United States Patent 12,397,048 (BUNYAVIRALES VACCINE) - sequence listing, part 11

SEQ ID NO: 12591 - RNA, 4326 nt, synthetic construct
  misc_feature 1..4326: note = derived and/or modified CDS sequence (opt1) from CHATV(LEIV-15854)__HQ734820.1__GP
  source 1..4326: mol_type = other RNA
atgatcttcatcctgatcctcttcgccgtgagcgccgcgtcccccgtctaccagcgctgcttccaggacggcgccatcgtgaagcagaacccgagcaaggaggccgtgaccgaggtctgcctgaaggacgacgtgtccatgatcaagaccgaggcccggtacgtgaagaacgccacggggatctacagcaacaacgtcgcgatccgcaagtggctggtgtccgactggcacgactgccggccccgcaaggtgagcggcgggcacatcaacgtcatcgaggtgggcgacgacctctccctgcacaccgagagctacgtgtgctccgccgactgcaccatcggggtcgacaaggagaccgcccaggtgcggctgcagacggacaccaccaaccacttcgagatcgccggcaccacggtcaagagcggctggttcaagtccaccacctacatcaccctcgaccagacgtgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtcaccctgaccctcctgatcttcgtgctgctctccatcctgagcaagacgtacatctgctacctgctcatgccgatcttcatccccatcgcctacgtgtacgggatcatctacaacaagtcctgcaagaagtgcaagctgtgcggcctggtctaccaccccttcaccgagtgcgggacccactgcgtgtgcggcgcccgctacgacaccagcgaccggatgaagctccaccgcagctccggcctgtgccccgggtacaagagcctgcgggccgcgcgcgtgatgtgcaagtccaagggcccggccagcatcctctccatcatcacggccatcctggtcctgaccttcgtgacccccatcaacagcatggtcatcggggagtccaaggaggtgttcgagctcgaggagctgcccgacgacatgctggagatggccctcaagatcaacctgtactacttcgtgtgcgtcatgaactacgccgtgacctggagcctggtgatcgtcgcgctcctgatcgccctgatcttcaagaagtaccagcaccggttcctcaacctgtacgccatgtactgcgaggagtgcgacatgtaccacgaccgcatcggcctgaagcggaacggcgacttcacgaacaagtgccgccagtgcacgtgcgggcagtacgaggacgccaccggcctcatgacccaccggaagacctacaactgcctggtgcagtacaagtccaagtggatcctgaacttcctcatcacctacatggtgctgaccctgatcaaggacagcgccatcatcgtccaggcggccgggaccgacttctccgcctgcctcgaggcccagagcgtggactggaactgcacgggccccttcctgaacctggggaactgccagaagcagcagaagaaggagtcctacgccaacatcgcgacccagctcaagggcctgcaggccatcagcgtgctggacgtcccgatgatcgccaacatccccgaggacatcgccggcgcgctgcgctacatcgaggagaaggacaccttccacgtgcagctcaccgccgagtacgccatgctgacgcggtactgcgactactacacccagttcgccgacaactccgggtacagccagaccacctggcgcgtgtacctgcggtcccacgacttcgacgcctgcatcctctaccccaaccagcacttctgccgctgcgtcaagcacggcgacaagtgcagctccagcaactgggacttcgcgaacgagatgaagaactactacagcgggaagcagaacaagttcgacaaggacctgaacctggccctcatggccgtgcaccacgccttccgcggcacctccagcgcctacatcgcgacgatgctgtccaagaagctgaacaacgacctcatcacctacaccaacaagatcaaggagaagttccccgggaacgccctgctgaaggccatcatggactacatcagctacatgaagggcctctccgagatgaccaacttcaagtacgacgagttctgggacgacctgctgcacaagccgagccccacgaacgccccgcccctctcccgggacagcgagccctcctacaacttcaagagcgtgatctccagccgctccgtcaagagctgcaagaacgtgaagaacgtggtctgcctgagcccccggagcggcgcctcctacgacagcatcctggcgtgcggggagcccaacggccccagcgtgtacaagaagccgtccgacggggtgttccagagcaactccgacaagaccatgtactgcctcgccgacagccactgcctggaggacttcgaggtcgtgtcccaggaggagctggacgccatcaagaagtccaagtgctgggtgaccgagtaccccaacgtcaagctctccaagctgagcgacggcatcacctcctgccgcatgaaggacagcgggaagtgcaacgtggccgcgaaccggtggcccatcatccagtgcgagaacgacaagttctactactccgagctgcagaacgactacgacaagacgcaggacatcggccacttctgcctcagccccggctgctccaccatccgcttcccgatcaaccagaagcacatcagcaactgcaactggcaggtctcccggagctccatcgccaagatcgacgtgcacgacatcgaggacatcgaccagtaccgcaaggccatcacccagaagctgcagaccgggctgagcctcttcaagtacgccaagacgaagaacctgccccacatcaagcccatctacaagtacatcaccatcgagggcaccgagaccgccgaggggatcgagtccgcgtacatcgagagcgagatcccggccctggccggcacgagcatcggcttcaagatcaactccaaggaggggaagcacctcctggacatcgtgggctacgtcaagagcgcctcctacagctccgtgtacaccaagctgtacagcaccgggcccacctccggcatcaacacgaagcacgacgagctctgcaccgggccctgccccgtgaacatcaaccaccagaccggctggctgaccttcgccaaggagcggacgagctcctggggctgcgaggagttcgggtgcctggcgatcagcgacggctgcgtgttcgggtcctgccaggacatcgtccgcgacgagctcagcgtgtaccggaaggagaccgaggaggtgaccgacgtcgagctgtgcctgaccttctccgacaagacgtactgcaccaacctcaacccgatcacccccatcatcaccgacctgttcgaggtgcagttcaagacggtggagacctacagcctgccccgcatcgtcgccgtgcagaaccacgaggtgaagatcggccagatcaacgacctcgggatctactccaagggctgcggcaacgtccagaaggtgaacgggaccgtgtacggcaacggggtccccaagttcgactacctgtgccacctggccagccggaaggaggtgatcgtgcgcaagtgcttcgacaacgactaccaggcctgcaagttcctccagaccccggcctcctaccggctggaggagaacagcggcacggtcaccgtgatcgactacaagaagatcctggggaccatcaagatgaaggcgatcctcggcgacgtcaagtacaagaccttcgccgacaacgtggacatgaccgccgagggctcctgcgccgggtgcatcaactgcttcgagaacatccactgcgagctgacgctgcacaccaccatcgacgcgagctgccccgtgaccagcccctgcacggtcttccacgaccgcatcctcatcacccccaacgagcacaagtacgccatgaaggtgatctgcaccgagaagccgggcaacaccctgacgatcaagatctgctccaccaagatcgacgccagcctggccctcatcgacgccaagcccatcctggagctggcgcccgtggaccagaccgcctacatccgggagaaggacgagcgctgcaagacctggatgtgccgggtccgcgacgaggggctccaggtgatcctggagcccttcaagaacctgttcggctcctacatcgggatcttctacacgttcatcatctgcgtgatcgtcctcctgatcgtgatctacatcgtgctgccgatctgcttcaagctccgcgacaccctgcggcagcacgaggacgcctacaagcgcgagatgaagatccggtga

SEQ ID NO: 12592 - RNA, 4326 nt, synthetic construct
  misc_feature 1..4326: note = derived and/or modified CDS sequence (opt1) from CHATV(LEIV-17756)__EU621834.1__GP
  source 1..4326: mol_type = other RNA
atgatcttcatcctgatcctcttcgccgtgagcaccgcctcccccgtctaccagcgctgcttccaggacggcgcgatcgtgaagcagaacccgagcaaggaggccgtgaccgaggtctgcctgaaggacgacgtgtccatgatcaagacggaggcccggtacatccgcaacgccaccgggaccttcagcaacaacgtggccatccggaagtggatcgtctccgactggcacgactgccgccccaagaaggtgagcggcgggcacatcaacgtgatcgaggtcggcgacgacctgtccctccacaccgagagctacgtgtgctccgcggactgcacgatcggggtggacaaggagaccgcccaggtccggctgcagaccgacaccacgaaccacttcgagatcgccggcaccaccgtcaagagcggctggttcaagtccaccacgtacatcaccctggaccagacctgcgagcacctcaaggtgagctgcgggcccaagtccgtgcagttccacgcctgcttcaaccagcacatgagctgcgtgcgcttcctgcaccggaccatcctgcccggctccatcgcgaacagcatctgccagaacatcgagatcatcatcctcgtgacgctgaccctgctcatcttcgtcctgctgtccatcctcagcaagacctacatctgctacctgctgatgccgatcttcatccccatcgcctacatctacgggatcatctacaacaagtcctgcaagaagtgcaagctctgcggcctggtgtaccaccccttcaccgagtgcgggacgcactgcgtgtgcggcgcccgctacgacaccagcgaccggatgaagctgcaccgcagctccggcctctgccccgggtacaagagcctgcgggccgcccgcgtcatgtgcaagtccaagggcccggcgagcatcctgtccatcatcaccgccatcctcgtgctgaccttcgtgacgcccatcaacagcatggtcgtgggggagtccaaggaggtcttcgagctggaggagctccccgacgacatgctggagatggccctgaagatcaacttctactacttcgtgtgcgtgatgaactacgccgtcacctggggcctcatcgtggtggccctgctgatcggcctcatcttcaagaagtaccagcaccggttcctgaacctgtacgcgatgtactgcgaggagtgcgacatgtaccacgaccgcaccgggctcaagcggaacggcgacttcaccaacaagtgccgccagtgcacgtgcgggcagtacgaggacgccaccggcctgatgacccaccggaagacctacaactgcctggtccagtacaagagcaagtggatcctcaacttcctgatcacgtacatggtgctgaccctcatcaaggactccgccatcgtggtccaggccaccgggaccgacttcagctcctgcctggagacgcagagcgtgaactggaactgcaccggccccttcctgaacctcggcaactgccagaagcagcagaagaaggagtcctacgccaacatcgcgacccagctgaaggggctgcaggccatcagcgtgctcgacatgccgatgatcgcctccatccccgaggacatcgccggcgccctgcgctacatcgaggagcgggagaccttccacgtccagctgaccgcggagtacgccatgctgacgcgctactgcgactactacacccagttcgccgacaacagcgggtactcccagaccacctggcgggtgtacctccgcagccacgacttcgacgcctgcatcctgtaccccaaccagcacttctgccgctgcgtgaagcacggcgacaagtgctccagcagcaactgggacttcgcgaacgagatgaagaactactactccgggaagcagaacaagttcgacaaggacctgaacctcgccctgatgacgatgcaccacgccttccggggcaccagctccgcctacatcgccgcgctgctcagcaagcgctccaacgacgacctggtcgcctacaccaacaagatcaaggagaagttccccggcaacgccctgctcaaggccgtgatggactacatcagctacatgaagtccctgagcgagatgtccaacttcaagtacgacgagttctgggacgacctgctccacaagccgaaccccaccaaggcccccagcctgtcccgcggggacgagcccgcgtacaacttcaagctggccatcagctcccggagcatgaagtcctgcaagaacgtcaagagcgtggtgtgcctctccccgcggagcggcgtgagctacgactccatcctggcctgcggggagcccaacgcccccagcgtccaccgcaagccctccgacggcgtgttccagagcaactccgacaagacgatgtactgcctggccgacagccactgcctcgaggacttcgaggtggtctcccaggaggagctggacgcgatcaagaagtccgagtgctgggtgaccgagtacccgaacgtgaagctgagcaagctcagcgacgggatcaagtcctgccggatgaaggacagcggcaagtgcaacgtcgccaccaaccgctggcccatcatccagtgcgagaacgacaagttctactactccgagctgcagaacgactacgacaagacccaggacatcggccacttctgcctgagccccgggtgctccacgatccggttccccatcaaccagaagcacatcagcaactgcaactggcaggtctcccgcagctccatcgccaagatcgacgtgcacaacatcgaggacatcgagcagtaccggaaggccatcacccagaagctccagaccagcctgagcctgttcaagtacgcgcgcaccaagaacctcccgcacatcaagcccatctacaagtacatcacgatcgagggcaccgagaccgccgaggggatcgagtccgcctacatcgagagcgagatccccgccctggccggcacctccatcggcttcaagatcaacagcaaggaggggaagcacctcctggacgtgatcggctacgtgaagtccgcgagctactccagcgtgtacacgaagctgtactccaccgggccgaccagcggcatcaacaccaagcacgacgagctgtgcacggggccctgccccgccaacatcaagcaccagaccggctggctcaccttcgcccgggagcgcacctccagctggggctgcgaggagttcgggtgcctggccatctccgacggctgcgtcttcgggagctgccaggacatcgtgcgggacgagctgtccgtgtaccgcaaggagacggaggaggtcaccgacgtggagctctgcctgaccttcagcgacaagacctactgcacgaacctgaaccccatcaccccgatcatcaccgacctcttcgaggtgcagttcaagaccgtcgagacgtactccctgccccggatcgtggccatccagaaccacgagatcaagatcggccagatcaacgacctgggggtgtacagcaagggctgcggcaacgtccagaaggtgaacgggaccgtgtacggcaacggggtccccaagttcgactacctctgccacctggcgtcccgcaaggaggtgatcgtgcggaagtgcttcgacaacgactaccaggcctgcaagttcctgcagacccccgccagctaccgcctcgaggagaacagcggcaccgtcaccgtgatcgactacaagaagatcctggggacgatcaagatgaaggccatcctgggcgacgtgaagtacaagaccttcgccgacaacgtcgacatcaccgcggagggctcctgcaccgggtgcatcaactgcttcgagaacatccactgcgagctcacgatccacaccaccatcgacgccagctgcccggtgacctccccctgcacggtcttccacgaccgcatcctggtgacccccaacgagcacaagtacgccatgaaggtgatctgcaccgagaagcccggcagcaccctggccatcaagatctgcaacacgaagatcgacgcgtccctcgccctgatcgacgccaagccgatcctggagctcgcccccgtcgaccagaccgcctacatccgggagaaggacgagcgctgcaagacctggatgtgccgggtgcgcgacgaggggctccaggtgatcctggagcccttcaagaacctgttcggcagctacatcgggatcttctacaccttcgtcatctccatcatcgcgctgctgatcgtgatctacatcatcctccccatctgcttcaagctgcgggacacgctgcgcaagcacgaggacgcctacaagcgggagatgaagatccgctga

SEQ ID NO: 12593 - RNA, 4326 nt, synthetic construct
  misc_feature 1..4326: note = derived and/or modified CDS sequence (opt1) from CHATV(LEIV-18733)__HQ734821.1__GP
  source 1..4326: mol_type = other RNA
atgatcttcatcctggtgctcctggccgtcagcaccgcctcccccgtgtaccagcgctgcttccaggacggcgcgatcgtgaagcagaacccgagcaaggaggccgtcaccgaggtgtgcctgaaggacgacgtgtccatgatcaagacggaggcccggtacatgaagaacgccaccgggaccttcagcaacaacgtcgccatccgcaagtggctcgtgtccgactggcacgactgccggcccaagaaggtgagcggcgggcacatcaacgtcatcgaggtgggcgacgacctgtccctgcacaccgagagctacgtgtgctccgcggactgcacgatcggggtcgacaaggagaccgcccaggtgcgcctccagaccgacaccacgaaccacttcgagatcgccggcaccaccgtcaagagcggctggttcaagtccaccacgtacatcaccctggaccagacctgcgagcacctgaaggtgagctgcgggcccaagtccgtgcagttccacgcctgcttcaaccagcacatgagctgcgtgcggttcctccaccgcaccgtcctgcccggctccatcgcgaacagcatctgccagaacatcgagatcatcatcctggtgacgctcaccctgctgatcttcgtgctcctgtccatcctgagcaagacctacatctgctacctcctgatgccgatcttcatccccatcgcctacgtctacgggatcatctacaacaagtcctgcaagaagtgcaagctgtgcggcctcgtgtaccaccccttcaccgagtgcgggacgcactgcgtgtgcggcgcccggtacgacaccagcgaccgcatgaagctgcaccggagctccggcctgtgccccgggtacaagagcctccgcgccgcccgggtcatgtgcaagtccaagggcccggcgagcatcctgtccatcatcaccgccatcctggtgctcaccttcgtcacgcccatcaacagcatggtgatcggggagtccaaggaggtgttcgagctggaggagctgcccgacgacatgctcgagatggccctgaagatcaacttctactacttcgtctgcgtgatcaactacgccgtgacctggggcctgatcgtcgtggccctcctgatcggcctggtgttcaagaagtaccagcaccgcttcctcaacctgtacgcgatgtactgcgaggagtgcgacatgtaccacgaccggaccgggctgaagcgcaacggcgacttcaccaacaagtgccggcagtgcacgtgcgggcagtacgaggacgccaccggcctcatcacccaccgcaagacctacaactgcctggtcaagtacaagagcaagtggatcctgaacttcctcatcacgtacatggtgctgaccctgatcaaggactccgccatcgtggtccaggccgccgggaccgacttcagcgcgtgcctcgaggcccagtccgtggactggaactgcaccggccccttcctgaacctgggcaactgccagaagcagcagaagaaggagagctacgccaacatcgccacgcagctcaaggggctgcaggccatctccgtgctggacatgccgatgatcgcgagcatccccgaggacatcgccggcgccctgcggtacatcgaggagaaggagaccttccacgtccagctcaccgccgagtacgcgatgctgacccgctactgcgactactacacccagttcgccgacaactccgggtacagccagacgacctggcgggtgtacctgcgctcccacgacttcgacgcctgcatcctctaccccaaccagcacttctgccggtgcgtgaagcacggcgacaagtgcagctccagcaactgggacttcgccaacgagatgaagaactactacagcgggaagcagtccaagttcgacaaggacctgaacctggccctcatgaccgtccaccacgcgttccgcggcaccagctccgcctacatcgccacgatgctgagcaagaagtccaacaacgacctggtggcctacaccaacaagatcaaggagaagttccccggcaacgccctcctgaaggcggtgatggactacatcagctacatgaagtccctgagcgagatgaccaacttcaagtacgacgagttctgggacgacctcctgtaccgcccgaaccccaccaaggccccctccctgagccgggagtccgagacgagctacaacttcaagctcgtcatctcccccaagagcatgaagtcctgcaagaacgtcaagagcgtggtgtgcctgtccccgcgcagcggggccagctacgactccatcctggcctgcggcgagcccaacgggcccagcgtgtaccggaagccctccggcggggtgttccagagcaactccgacaagaccatgtactgcctcgccgacagccactgcctggaggacttcgaggtcatcggccaggaggagctggacgcgatcaagaagtccgtgtgctgggccgtggagtacccggacgtcaccctcagcaagctgtccgacggcgtcaagagctgccgcatgaaggactccgggaagtgcaacgtggccgccaaccggtggcccatcatccagtgcgagaacgacaagttctactacagcgagctgcagaacgactacgacaagacccaggacatcggccacttctgcctctcccccgggtgcagcacggtgcgcttccccatcaaccagaagcacatctccaactgcaactggcaggtcagccggtccagcatcgcgaagatcgacgtgcacgacatcgaggacatcgaccagtaccgcaaggccatcacccagaagctgcagacctccctgagcctcttcaagtacgccaagaccaagaacctgccgcacatcaagcccatctacaagtacatcacgatcgagggcaccgagaccgccgagggcatcgagagcgcctacatcgagtccgagatccccgcgctggccgggaccagcgtgggcttcaagatcaactccaaggaggggaagcacctcctggacatcatcggctacgtcaagagcgcctcctacagctccgtgtacacgaagctgtacagcaccgggccgacctccggcatcaacaccaagcacgacgagctctgcacgggcccctgccccgccaacatcaaccaccagaacgggtggctgaccttcgccaaggagcggaccagctcctggggctgcgaggagttcgggtgcctggcgatcagcgacggctgcgtgttcgggtcctgccaggacatcgtgcgcgacgagctcagcgtgtaccggaaggagaccgaggaggtcacggacgtggagctgtgcctgaccttctccgacaagacctactgcaccaacctcaaccccatcacgccgatcatcaccgacctgttcgaggtgcagttcaagaccgtcgagacctacagcctgccccgcatcgtggccatccagaaccacgagatcaagatcggccagatcaacgacctcggcgtgtactccaaggggtgcggcaacgtccagaaggtgaacgggacggtgtacggcaacggggtccccaagttcgactacctgtgccacctggccagccggaaggaggtgatcgtccgcaagtgcttcgacaacgactaccaggcctgcaagttcctccagacccccgcctcctaccggctggaggagaacagcggcaccatcaccgtgatcgactacaagaagatcctgggcaccatcaagatgaaggcgatcctcggggacgtgaagtacaagacgttcgccgacaacgtcgacatcaccgtggagggcagctgcgccgggtgcatcaactgcttcgagaacatccactgcgagctgaccatccacaccacgatcgaggcctcctgcccggtgaccagcccctgcaccgtcttccacgaccgcatcctgatcacccccaacgagcacaagtacgcgatgaaggtggtgtgcacggagaagcccggcaacaccctcaccctgaaggtctgcaacaccaaggtggacgcctccctggccctcatcgacgccaagccgatcctggagctggcccccgtggaccagacggcgtacatccgggagaaggacgagcgctgcaagacctggatgtgccgggtccgcgacgaggggctccaggtgatcctggagcccttcaagaacctgttcggcagctacatcggcatcttctacaccatcatcatctccatcatcgtgctcctgatcgtcatctacatcatcctgcccgtgtgcttcaagctccgcgacaccctgcggcagcacgaggacgcctacaagcgcgagatgaaggtgcggtga

SEQ ID NO: 12594 - RNA, 4326 nt, synthetic construct
  misc_feature 1..4326: note = derived and/or modified CDS sequence (opt1) from CHATV(LEIV-22712)__HQ734822.1__GP
  source 1..4326: mol_type = other RNA
atgatcttcatcctgatcctcttcgccgtgagcgccgcgtcccccgtctaccagcgctgcttccaggacggcgccatcgtgaagcagaacccgagcaaggaggccgtgaccgaggtctgcctgaaggacgacgtgtccatgatcaagaccgaggcccggtacacgaagaacgccaccgggaccttcagcaacaacgtggcgatccgcaagtggctggtctccgactggcacgactgccggcccaagaaggtgagcggcgggcacatcaacgtgatcgaggtcggcgacgacctctccctgcacaccgagagctacgtgtgctccgccgactgcacgatcggggtggacaaggagaccgcccagatccgcctgcagaccgacaccacgaaccacttcgagatcgccggcaccaccgtcaagagcggctggttcaagtccaccacgtacatcaccctcgaccagacctgcgagcacctgaaggtgagctgcgggcccaagtccgtgcagttccacgcgtgcttcaaccagcacatgagctgcgtccggttcctgcaccgcaccgtgctccccggctccatcgccaacagcatctgccagaacatcgagatcatcatcctggtgacgctgaccctcctgatcttcgtcctgctctccatcctgagcaagacctacatctgctacctgctcatgccgatcttcatccccatcgcctacgtgtacgggatcatctacaacaagtcctgcaagaagtgcaagctgtgcggcctggtgtaccaccccttcaccgagtgcgggacgcactgcgtctgcggcgcccggtacgacaccagcgaccgcatgaagctccaccggagctccggcctgtgccccgggtacaagagcctgcgcgccgcgcgggtgatgtgcaagtccaagggcccggccagcgtgctctccatcatcaccgccatcctggtcctgaccttcgtgacgcccatcaacagcatggtcgtgggggagtccaaggaggtgttcgagctcgaggagctgcccgacgacatgctggagatggccctcaagatcaacttctactacttcatctgcgtcatgaactacgccgtgacctggggcctgatcgtggtcggcctgctcatcgggctggtgttcaagaagtaccagcaccgcttcctgaacctctacgcgatgtactgcgaggagtgcgacatgtaccacgaccggaccggcctgaagcgcaacggggacttcaccaacaagtgccggcagtgcacgtgcggccagtacgaggacgccaccgggctgatcacccaccgcaagacctacaactgcctcgtgcagtacaagagcaagtggatcctgaacttcctgatcgcctacatgacgctcaccctgatcaaggactccgccatcatcgtccaggccaccggcaccgacttcatcagctgcctggagacgcagtccgtgaactggaactgcaccggccccttcctcaacctggggaactgccagaagcagcagaagaaggagccgtacgcgaacatcgccacccagctgaagggcctccaggccatcagcgtgctggacatccccatgatcgccaacatccccgaggacatcgccggggcgctgcggtacatcgaggagaaggagaccttccacgtccagctgaccgccgagtacgccatgctcacgcgctactgcgactactacacccagttcgccgacaactccggctacagccagaccacctggcgggtgtacctgcgctcccacgacttcgacgcgtgcatcctgtaccccaaccagcacttctgccggtgcgtgaagcacggggacaagtgcagctccagcaactgggacttcgccaacgagatgaagaactactactccggcaagcagagcaagttcgacaaggacctcaacctggccctgatgacgatgcaccacgccttccgcggcaccagctccgcctacatcgcgaccctcctgagcaagaagctgaacgacgacctcgccgcctacaccaacaagatcaaggagaagttcccggggaacgccctgctgaaggccatgatggactacatctcctacatgaagtccctctccgagatggcgaacttcaagtacgacgagttctgggacgacctgctgcacaagcccgaccccacgaaggcgcccctcctgagccgcggctccgagccggtctacaacttcaagctggtggtgagctcccggagcgtcaagtcctgcaagaacgtcaagagcgtggtgtgcctcagcccccgcagcggggtgtcctacgacagcgtgctggcctgcggcgagcccaacgggccctccgtctaccggaagccgagcgacggcgtgttccagagcaactccgacaagaccatctactgcctggccgacagccactgcctcgaggacttcgaggtgatctcccaggaggagctggacgccatcaagaagtccgagtgctgggtcatcgagtaccccaacgtgaagctgaccaagcccagcgacggcatcaagagctgccgcatgaaggactccgggaagtgcaacgtggccaccaaccggtggcccatcatccagtgcgagaacaacaacttctactacagcgagctccagaacgactacgacaagacgcaggacatcggccacttctgcctgtccccggggtgcagcaccatccgctaccccatcaaccagaagcacatctccaactgcaactggcaggtcagccactccagcatcgccaagatcgacgtgcacaacatcgaggacatcgagcagtaccggaaggccatcacccagaagctgcagacctccctcagcctgttcaagtacgccaagacgaagaacctgccccacatcaagccgatctacaagtacatcaccatcgagggcaccgagaccgcggagggcatcgagtccgcctacatcgagagcgagatccccgccctcgccgggacgtccatcggcttcaagatcaacagcaaggaggggaagcacctcctggacgtgatcggctacgtcaagagcgcctcctacagctccgtgtacagcaagctgtactccaccgggcccaccagcggcatcaacaccaagcacgacgagctgtgcacgggcccctgcccggagaacatcaagcaccagaccgggtggctgaccttcgcgcgcgagcggacctccagctggggctgcgaggagttcgggtgcctcgccatctccgacggctgcgtgttcgggagctgccaggacatcgtcaaggacgagctgtccgtgtaccgcaaggagacggaggaggtgaccgacgtcgagctgtgcctcaccttcagcgacaagacctactgcacgaacctgaaccccatcacccccatcatcaccaacctgttcgaggtgcagttcaagaccgtggagacgtactccctcccccggatcgtcgccatccagaaccacgagatcaagatcggccagatcaacgacctgggcgtgtacagcaaggggtgcggcaacgtgcagaaggtcaacgggaccgtgtacggcaacggggtgccgaagttcgactacctgtgccacctcgcctcccgcaaggaggtcatcgtgcggaagtgcttcgacaacgactaccaggcctgcaagttcctgcagacccccgcgagctaccgcctggaggagaactccggcgccatcaccgtgatcgactacaagaagatcctcggcaccatcaagatgaaggccatcctgggggacgtcaagtacaagacgttcgccgacaacgtggacatcaccgccgagggcagctgcaccgggtgcatcaactgcttcgagaacatccactgcgagctgaccatccacacgaccatcgaggcgtcctgccccgtcaccagcccctgcaccgtgttccacgaccggatcctcgtgacgccgaacgagcacaagtacgccatgaaggtcgtgtgcaccgagaagcccggcagcaccctggtgatcaaggtctgcaacaccaagatcgacgcctccctggccctcatcgacgcgaagcccatcctggagctggcccccgtggaccagacggcctacatccgcgagaaggacgagcggtgcaagacctggatgtgccgcgtgcgggacgaggggctccaggtcatcctggagccgttcaagaacctgttcggcagctacatcggcatcttctacaccttcatcatctccatcatcgtgctcctgatcgtgatctacatcatcctgcccatctgcttcaagctccgcgacaccctgcgcaagcacgaggacgcctacaagcgggagatgaagatccgctga

SEQ ID NO: 12595 - RNA, 4332 nt, synthetic construct
  misc_feature 1..4332: note = derived and/or modified CDS sequence (opt1) from INKV(KN3641)__U88059.1__GP
  source 1..4332: mol_type = other RNA
atggaggtgctgaacctcatctggctgctgaccctctgcagcgcctcccccgtcttccagcgctgcttccaggacggcgccatcgtgaagcagaacccgagcaaggaggcggtgaccgaggtctgcctgaaggacgacgtgtccatgatcaagacggaggccaagtacatcaagaacaccaccgggaccttcgccaacaacatcgccatgcggaagtggctggtggccgactggcacgactgccgcccccagaagtcctccggcgggcacatcaacgtcatcgaggtgggcgacgacctcagcctgcacacggagtcctacatctgcagcgcggactgcgtgatcaccgtcgacaaggagaccgcccagatccggctgcagaccgacaacacgaaccacttcgaggtggccgggaccaccgtgaagtccggctggttcaagagcaccacgtacatcaccctcgaccagacctgcgagcacctgaaggtctcctgcggccccaagagcatccagttccacgcctgcttcaaccagcacatgtcctgcgtgcgcttcctgcaccggaccatcctccccgggagcatcgcgaactccatctgccagaacatcgagatcatcatcctggtgacgctgagcctcgtcatcttcatcttcctgaccatcgtgtccaagacctacgtgtgctacctgctcatgccgatcttcatccccatcgcctacatctacggctggatctacaacaagagctgcaagaagtgccgcctgtgcgggctggtctaccaccccttcaccgagtgcggcacgcactgcgtgtgcggggcccggtacgagacctccgaccgcatgaagctccaccgggccagcggcctgtgccccggctacaagaacctgcgcgccgcgcgggtgatgtgcaagagcaaggggccggcctccgtcctcagcatcatgaccgccgtgctgatcctgaccttcgtgacgcccatctccgccatggtcatcggcgagagctccgaggtgtacaccctcggggacctgcccgacgacatggtcgagatggccgagcgcgtgaacatctactaccagatcatcatcatcaactacagcatcacctgggtgttcctgctcctgggcctgatcatcgcgtacttcttccggaagtaccagcaccgcttcctctccttctacgccatgtactgcaaggagtgcgacatgtaccacgagcgggccggcctgacctactggggcgacttcacgaacaagtgccgccagtgcacgtgcgggcagttcgaggacgtcaccgggctgatggtgcacaagaagtcctacaactgcatcatcaagtacaaggccaagtggatccgggacatgctcatcacctacctgctgatcatgctcatcaaggacagcctgctgttcgtgggcgccaccgggaccgacttcgcggcctgcatcgacgagaagaccgtcacctggaaccgcacgggccccttcctcaacctgggccggtgcgacaagagccagaagaagaccgggtacaccgacatcgccgaccagctgaagggcctcggggccatctccgtgctggacatcccgatgatcaagaagatgcccgacgagatcagcggctccctgaagtgcatcgacgacctcgagacccaccacgagcagctgaccgccgagtacgcgttcctgacgcgctactgcgactactacacccagtacaccgacaacagcgggtactcccagaccgtgtggcggacgtacctgcgcagccacgacttcggcgcctgcgtcgtgtaccccaaccagcacttctgccgctgcgtgaagcacggcgacaagtgcaactccgccaagtgggacttcgccaacgagatgaagaccttctacaccgggcagaaggcgaagttcaacaaggacctcaacctggccctgctcgtcctgcacaaggccttccggggcaccgggacgagctacatcgccgagtccatggcccgcaaggacaaccggagcatgacccacttcgcgctggagatcaagaagaagttccccaccaacgccctcctgaccgccctgatcgactacatcagctacctccagtccccggccgagatgagcacgttcgagctggacgaggactgggaggacttcaagtacaagcccgagcccaccgagagcccccagctgcgcagccaccggaccgaccagtacaacttcaagaacgccgactccaacagcaacgtgaaggtgtgcaagaacatccagaaggtctcctgcatcagcccgcgctcccgggcgaagttcgagaacatcatcgcctgcggcgagcacgccaaccccagcgtgtacaccatgcccaacgtgtccatctaccagagcaactccgagcgcagccactactgcatcgccgactcccactgcctcgaggagtacgaggtcgtggagacggagctgctgaacgccctcaagaagtccaagtgctgggcgcgggagatggacgacatcgtgctgcacaagcaggtcgacgggctgcgcagctgccggatgaaggacaccggcaactgcaacgtgcaggagaacgactggaccatcgtgctctgcgagaacggcaactactactacagcgaggcccaccgcgactacgacaaggaccaggacgtcgggcacttctgcctgagcccccggtgctccaccatccgctacccgatcagcaagcggcacatcaagaactgcgactggcagatctcccacagcacgatcgacaagatctccgtgcaggagctggccgacatcgagcagtacaagaaggccatcagccagaagctccagacctccctgagcatcttcaagtacgtgaagaccaagaacctgccccacatcaagcccgcgtacaagtacatcaccgtcgagggcgtggagacggtggaggggatcgagaacgccttcatcgagtccgagatccccgccctcgccggcaccgccatcggcttcaagatcaacagccgcgaggggaactacctgatggacgtcatcggctacgtgaagtccgggagctactccgcgacctacaccaagctgtacatcacgggcccgaccatcggggtgaacaccaagcacgacgagaagtgcaccggcccctgccccgccatcatcgaccacaaggagggctggctcacgttcgccaaggggcggaccagcacctggggctgcgaggagttcgggtgcctggccgtctccgacggctgcgtgttcgggagctgccaggacatcatcaaggacgagctggccgtgcaccgcaagaccacggaggagccgaccaccgtcgagctctgcctgaccttctccgacaagacctactgcacgaacctgaacgcgatcacccccatcatcaccgacaagttcgaggtgcagttcaagaccgtggagagctacacgctcccccggatcatcgccatcaagaaccacgagatcaaggtcggccagatcaacgacctgggcgtgtactccaaggggtgcggcaacgtgcagaagatcaacgggaccaactacggcaacgggctgcccaagttcgactacctctgccacctggccggccgcaaggaggtcatcatccgcaagtgcttcgacaacgactaccaggcctgcaagttcctgcagagcccgcccagctaccggctcgaggagcaccagggcaccgtgaccgtgatcgactacaagaagatcctggggacgatcaagatggaggccatcctgggcgacgtcaagtaccgcaactaccagtccaacatcgagatcaacgcgaaggggacctgcgccggctgcatcaactgcttcgagaacatccactgcgagttcaccatccacaccacggtggaggccagctgccccatcgtgaccgactgggtctccttccacgaccggatcctcatcacccccgacgagcacaagtacgccctgaaggtggtgtgccaggagaagccgaagctgagcctcaagttcaagatctgcaacaccaacatcgacgcgtccatgacggtcgtggacagcaagcccatcctggagctggcccccgtcgaccagaccacctacatccgcgagcgggacgagcgctgcaagacctggatgtgccgggtgcgcgacgaggggttccaggtgatcctcgagcccttcaagaacctgttcggctcctacatcggcatcttctacacggggatcctgtgcatcgtctgcctcctgatcgtgatctacatcatcctgccgatctgcttcaagctccgggacaccctgcgccagctggaggacgcctacaagaaggaggtgaagatccggtga

SEQ ID NO: 12596 - RNA, 4332 nt, synthetic construct
  misc_feature 1..4332: note = derived and/or modified CDS sequence (opt1) from INKV(SWAR83-161)__U88060.1__GP
  source 1..4332: mol_type = other RNA
atggaggtgctgaacctcatctggctgctgaccctctgcagcgcctcccccgtcttccagcgctgcttccaggacggcgccatcgtgaagcagaacccgagcaaggaggcggtgaccgaggtctgcctgaaggacgacgtgtccatgatcaagacggaggccaagtacatcaagaacgccaccgggaccttcgccaacaacatcgccatgcggaagtggctggtggcggactggcacgactgccgcccccagaagtcctccggcgggcacatcaacgtcatcgaggtgggcgacgacctcagcctgcacaccgagtcctacatctgcagcgccgactgcgtgatcacggtcgacaaggagaccgcccagatccggctgcagaccgacaacaccaaccacttcgaggtggccgggacgaccgtgaagtccggctggttcaagagcaccacctacatcacgctcgaccagacctgcgagcacctgaaggtctcctgcggccccaagagcatccagttccacgcgtgcttcaaccagcacatgtcctgcgtgcgcttcctgcaccggaccatcctccccgggagcatcgccaactccatctgccagaacatcgagatcatcatcctggtgaccctgagcctcgccatcttcatcttcctgacgatcgtctccaagacctacgtgtgctacctgctcatgccgatcttcatccccatcgcctacatctacggctggatctacaacaagagctgcaagaagtgcaagctgtgcgggctggtgtaccaccccttcaccgagtgcggcacccactgcgtctgcggggcccgctacgagacgtccgaccggatgaagctccaccgcgcgagcggcctgtgccccggctacaagaacctgcgggccgcccgcgtgatgtgcaagagcaaggggccggcctccgtgctcagcatcatgaccgccatcctgatcctgaccttcgtcacccccatctccgcgatggtgatcggcgagagctccgaggtgtacacgctcgacgagctgcccgacgacatggtccagatggccgagcgggtgaacatctactaccagatcatcatcatcaactacagcatcacctgggccttcctcctgttcgggctggtcctggcctacttcttcaagaagtaccagcaccgcttcctctccttctacgccatgtactgcaaggagtgcgacatgtaccacgagcgggcgggcctgacctactggggcgacttcaccaacaagtgccgccagtgcacgtgcgggcagttcgaggacgtgaccggcctgatggtgcacaagaagtcctacaactgcatcatcaagtacaaggccaagtggatccgggacatcctcatcacctacctgatcatcatgctgatcaaggactccctcctgttcgtcggggccaccggcacggacttcgccgcctgcatcgacgagaagaccgtgacctggaactgcaccgggcccttcctgaacctcggcaagtgcgacaagagccagaagaagatcggctacgcggacatcgccgaccagctgaaggggctgggcgccatctccgtgctcgacatcccgatgatcaagcgcatgcccgacgagatcagcgggtccctgaagtacatcgacggcctggagacgtaccacgagcagctcaccgccgagtacgcgttcctgacccggtactgcgactactacacccagtacaccgacaacagcgggtactcccagacggtctggcgcacctacctgcggagccacgacttcggcgcctgcgtggtgtaccccaaccagcacttctgccgctgcgtcaagcacggcgacaagtgcaactccgccaagtgggacttcgccaacgagatgaagaccttctacaccgggcagaaggccaagttcaacaaggacctgaacctcgcgctgctggtgctccacaaggccttccggggcacggggaccagctacatcgccgagtccatggcccgcaaggacaaccgcagcatgacccacttcgccctggagatcaagaagaagttccccaccaacgcgctgctcacggccctgatcgactacatcagctacctgcagtccctcgccgagatgagcaccttcgagctggacgaggactgggaggacttcaagtacaagccggagcccaccgaggcgccccagctgcggtcccaccgcaccgaccagtacaacttcaagaacgccgacagcaactccaacgtgaaggtctgcaagaacatccagaaggtgagctgcatcagcccccggagccgcgccaagttcgagaacatcatcgcctgcggcgagcacgccaacccgtccgtgtacatgatgcccaacgtcagcatctaccagtccaacagcgagcggtcccactactgcatcgccgacagccactgcctcgaggagtacgaggtggtggagtccgagctgctgaacgcgctcaagaagtccaagtgctgggccaaggagatggacgacatcgtcctgcacaagcagagcgacgggctgcgcagctgccggatgaaggacacgggcaactgcaacgtgcaggagaacgactggaccatcgtgctctgcgagaacggcaactactactacagcgaggcccaccgcgactacgacaaggaccaggacgtcgggcacttctgcctgagcccccggtgcagcaccatccgctaccccatcaacaagcggcacatccgcaactgcgactggcagatctcccacagcaccatcgacaagatctccgtgcaggagctggccgacatcgagcagtacaagaaggccatcagccagaagctccagacgtccctgagcatcttcaagtacgtgaagaccaagaacctgccgcacatcaagcccgcgtacaagtacatcaccgtcgagggcatcgagaccgtggaggggatcgagaacgccttcatcgagtccgagatccccgccctcgccggcacggccatcggcttcaagatcaacagccgggaggggaactacctgatggacgtgatcggctacgtcaagtccgcgagctactccgccacctacaccaagctgtacaccacggggcccaccatcggcgtgaacaccaagcacgacgagaagtgcaccgggccgtgcccgcccatcatcgaccacaaggagggctggctcacgttcgccaaggagcgcaccagcacctggggctgcgaggagttcgggtgcctggccgtgtccgacggctgcgtcttcgggagctgccaggacatcatcaaggacgagctggccgtgtaccggaagaccacggaggagctcaccaccgtggagctgtgcctgaccttctccgacaagacgtactgcaccaacctcaacgcgatcacccccatcatcaccgacaagttcgaggtccagttcaagaccgtggagagctacacgctgccccgcatcatcgccatcaagaaccacgagatcaaggtgggccagatcaacgacctgggggtctactccaagggctgcggcaacgtgcagaagatcaacgggaccaactacggcaacggggtgcccaagttcgactacctctgccacctggccagccggaaggaggtcatcatccgcaagtgcttcgacaacgactaccaggcctgcaagttcctgcagagcccgccctcctaccggctcgaggagcaccagggcaccgtgaccgtgatcgactacaagaagatcctggggatcatcaagatgaaggcgatcctgggcgacgtcaagtacaagaactaccagagcaacatcgagatcaacgccgagggcacgtgcgccgggtgcatcaactgcttcgagaacatccactgcgagttcaccatccacaccaccgtggaggcctcctgccccatcgtgacggactgcgtcagcttccacgaccgcatcctcatcacccccgacgagcacaagtacgccctgaaggtggtgtgccaggagaagcccaagctgtccctcaagttcaagatctgcaacaccaacatcgacgcgagcatgaccatcgtcgactccaagccgatcctggagctggcccccgtggaccagacgacctacatccgcgagaaggacgagcggtgcaagacctggatgtgccgcgtgcgggacgagggcttccaggtcatcctcgagcccttcaagaacctgttcgggagctacatcggcatcttctacaccgggatcctgtgcatcatctgcctcctgatcgtgatctacatcatcctgcccatctgcttcaagctccgcgacacgctgcggcagcacgaggacgcctacaagaaggagatgaagatccgctga

SEQ ID NO: 12597 - RNA, 4332 nt, synthetic construct
  misc_feature 1..4332: note = derived and/or modified CDS sequence (opt1) from INKV(Lovanger)__KU681435.1__GP
  source 1..4332: mol_type = other RNA
atggaggtgctgaacctcatctggctgctgaccctctgcagcgcctcccccgtcttccagcgctgcttccaggacggcgccatcgtgaagcagaacccgagcaaggaggcggtgaccgaggtctgcctgaaggacgacgtgtccatgatcaagacggaggccaagtacatcaagaacgccaccgggaccttcgccaacaacatcgccatgcggaagtggctggtggcggactggcacgactgccgcccccagaagtcctccggcgggcacatcaacgtcatcgaggtgggcgacgacctcagcctgcacaccgagtcctacatctgcagcgccgactgcgtgatcacggtcgacaaggagaccgcccagatccggctgcagaccgacaacaccaaccacttcgaggtggccgggacgaccgtgaagtccggctggttcaagagcaccacctacatcacgctcgaccagacctgcgagcacctgaaggtctcctgcggccccaagagcatccagttccacgcgtgcttcaaccagcacatgtcctgcgtgcgcttcctgcaccggaccatcctccccgggagcatcgccaactccatctgccagaacatcgagatcatcatcctggtgaccctgagcctcgccatcttcatcttcctgacgatcgtctccaagacctacgtgtgctacctgctcatgccgatcttcatccccatcgcctacatctacggctggatctacaacaagagctgcaagaagtgcaagctgtgcgggctggtgtaccaccccttcaccgagtgcggcacccactgcgtctgcggggcccgctacgagacgtccgaccggatgaagctccaccgcgcgagcggcctgtgccccggctacaagagcctgcgggccgcccgcgtgatgtgcaagtcccgggggccggccagcgtgctctccatcatgaccgccatcctgatcctgaccttcgtcacccccatcagcgcgatggtgatcggcgagtccagcgaggtgtacacgctcgacgagctgcccgacgacatggtccagatggccgagcgcgtgaacatctactaccagatcatcatcatcaactactccatcacctgggccttcctcctgttcgggctggtcctggcctacttcttcaagaagtaccagcaccggttcctcagcttctacgccatgtactgcaaggagtgcgacatgtaccacgagcgcgcgggcctgacctactggggcgacttcaccaacaagtgccggcagtgcacgtgcgggcagttcgaggacgtgaccggcctgatggtgcacaagaagtcctacaactgcatcatcaagtacaaggccaagtggatccgcgacatcctcatcacctacctgatcatcatgctgatcaaggacagcctcctgttcgtcggggccaccggcacggacttcgccgcctgcatcgacgagaagaccgtgacctggaactgcaccgggcccttcctgaacctcggccggtgcgacaagtcccagaagaagatcggctacgcggacatcgccgaccagctgaaggggctgggcgccatcagcgtgctcgacatcccgatgatcaagcgcatgcccgacgagatctccgggagcctgaagtacatcgacggcctggagacgtaccacgagcagctcaccgccgagtacgcgttcctgacccggtactgcgactactacacccagtacaccgacaactccgggtacagccagacggtctggcgcacctacctgcggtcccacgacttcggcgcctgcgtggtgtaccccaaccagcacttctgccgctgcgtcaagcacggcgacaagtgcaacagcgccaagtgggacttcgccaacgagatgaagaccttctacaccgggcagaaggccaagttcaacaaggacctgaacctcgcgctgctggtgctccacaaggccttccgcggcacggggacctcctacatcgccgagagcatggcccggaaggacaaccgcagcatgacccacttcgccctggagatcaagaagaagttccccaccaacgcgctgctcacggccctgatcgactacatctcctacctgcagagcctcgccgagatgtccaccttcgagctggacgaggactgggaggacttcaagtacaagccggagcccaccgaggcgccccagctgcggagccaccgcaccgaccagtacaacttcaagaacgccgactccaacagcaacgtgaaggtctgcaagaacatccagaaggtgtcctgcatcagcccccggtcccgcgccaagttcgagaacatcatcgcctgcggcgagcacgccaacccgagcgtgtacatgatgcccaacgtctccatctaccagagcaactccgagcggagccactactgcatcgccgactcccactgcctcgaggagtacgaggtggtggagagcgagctgctgaacgcgctcaagaagtccaagtgctgggccaaggagatggacgacatcgtcctgcacaagcaggccgacgggctgcgcagctgccggatgaaggacacgggcaactgcaacgtgcaggagaacgactggaccatcgtgctctgcgagaacggcaactactactacagcgaggcccaccgcgactacgacaaggaccaggacgtcgggcacttctgcctgagcccccggtgcagcaccatccgctaccccatcaacaagcggcacatccgcaactgcgactggcagatctcccacagcaccatcgacaagatctccgtgcaggagctggccgacatcgagcagtacaagaaggcgatcagccagaagctccagacgtccctgagcatcttcaagtacgtgaagaccaagaacctgccgcacatcaagcccgcctacaagtacatcaccgtcgagggcgtggagaccgtggaggggatcgagaacgccttcatcgagtccgagatccccgccctcgccggcacggcgatcggcttcaagatcaacagccgggaggggaactacctgatggacgtcatcggctacgtgaagtccgccagctactccgccacctacaccaagctgtacaccacggggcccaccatcggcgtgaacaccaagcacgacgagaagtgcaccgggccgtgcccgcccatcatcgaccacaaggagggctggctcacgttcgccaaggagcgcaccagcacctggggctgcgaggagttcgggtgcctggccgtctccgacggctgcgtgttcgggagctgccaggacatcatcaaggacgagctggtggtctaccggaagaccacggaggagctcaccaccgtggagctgtgcctgaccttctccgacaagacgtactgcaccaacctcaacgcgatcacccccatcatcaccgacaagttcgaggtgcagttcaagaccgtcgagagctacacgctgccccgcatcatcgccatcaagaaccacgagatcaaggtgggccagatcaacgacctgggggtgtactccaagggctgcggcaacgtccagaagatcaacgggaccaactacggcaacgggtggcccaagttcgactacctctgccacctggccagccggaaggaggtgatcatccgcaagtgcttcgacaacgactacaaggcctgcaagttcctgcagagcccgccctcctaccgcctcgaggagcaccagggcaccgtgaccgtcatcgactacaagaagatcctggggacgatcaagatgaaggcgatcctgggcgacgtgaagtacaagaactaccagagcaacatcgagatcaacgccgaggggacctgcgccggctgcatcaactgcttcgagaacatccactgcgagttcaccatccacaccacggtggaggcctcctgccccatcgtcaccgactgcgtgagcttccacgaccggatcctcatcacccccgacgagcacaagtacgccctgaaggtggtctgccaggagaagcccaagctgtccctcaagttcaagatctgcaacaccaacatcgacgcgagcatgacgatcgtggactccaagccgatcctggagctggcccccgtggaccagaccacctacatccgcgagaaggacgagcggtgcaagacctggatgtgccgcgtccgggacgagggcttccaggtgatcctcgagcccttcaagaacctgttcgggagctacatcggcatcttctacacggggatcctgtgcatcatctgcctcctgatcatcatctacatcatcctgcccatctgcttcaagctccgcgacaccctgcggcagcacgaggacgcctacaagaaggagatgaagatccgctga

SEQ ID NO: 12598 - RNA, 4332 nt, synthetic construct
  misc_feature 1..4332: note = derived and/or modified CDS sequence (opt1) from INKV(Lovanger)__KX554936.1__GP
  source 1..4332: mol_type = other RNA
atggaggtgctgaacctcatctggctgctgaccctctgcagcgcctcccccgtcttccagcgctgcttccaggacggcgccatcgtgaagcagaacccgagcaaggaggcggtgaccgaggtctgcctgaaggacgacgtgtccatgatcaagacggaggccaagtacatcaagaacgccaccgggaccttcgccaacaacatcgccatgcggaagtggctggtggcggactggcacgactgccgcccccagaagtcctccggcgggcacatcaacgtcatcgaggtgggcgacgacctcagcctgcacaccgagtcctacatctgcagcgccgactgcgtgatcacggtcgacaaggagaccgcccagatccggctgcagaccgacaacaccaaccacttcgaggtggccgggacgaccgtgaagtccggctggttcaagagcaccacctacatcacgctcgaccagacctgcgagcacctgaaggtctcctgcggccccaagagcatccagttccacgcgtgcttcaaccagcacatgtcctgcgtgcgcttcctgcaccggaccatcctccccgggagcatcgccaactccatctgccagaacatcgagatcatcatcctggtgaccctgagcctcgccatcttcatcttcctgacgatcgtctccaagacctacgtgtgctacctgctcatgccgatcttcatccccatcgcctacatctacggctggatctacaacaagagctgcaagaagtgcaagctgtgcgggctggtgtaccaccccttcaccgagtgcggcacccactgcgtctgcggggcccgctacgagacgtccgaccggatgaagctccaccgcgcgagcggcctgtgccccggctacaagagcctgcgggccgcccgcgtgatgtgcaagtcccgggggccggccagcgtgctctccatcatgaccgccatcctgatcctgaccttcgtcacccccatcagcgcgatggtgatcggcgagtccagcgaggtgtacacgctcgacgagctgcccgacgacatggtccagatggccgagcgcgtgaacatctactaccagatcatcatcatcaactacgggatcacctgggccttcctcctgttcggcctggtcctggcctacttcttcaagaagtaccagcaccggttcctctccttctacgccatgtactgcaaggagtgcgacatgtaccacgagcgcgcgggcctgacctactggggcgacttcaccaacaagtgccggcagtgcacgtgcgggcagttcgaggacgtgaccgggctgatggtgcacaagaagtcctacaactgcatcatcaagtacaaggccaagtggatccgcgacatcctcatcacctacctgatcatcatgctgatcaaggacagcctcctgttcgtcggcgccaccgggacggacttcgccgcctgcatcgacgagaagaccgtgacctggaactgcaccggccccttcctgaacctcggccggtgcgacaagagccagaagaagatcgggtacgcggacatcgccgaccagctgaagggcctgggggccatctccgtgctcgacatcccgatgatcaagcgcatccccgacgagatcagcggctccctgaagtacatcgacgggctggagacgtaccacgagcagctcaccgccgagtacgcgttcctgacccggtactgcgactactacacccagtacaccgacaacagcggctactcccagacggtctggcgcacctacctgcggagccacgacttcggcgcctgcgtggtgtaccccaaccagcacttctgccgctgcgtcaagcacggggacaagtgcaactccgccaagtgggacttcgccaacgagatgaagaccttctacaccggccagaaggccaagttcaacaaggacctgaacctcgcgctgctggtgctccacaaggccttccgcgggacgggcaccagctacatcgccgagtccatggcccggaaggacaaccgcagcatgacccacttcgccctggagatcaagaagaagttccccaccaacgcgctgctcacggccctgatcgactacatcagctacctgcagtccctcgccgagatgagcaccttcgagctggacgaggactgggaggacttcaagtacaagccggagcccaccgaggcgccccagctgcggtcccaccgcaccgaccagtacaacctcaagaacgccgacagcaactccaacgtgaaggtctgcaagaacatccagaaggtgagctgcatcagcccccggagccgcgccaagttcgagaacatcatcgcctgcggggagcacgccaacccgtccgtgtacatgatgcccaacgtcagcatctaccagtccaacagcgagcggtcccactactgcatcgccgacagccactgcctggaggagtacgaggtggtggagtccgagctgctcaacgcgctgaagaagtccaagtgctgggccaaggagatggacgacatcgtcctgcacaagcaggccgacggcctccgcagctgccggatgaaggacacgggcaactgcaacgtgcaggagaacgactggaccatcgtgctgtgcgagaacgggaactactactacagcgaggcccaccgcgactacgacaaggaccaggacgtcggccacttctgcctgagcccccggtgctccaccatccgctaccccatcaacaagcggcacatccgcaactgcgactggcagatcagccactccaccatcgacaagatcagcgtgcaggagctcgccgacatcgagcagtacaagaaggcgatctcccagaagctgcagacgagcctgtccatcttcaagtacgtgaagaccaagaacctcccgcacatcaagcccgcctacaagtacatcaccgtcgagggggtggagaccgtggagggcatcgagaacgccttcatcgagagcgagatccccgccctggccggcacggcgatcgggttcaagatcaactcccgggagggcaactacctgatggacgtcatcgggtacgtcaagagcgcctcctacagcgccacctacaccaagctctacaccacgggccccaccatcggggtgaacaccaagcacgacgagaagtgcaccggcccgtgcccgcccatcatcgaccacaaggagggctggctgacgttcgccaaggagcgcacctccacctgggggtgcgaggagttcggctgcctggccgtgagcgacgggtgcgtgttcggctcctgccaggacatcatcaaggacgagctcgcggtgtaccggaagaccacggaggagctgaccaccgtcgagctgtgcctcaccttcagcgacaagacgtactgcaccaacctgaacgccatcacccccatcatcaccgacaagttcgaggtgcagttcaagaccgtggagtcctacacgctgccccgcatcatcgccatcaagaaccacgagatcaaggtcgggcagatcaacgacctcggcgtgtacagcaagggctgcgggaacgtgcagaagatcaacggcaccaactacgggaacggcctgcccaagttcgactacctgtgccacctcgcctcccggaaggaggtcatcatccgcaagtgcttcgacaacgactaccaggcgtgcaagttcctgcagagcccgcccagctaccgcctggaggagcaccaggggaccgtgaccgtgatcgactacaagaagatcctcggcacgatcaagatgaaggccatcctgggcgacgtcaagtacaagaactaccagtccaacatcgagatcaacgccgaggggacctgcgccggctgcatcaactgcttcgagaacatccactgcgagttcaccatccacaccacggtggaggccagctgccccatcgtgaccgactgcgtctccttccacgaccggatcctgatcacccccgacgagcacaagtacgcgctcaaggtggtgtgccaggagaagcccaagctgagcctgaagttcaagatctgcaacaccaacatcgacgcctccatgacgatcgtcgacagcaagccgatcctcgagctggcccccgtggaccagaccacctacatccgcgagaaggacgagcggtgcaagacctggatgtgccgcgtgcgggacgaggggttccaggtcatcctggagcccttcaagaacctcttcggctcctacatcgggatcttctacacgggcatcctgtgcatcatctgcctgctcatcgtgatctacatcatcctgcccatctgcttcaagctgcgcgacaccctccggcagcacgaggacgcctacaagaaggagatgaagatccgctga

SEQ ID NO: 12599 - RNA, 4335 nt, synthetic construct
  misc_feature 1..4335: note = derived and/or modified CDS sequence (opt1) from JSV__AF123487.1__GP
  source 1..4335: mol_type = other RNA
atggaggtgctgaacctcatctggctgctggccctctgcagcgcctcccccgtcttccagcgctgcttccaggacggcgcgatcgtgaagcagaacccgagcaaggaggccgtgaccgaggtctgcctgaaggacgacgtgtccatgatcaagaccgaggccaagtacgtgaagaacacgaccgggaccttcgccaacaacatcgccatgcggaagtggctggtcgcggactggcacgactgccgcccccagaagtcctccggcgggcacatcaacgtgatcgaggtgggcgacgacctcagcctgcacaccgagtcctacatctgcagcgccgactgcgtcatcacggtggacaaggagaccgcccagatccggctgcagaccgacaacaccaaccacttcgaggtggccgggacgaccgtcaagtccggctggttcaagagcaccacctacatcacgctcgaccagacctgcgagcacctgaaggtgtcctgcggccccaagagcatccagttccacgcgtgcttcaaccagcacatgtcctgcgtgcgcttcctgcaccggaccatcctccccgggagcatcgccaactccatctgccagaacatcgagatcatcatcctggtcaccctgagcctcgtgatcttcatcttcctgtccatcgtgagcaagacgtacgtctgctacctgctcatgccgatcttcatccccatcgccttcatctacggctggatctacaacaagtcctgcaagaagtgcaagctgtgcgggctggtgtaccaccccttcaccgagtgcggcacccactgcgtgtgcggggcccgctacgagaccagcgaccggatgaagctccaccgcgccagcggcctgtgccccggctacaagtccctgcgggcggcccgcgtcatgtgcaagagcaaggggccggcctccatcctcagcatcatgacggccatcctgatcctgaccttcgtgacccccatctccgccatggtgatcggcgagagctccgaggtctacaccctcgacgacctgcccgacgacatggtgcagatggcggagcgggtcaacatctactaccagatcatcatcatcaactacggggtgacgtgggccttcctgctcctgggcctgatcctcgcctacttcttcaagaagtaccagcacaagttcctggacttctacgccatgtactgcgaggagtgcgacatgtaccacgagaagtccggcctgacccactggggcgacttcaccaacaagtgccgccagtgcacgtgcgggcagttcgaggacgtggccgggctcatgatccaccgcaagagctacaactgcctggtcaagtacaaggcgcggtggatccgggacatcctgatcatgtacctcgccatgatcctgatcaaggacagcctcctgttcgtgggcgcctccgggaccgacttcgccgcctgcatcgacgagaaggtggtcacctggaactgcaccggccccttcctgaacctgggccgctgcgacaagagccagaagaagaccaactacgaggggatcgcgaaccagctcaagggcctgggggtgatctccgtgctggacatcccgatgatcaagaacatgcccgacgagatcagcggctccctcaagtacatcgacagcctggagacgtaccacgagcagctgaccgccgagtacgccttcctgacccggtactgcgactactacacccagtacacggacaactccgggtacagccgcaccgtctggcggacctacctccgctcccacgacttcggcgcctgcgtggtgtaccccaaccaccacctgtgccggtgcgtcaagtacggcgacaagtgcaacagcgcgaagtgggacttcgccaacgagatgaagaccttctacaccgggcagaaggtgaagttcaacaaggacctgaacctcgccctgctggtgctccacaaggccttccgcggcacggggaccgcctacgtcgcggaggccatggcccgcaaggacaacggcagcatggcccacttcgccctggagatccggaagaagttccccaccaacgcgctgctcgccgccctgatcgactacatcgtgtacctgcagtccctcgccgagatcgccaccttcgagctggacgaggactgggaggacttcaagtacaagccggagcccacggagagcacgccccaggcgcgctcccaccggaacgaccagtacaacttcaagaacgccgagagcaactccaacaccaaggtgtgcaagaacgtccagaaggtgctgtgcatcagcccccgctccaaggccaagttcgagaacatcatcgcctgcggggagcacgcgaacccgagcgtgtacatgatgcccaacgtctccatctaccagagcaactccgagcggagccactactgcatcgccgactcccactgcctcgagaagtacgaggtggtggagaccgagctgctgaacgccctcaagaagtccaagtgctgggccaaggagatggacgacatcgtcctgcacaagcagagcgacggcctgcgcagctgccggatcaaggacaccggcaactgcaacgtgcaggagaacgactggaccatcgtgctctgcgagaacgggaactactactactccgaggtccacaaggactacgacaaggaccaggacgtgggccacttctgcctgagcccccgctgcaccaccatccggtaccccatcagccgccggcacatccgcaagtgcgagtggcagatctcccacagcacgatcgacaagatctccgtgcaggagctggccgacatcgagcagtacaagaaggcgatcagccagaagctccagacctccctgagcatcttcaagtacgtccggaccaagaacctgccgcacatcaagcccgcctacaagtacatcaccgtggagggggtggagacgatcgagggcatcgagaacgccttcatcgagtccgagatccccgccctcgccggcaccgcgatcgggttcaagatcaacagccgcgagggcaactacctgatggacgtcatcgggtacgtgaagtccgccagctactccgccgtgtacaccaagctgtacaccacgggccccaccatcgggatcaacaccaagcacgacgagaagtgcaccggcccgtgccccgccgtcatcgaccacaaggacggctggctcacgttcagcaaggagcggacctccacctgggggtgcgaggagttcggctgcctggccgtgagcgacgggtgcgtgttcggctcctgccaggacatcatcaaggacgagctggcggtctaccgcaagaccacggaggagctcaccaccgtggagctgtgcctgaccttcagcgacaagacgtactgcaccaacctcaacgccatcacccccatcatcaccgacaagttcgaggtgcagttcaagacggtcgagtcctacaccctgccgcgggtgatcgccatcaagaaccacgagatcaaggtggggcagatcaacgacctgggcgtctacagcaagggctgcgggaacgtgcagaaggtgaacggcaccaactacgggaacggcagcccccgcttcgactacctctgccacctggccagccggaaggaggtcatcctgcgcaagtgcttcgacaacgactaccaggcgtgcaagttcctccagagcccctccagctaccgcctggaggagcaccaggggaccgtgaccgtgatcgactacaagaagatcctgggcacgatcaagatgaaggccatcctcggcgacgtcatctacatcaactaccagaacaacatcgagatcaacgccgaggggacctgcgccggctgcatcgactgcttcgagaacatccactgcgagttcaccatccacaccacggtggaggcctcctgccccatcaccaccgagtgcgtcagcttccacgaccggatcctgatcaccccggacgagcacaagtacgcgctgaagatcgtgtgccacgacaagcccaaggtgtccctcaagttcaagatctgcaacacgaacgtcgacgccgccatgaccatcgtggacagcaagcccatcctggagctggcccccgtggaccagaccacctacatccgcgagaaggacgagcggtgcaagacgtggatgtgccgcgtccgggacgaggggttccaggtgatcctcgagccgttcaagaacctgttcggctcctacatcgggatcttctacaccggcatcctgagcatcatctgcctcctgatcgtggtctacatcatcctgcccatctgcttcaagctccgcgacaccctgcggcagcacgaggacgcctaccgcaaggagatgaagatccggtga

SEQ ID NO: 12600 - RNA, 4335 nt, synthetic construct
  misc_feature 1..4335: note = derived and/or modified CDS sequence (opt1) from JSV(BFS 4474)__KX817319.1__GP
  source 1..4335: mol_type = other RNA
atggaggtgctgaacctcatctggctgctggccctctgcagcgcctcccccgtcttccagcgctgcttccaggacggcgcgatcgtgaagcagaacccgagcaaggaggccgtgaccgaggtctgcctgaaggacgacgtgtccatgatcaagaccgaggccaagtacgtgaagaacacgaccgggaccttcgccaacaacatcgccatgcggaagtggctggtcgcggactggcacgactgccgcccccagaagtcctccggcgggcacatcaacgtgatcgaggtgggcgacgacctcagcctgcacaccgagtcctacatctgcagcgccgactgcgtcatcacggtggacaaggagaccgcccagatccggctgcagaccgacaacaccaaccacttcgaggtggccgggacgaccgtcaagtccggctggttcaagagcaccacctacatcacgctcgaccagacctgcgagcacctgaaggtgtcctgcggccccaagagcatccagttccacgcgtgcttcaaccagcacatgtcctgcgtgcgcttcctgcaccggaccatcctccccgggagcatcgccaactccatctgccagaacatcgagatcatcatcctggtcaccctgagcctcgtgatcttcatcttcctgtccatcgtgagcaagacgtacgtctgctacctgctcatgccgatcttcatccccatcgccttcatctacggctggatctacaacaagtcctgcaagaagtgcaagctgtgcgggctggtgtaccaccccttcaccgagtgcggcacccactgcgtgtgcggggcccgctacgagaccagcgaccggatgaagctccaccgcgccagcggcctgtgccccggctacaagtccctgcgggcggcccgcgtcatgtgcaagagcaaggggccggcctccatcctcagcatcatgacggccatcctgatcctgaccttcgtgacccccatctccgccatggtgatcggcgagagctccgaggtctacaccctcgacgacctgcccgacgacatggtgcagatggcggagcgggtcaacatctactaccagatcatcatcatcaactacggggtgacgtgggccttcctgctcctgggcctgatcctcgcctacttcttcaagaagtaccagcacaagttcctggacttctacgccatgtactgcgaggagtgcgacatgtaccacgagaagtccggcctgacccactggggcgacttcaccaacaagtgccgccagtgcacgtgcgggcagttcgaggacgtggccgggctcatgatccaccgcaagagctacaactgcctggtcaagtacaaggcgcggtggatccgggacatcctgatcatgtacctcgccatgatcctgatcaaggacagcctcctgttcgtgggcgcctccgggaccgacttcgccgcctgcatcgacgagaaggtggtcacctggaactgcaccggccccttcctgaacctgggccgctgcgacaagagccagaagaagaccaactacgaggggatcgcgaaccagctcaagggcctgggggtgatctccgtgctggacatcccgatgatcaagaacatgcccgacgagatcagcggctccctcaagtacatcgacagcctggagacgtaccacgagcagctgaccgccgagtacgccttcctgacccggtactgcgactactacacccagtacacggacaactccgggtacagcaagaccgtctggcgcacctacctccggtcccacgacttcggcgcctgcgtggtgtaccccaaccagcacttctgccgctgcgtcaagtacggcgacaagtgcaacagcgcgaagtgggacttcgccaacgagatgaagaccttctacaccgggcagaaggtgaagttcaacaaggacctgaacctggccctcctggtgctgcacaaggccttccggggcacggggaccgcctacgtcgcggaggccatggcccgcaaggacaacggcagcatggcccacttcgccctcgagatccgcaagaagttccccaccaacgcgctgctggccgccctcatcgactacatcgtgtacctgcagtccctggccgagatcgccaccttcgagctcgacgaggactgggaggacttcaagtacaagccggagcccacggagagcacgccccaggcgcggtcccaccgcaacgaccagtacaacttcaagaacgccgagagcaactccaacaccaaggtgtgcaagaacgtccagaaggtgctgtgcatcagcccccggtccaaggccaagttcgagaacatcatcgcctgcggggagcacgcgaacccgagcgtgtacatgatgcccaacgtctccatctaccagagcaactccgagcgcagccactactgcatcgccgactcccactgcctggagaagtacgaggtggtggagaccgagctcctgaacgccctgaagaagtccaagtgctgggccaaggagatggacgacatcgtcctccacaagcagagcgacggcctgcggagctgccgcatcaaggacaccggcaactgcaacgtgcaggagaacgactggaccatcgtgctgtgcgagaacgggaactactactactccgaggtccacaaggactacgacaaggaccaggacgtgggccacttctgcctcagcccccggtgcaccaccatccgctaccccatcagccggcgccacatccggaagtgcgagtggcagatctcccacagcacgatcgacaagatctccgtgcaggagctggccgacatcgagcagtacaagaaggcgatcagccagaagctgcagacctccctcagcatcttcaagtacgtccgcaccaagaacctgccgcacatcaagcccgcctacaagtacatcaccgtggagggggtggagacgatcgagggcatcgagaacgccttcatcgagtccgagatccccgccctggccggcaccgcgatcgggttcaagatcaacagccgggagggcaactacctcatggacgtcatcgggtacgtgaagtccgccagctactccgccgtgtacaccaagctgtacaccacgggccccaccatcgggatcaacaccaagcacgacgagaagtgcaccggcccgtgccccgccgtcatcgaccacaaggacggctggctgacgttcagcaaggagcgcacctccacctgggggtgcgaggagttcggctgcctcgccgtgagcgacgggtgcgtgttcggctcctgccaggacatcatcaaggacgagctggcggtctaccggaagaccacggaggagctgaccaccgtggagctctgcctgaccttcagcgacaagacgtactgcaccaacctgaacgccatcacccccatcatcaccgacaagttcgaggtgcagttcaagacggtcgagtcctacaccctcccgcgcgtgatcgccatcaagaaccacgagatcaaggtggggcagatcaacgacctgggcgtctacagcaagggctgcgggaacgtgcagaaggtgaacggcaccaactacgggaacggcagcccccggttcgactacctgtgccacctcgccagccgcaaggaggtcatcctgcggaagtgcttcgacaacgactaccaggcgtgcaagttcctgcagagcccctccagctaccgcctcgaggagcaccaggggaccgtgaccgtgatcgactacaagaagatcctgggcacgatcaagatgaaggccatcctgggcgacgtcaagtacaagaactaccagaacaacatcgagatcaacgccgaggggacctgcgccggctgcatcgactgcttcgagaacatccactgcgagttcaccatccacaccacggtggaggcctcctgccccatcaccaccgagtgcgtcagcttccacgaccgcatcctcatcaccccggacgagcacaagtacgcgctgaagatcgtgtgccacgacaagcccaaggtgtccctgaagttcaagatctgcaacacgaacgtcgacgccgccatgaccatcgtggacagcaagcccatcctcgagctggcccccgtggaccagaccacctacatccgggagaaggacgagcgctgcaagacgtggatgtgccgggtccgcgacgaggggttccaggtgatcctggagccgttcaagaacctcttcggctcctacatcgggatcttctacaccggcatcctgagcatcatctgcctgctcatcgtggtctacatcatcctgcccatctgcttcaagctgcgggacaccctccgccagcacgaggacgcctaccggaaggagatgaagatccgctga

SEQ ID NO: 12601 - RNA, 4323 nt, synthetic construct
  misc_feature 1..4323: note = derived and/or modified CDS sequence (opt1) from LUMV__AF123484.1__GP
  source 1..4323: mol_type = other RNA
atgatcctggtgctgttcttcgtcgccctgagcgccgcgggccccgtgtaccagcgctgcttccaggacggggccatcgtgaagcagtccccgagcaagcaggccgtcaccgaggtgtgcctgaaggacgacgtgtccatgatcaagaccgaggcccggtacttcaagaacacgaccggcatctacgccaacaacgtcgcgatccgcaagtggctcgtggccgactggcacgactgccggcccaagaaggtgagcgggggccacatcaacgtcatcgaggtgggggacgacctgaccctgcacaccgaggcctacgtgtgcaacgccgactgcatcatcggcgtcgacaaggagacggcccaggtgcgcctccagaccgacaccaccaaccacttcgagatcgcgggcacgaccgtgaagtccgggtggttcaagagcaccacctacatcacgctgggccagacctgcgagcacctgaaggtctcctgcgggcccaagagcatccagttccacgcctgcttcaaccagcacatgtcctgcgtgcggttcctccaccgcaccatcctgcccggcagcatcgccaactccgtgtgccagaacatcgagatcatcatcctgaccgtcctcacgctgctgatcttcaccctcctgagcatcctgtccaagacctacatctgctacatcctcatgccgatcttcatccccctggcctacatctacgggctgatctacaacaagagctgcaagaagtgcaagctctgcggcctggtgtaccaccccttcaccgagtgcggcacgcactgcgtgtgcggggcgcggtacgacacctccgaccgcatgaagctgcaccgggccagcggcctctgccccgggtacaagtccctgcgcgccgcccgggtcatgtgcaagagcaagggcccggcctccgtgctgagcatcatcaccgcggtgctcatcctgaccttcatcacgcccatcaacgccatgatcgccggcgagacccaggagaccttcaagctggaggacctccccgacgacatgctgagcatggccatgaagatcaacatgtactacatcatgtgcatgctgaactacgtcgccacctggtccttcatcttctgcgcgctcatcatcgccctgatcttcaagaagtaccagcacaagttcctgagctactacgccatgtactgccaggagtgcgacatgtaccacgaccgctccgggctcaagtacaacggcgggttcacgaacaagtgccggcagtgcacgtgcggccagtacgaggacgccaccgggctgatggcccaccgcaagacctacaactgcctgatccagtacaagagcaagtggctcgtgaacttcctgatcacctacatcatcctgatgctcatcaaggactccgtcctgatcgtgcacgcggagggcaccgacttcgagaagtgcagctccgacatcaacatcgtgtggaactgcaccggccccttcctgagcctcgggaactgcgagaagaagcagaagaaggagtcctacaacgacatcgccgcccagctgaagggcctggacgccatcagcgtcctcgacatcccgatgatctccaagatccccgaggacatcgcgggggccctgcggttcatcgaggagcagaacagctaccacgtgcagctgaccgtggagtacgccatgctgacgcgctactgcgactactacacccagttctccgacaacagcggctactcccagaccacctggcggacctacctccgcagccacgacttcgaggcctgcatcctgtaccccaaccagcacttctgccggtgcgtcaagcacggggacaagtgctcccgcagcaactgggacttcgccaacgagatgaagaactactactccggcaagcagagcaagtacaacaaggacctgaacctcgcgctgatgagcttccaccacgccttccggggcacgtccagcttctacaccgccaagctgctccgcgagaagaagaccgaggagctgaagaactacatcgacaagatccgcaccgagtaccccgggaacgccctgctcaaggccgtgatcgactacatcaagtacatgatgggcctgacggaggtgtccaacttcaagcacgacgagatgtgggacgacttcatcttcgagaacccgagcacccggtccagcctgtcccgcaacagcgagtccagctacgacttcaagaccaacatcaactccgaccccaccaacacgtgcaagaacatcaaggcggtgacctgcctcagccccaagtccggggtgagcttcgactccgtgatcgcctgcggcgagagcaaccagccctccatctaccagaagccgcggaagcaggtctaccagagcaacagcgagcagacccacttctgcctgctggacacccactgcctcgaggggtacgagacggtgggcgaggaggtgctgtccgccatcaagaagtccaagtgctgggagaccgacttcaccgagtacatccagttcaagcagtccgacggcgtccgcagctgccggatgaaggactccggggagtgcaccgtgacgaccaacaagtggcccatcatcctgtgcgagaacaaccgctactactacagcgagctccacaaggactacgacaaggaccaggacatcggccacttctgcctgagcccccggtgcaacaccatccgctaccccatcaaccagaaccacatcagcaactgcacctggcaggtccggcacaacaacatcgacaagatcgaggtccacgagctggaggacctcgagcagtaccgcaaggccatcacgcagaagctgcagacctccctgaccctcttcaagtacagccggaccaagaacctgccgcacatcaagcccatctacaagtacatcacgatcgaggggaccgagaccgccgagggcatcgagtccgcgtacatcgagagcgagatccccgccctggccggcacctccatcgggttcaagatcacgagcaagtccggcaagcacctcctggacgtgatcagctacgtgaagtccgccagctactccgcggtctacaccaagctgtacaccaccgggcccacgatcggcgtgaacaccaagcacgacgagctctgcaccgggagctgcccggtgaacgtcccccacaacaccggctggctgacgttcgcccgcgagcggaccagctcctggggctgcgaggagttcgggtgcctggccatcagcgacggctgcgtgttcgggtcctgccaggacatcatcaaggacgagctcaccgtgtaccgcgaggagaccgaggagaccacgaacgtcgagctgtgcctgaccttcgccgacaagacctactgcaccaacctcaacgccatcacgcccatcatcaccgaccagttcgaggtgcagttcaagaccgtggaggcgtacagcctgccgcggatcatcgccgtccgcaaccacgagatcatggtgggccagatcaacgacatcggggtgtactccaagggctgcggcaacgtccagaagatcaacaacaccaactacgggaacggcgtgcccaagttcgactacctgtgccacctcgccagccggaaggaggtgatcatccgcaagtgcttcgacaacgactaccaggcctgcaagttcctgcagacgcccgcctcctaccggctggaggaggagggcgggagcgtcaccgtgatcgactacaagaagatcctcgggaccatcaagatgaaggcgatcctgggcgacgtgaagtacaagaccttcgccgacaacgtcgacatcacggtggagggcgcctgcaccgggtgcatcaactgcttcgacaacatccactgcgagctgaccatccactccaccgtggaggccagctgccccatcacgtccagctgcaccgtcttccacgaccgcatcctcatcaccccgaacgagcacaagtacgccatcaaggtgatctgcaacggcaagcccgggatctccctgcccttcaagatctgcaacaccaaggtggacgcggccatgacgctgaccgacgccaagcagatcctcgagctggcccccgtcgaccagaccacctacatcaaggagaaggacgagcgctgcaagacgtggatgtgccgggtgcgcgacgagggcctccaggtgatcttcgagccgttcaagaacctcttcgggagctacatcggcatcttctacaccttcgtcatcttcctggtggtgatcttcatcgtcatctacatcgtgctgcccatctgcttcaagctccgggacaccctgcgccagcacgaggacgcgtacaagcgggagatgaagatccgctga

SEQ ID NO: 12602 - RNA, 4323 nt, synthetic construct
  misc_feature 1..4323: note = derived and/or modified CDS sequence (opt1) from LUMV(SAAr 1881)__KX817325.1__GP
  source 1..4323: mol_type = other RNA
atgatcctggtgctgttcttcgtcgccctgagcgccgcgggccccgtgtaccagcgctgcttccaggacggggccatcgtgaagcagtccccgagcaagcaggccgtcaccgaggtgtgcctgaaggacgacgtgtccatgatcaagaccgaggcccggtacttcaagaacacgaccggcatctacgccaacaacgtcgcgatccgcaagtggctcgtggccgactggcacgactgccggcccaagaaggtgagcgggggccacatcaacgtcatcgaggtgggggacgacctgaccctgcacaccgaggcctacgtgtgcaacgccgactgcatcatcggcgtcgacaaggagacggcccaggtgcgcctccagaccgacaccaccaaccacttcgagatcgcgggcacgaccgtgaagtccgggtggttcaagagcaccacctacatcacgctggaccagacctgcgagcacctgaaggtctcctgcggccccaagagcatccagttccacgcctgcttcaaccagcacatgtcctgcgtgcggttcctccaccgcaccatcctgcccgggagcatcgccaactccgtgtgccagaacatcgagatcatcatcctgaccgtcctcacgctgctgatcttcaccctcctgagcatcctgtccaagacctacatctgctacatcctcatgccgatcttcatccccctggcctacatctacggcctgatctacaacaagagctgcaagaagtgcaagctctgcgggctggtgtaccaccccttcaccgagtgcggcacgcactgcgtgtgcggcgcgcggtacgacacctccgaccgcatgaagctgcaccgggccagcgggctctgccccggctacaagtccctgcgcgccgcccgggtcatgtgcaagagcaaggggccggcctccgtgctgagcatcatcaccgcggtgctcatcctgaccttcatcacgcccatcaacgccatgatcgccggcgagacccaggagaccttcaagctggaggacctccccgacgacatgctgagcatggccatgaagatcaacatgtactacatcatgtgcatgctgaactacgtcgccacctggtccttcatcttctgcgcgctcatcatcgccctgatcttcaagaagtaccagcacaagttcctgagctactacgccatgtactgccaggagtgcgacatgtaccacgaccgctccggcctcaagtacaacgggggcttcacgaacaagtgccggcagtgcacgtgcgggcagtacgaggacgccaccggcctgatggcccaccgcaagacctacaactgcctgatccagtacaagagcaagtggctcgtgaacttcctgatcacctacatcatcctgatgctcatcaaggactccgtcctgatcgtgcacgcggaggggaccgacttcgagaagtgcagctccgacatcaacatcgtgtggaactgcaccggccccttcctgagcctcggcaactgcgagaagaagcagaagaaggagtcctacaacgacatcgccgcccagctgaaggggctggacgccatcagcgtcctcgacatcccgatgatctccaagatccccgaggacatcgcgggcgccctgcggttcatcgaggagcagaacagctaccacgtgcagctgaccgtggagtacgccatgctgacgcgctactgcgactactacacccagttctccgacaacagcgggtactcccagaccacctggcggacctacctccgcagccacgacttcgaggcctgcatcctgtaccccaaccagcacttctgccggtgcgtcaagcacggcgacaagtgctcccgcagcaactgggacttcgccaacgagatgaagaactactactccgggaagcagagcaagtacaacaaggacctgaacctcgcgctgatgagcttccaccacgccttccggggcacgtccagcttctacaccgccaagctgctccgcgagaagaagaccgaggagctgaagaactacatcgacaagatccgcaccaagtaccccggcaacgccctgctcaaggccgtgatcgactacatcaagtacatgatggggctgacggaggtgtccaacttcaagcacgacgagatgtgggacgacttcatcttcgagaacccgagcacccggtccagcctgtcccgcaacagcgagtccagctacgacttcaagaccaacatcaactccgaccccaccaacacgtgcaagaacatcaaggcggtgacctgcctcagccccaagtccggcgtgagcttcgactccgtgatcgcctgcggggagagcaaccagccctccatctaccagaagccgcggaagcaggtctaccagagcaacagcgagcagacccacttctgcctgctggacacccactgcctcgagggctacgagacggtgggggaggaggtgctgtccgccatcaagaagtccaagtgctgggagaccgacttcaccgagtacatccagttcaagcagtccgacggcgtccgcagctgccggatgaaggactccggcgagtgcaccgtgacgaccaacaagtggcccatcatcctgtgcgagaacaaccgctactactacagcgagctccacaaggactacgacaaggaccaggacatcgggcacttctgcctgagcccccggtgcaacaccatccgctaccccatcaaccagaaccacatcagcaactgcacctggcaggtccggcacaacaacatcgacaagatcgaggtccacgagctggaggacctcgagcagtaccgcaaggccatcacgcagaagctgcagacctccctgaccctcttcaagtacagccggaccaagaacctgccgcacatcaagcccatctacaagtacatcacgatcgagggcaccgagaccgccgaggggatcgagtccgcgtacatcgagagcgagatccccgccctggccggcacctccatcggcttcaagatcacgagcaagtccgggaagcacctcctggacgtgatcagctacgtgaagtccgccagctactccgcggtctacaccaagctgtacaccaccggccccacgatcggggtgaacaccaagcacgacgagctctgcaccggcagctgcccggtgaacgtcccccacaacaccgggtggctgacgttcgcccgcgagcggaccagctcctggggctgcgaggagttcggctgcctggccatcagcgacgggtgcgtgttcggctcctgccaggacatcatcaaggacgagctcaccgtgtaccgcaaggagaccgaggagaccacgaacgtcgagctgtgcctgaccttcgccgacaagacctactgcaccaacctcaacgccatcacgcccatcatcaccgaccagttcgaggtgcagttcaagaccgtggaggcgtacagcctgccgcggatcatcgccgtccgcaaccacgagatcatggtggggcagatcaacgacatcggcgtgtactccaaggggtgcggcaacgtccagaagatcaacaacaccaactacggcaacggggtgcccaagttcgactacctgtgccacctcgccagccggaaggaggtgatcatccgcaagtgcttcgacaacgactaccaggcctgcaagttcctgcagacgcccgcctcctaccggctggaggaggagggcgggagcgtcaccgtgatcgactacaagaagatcctcggcaccatcaagatgaaggcgatcctgggggacgtgaagtacaagaccttcgccgacaacgtcgacatcacggtggagggcgcctgcaccggctgcatcaactgcttcgacaacatccactgcgagctgaccatccactccaccgtggaggccagctgccccatcacgtccagctgcaccgtcttccacgaccgcatcctcatcaccccgaacgagcacaagtacgccatcaaggtgatctgcaacgggaagcccggcatctccctgcccttcaagatctgcaacaccaaggtggacgcggccatgacgctgaccgacgccaagcagatcctcgagctggcccccgtcgaccagaccacctacatcaaggagaaggacgagcgctgcaagacgtggatgtgccgggtgcgcgacgaggggctccaggtgatcttcgagccgttcaagaacctcttcggcagctacatcgggatcttctacaccttcgtcatcttcctggtggtgatcttcatcgtcatctacatcgtgctgcccatctgcttcaagctccgggacaccctgcgccagcacgaggacgcgtacaagcgggagatgaagatccgctga

SEQ ID NO: 12603 - RNA, 4329 nt, synthetic construct
  misc_feature 1..4329: note = derived and/or modified CDS sequence (opt1) from MELV__U88057.1__GP
  source 1..4329: mol_type = other RNA
atgatcgccctgatcttcctcatcgccatcgcggccgccagccccgtgtaccagcgctgcttccaggacggcgggatcgtcaagcagaacccgtccaaggacgccgtgaccgaggtgtgcctgaaggacgacgtcagcatgatcaagaccgaggccaagtacatgaagaacgacacgggcaccttctccaacaacgtggcgatgcggaagtggctggtggccgactggcacgactgccgcccccagaagtcctccgggggccacatcaacgtcatcgaggtgggggacgacctcagcctgcacaccgaggcctacatctgctccgccgactgcatgatcagcgtggacaaggagaccgcgcagatccggctgcagacggactccaccacccacttcgagatcgccggcaccacggtcaagagcggctggttcaagtccaccacctacatcaccctcgaccagacgtgcgagcacctgaaggtgagctgcgggcccaagtccatccagttccacgcctgcttcaaccagcacatgagctgcgtgcgcttcctgcaccggaccatcctccccggctccatcgccaacagcatctgccagaacatcgagatcatcatcctggtcaccctgaccctcctgatcttcatcttcctgtccatcctcagcaagacgtacatctgctacatcctgatgccgatgttcatccccgtggcctacatctacgggtggatctacaacaagtcctgcaagaagtgcaagctgtgcggcctcgtgtaccaccccttcaccgagtgcgggacccactgcgtctgcggcgcgcgctacgagaccagcgaccggatgaagctgcaccgcagctccggcctgtgccccgggtacaagagcctccgggccgcccgcgtgatgtgcaagtccaagggcccggccagcatcctgtccgtgctgacggccgtcctcatcctgaccttcgtgacccccatgaacgcgctgaccctcgggagctccgaggagaactacaagctggagaacctgcccgacgacatgctcgacatggccgagcggatcgacatctactacctgagcatcatcctgaactactccatcacgtggggcctcgtgatcctgctgggcctcaccttcatcctgttccgccggttccagcaccgcttcctgaactgctacgccatgtactgcagcgagtgcgacatgtaccacgacaagaacgggctcgtccggaacggcgacttcaccaacaagtgccgccagtgcacgtgcgggcagtacgaggacgccgccggcctgatcatccaccagaagtcctacaactgcctgatcaagtacaaggcgaagtggatccggaacatcctcctgacctacatcatcctgatcctcatcaaggacagcgtgctgctgacctccgccgaggggcccgacttcagcgtgtgcatcgagcagaaggccatctcctggaactgcaccggcccgttcctcaacctgggccgctgcgagaagacccagaagaaggccagctacgccacgatcgcgacccagctgcggtccatcgacgccatcagcgtcctggacatccccatgatcgccaagatccccgaggacatctccggggccctcaagtacatcgagagcctgaagacctaccacgagcagctgaccgcggagtacgccatgctcacgcgctactgcgactactacacccagttcagcgacaactccggctacagccagacctcctggcggaagttcctgcgcagccacgacttcgagtcctgcatcatctaccccaaccagcacttctgccgctgcgtgaagcaggacgagaagtgcagctccgccaagtgggacttcgccagcgagatgaaggggttctacctgaacaagcaggccaagttcaacaaggacctcaacctggcgctgtccaccttccacaaggccttccggggcaccccgatcagctacgtcacggagctcatctccaagaacaagaacagctccctgctgatgtacgtgagcgagatcaagcgcaagttccccgggaacgccctcctggtggccctgctcgacttcatcatgtacctgcagtccctgagcgagatctccggcttcgagctcggcgacgagtgggaggacttcaagtacgaccccgagcccaccgagccggccctgatgccccggagccaccgcagcgaccagtacaacttcaagaacgcggcctccgtcagcaagaccaagacctgcgagaacatcaagcgggtgctgtgcctcagcccccgcagccgggccacgttcgacgacgtggtcgcctgcggggagttcgccaacccctccgtgtacatgctgccgaacatcaccatctaccagagcaacatcgagcgctcccactactgcatcgcggacagccactgcctggaggagttcgagctcgtgaagcccgagctgctgaccgccctcaagaagtccacgtgctgggccggcgagatcgacgacatcgtcctgcacaagcagagcgacgggctgcggtcctgccgcatcaaggacaccgggacctgcgacgtgctcggcaacgagtggaccatcgtgctgtgcgagaacaacaacttctactacagcgaggtccaccgggactacgacaaggaccaggacatcggccacttctgcctgagcccccgctgcaacatcatccggtaccccatcaacccgcgccacatccggacctgcaagtggcagatcagccactccacgatcgacaagatcaccgtgcacgagctcgccgacatcgagcagtacaagaaggcgatcacccagaagctgcagaacagcctgtccatcttcaagtacaagcgcaccaagaacctcccccacatcaagcccatctacaagtacatcgccatcgagggcacggagaccgtggaggggatcgagaacgcctacatcgagagcgagatcccggccctggccggcaccgcgatcgggttcaagatcaactccaaggacggcaaccacctgatggacgtcatcggctacgtgaagtccgccagctactccagcacctacacgaagctctacaccaccgggcccaccatcggcatcaacacgaagcacgacgagaagtgcaccgggtcctgccccacccaggtgaagcacaagaccggctggctgacgttcgccaaggagcggaccagcacctgggggtgcgaggagttcggctgcctggccatctccgacggctgcgtcttcgggagctgccaggacatcatcaaggacgagctcaccgtgtaccgcaagacgaccgacgaggtgaccgagctggagctgtgcctcaccttcgccgacaagacgtactgcaccaacctgaacgcggtcacccccatcatcaccgacaagttcgaggtgcagttcaagaccgtggagtcctacagcctgccgcggatcatcgccgtcaagaaccacgagatcaaggtgggccagatcaacgacatcggggtgtactccaagggctgcgggaacgtccagaaggtgaacggcacgagctacggcaacggggtgcccaagttcgactacctctgccacctggcctcccgcaaggaggtcaccatccgcaagtgcttcgacaacgactaccaggcctgcaagttcctgcagacccccagctcctaccggctcgaggagcaccagggcaccgtgacgatcatcgactacaagaagatcctggggagcatcaagatgaaggccatcctgggcgacgtgaagtacaagaactacgcgtccaacatcgacatcaacgccgaggggagctgcgccggctgcatcaactgcttcgagaacatccactgcgagttcaccatccactccaccgtcgagaccagctgccagatcgagtccgactgcacgagcttccacgaccgcgtgctcatcacccccaacgagcacaagtacgccctgaagctgatctgccacgacaagccggcgagctccctcaagttcaagatctgcaacaccaaggtggaggccgccatgaccctggtcgacgcccggcccatcatcgagctggcccccgtggaccagacggcgtacatccgcgagaaggacgagcggtgcaagacctggatgtgccgcgtgcgggacgagggcatccaggtcatcttcgagcccttcaagaacctcttcgggagctacatcggcatcttctacgccatcgtgatctgcatcatcgtgctgttcctgatcgtctacatcgtgctcccgatctgcttcaagctgaaggacaccctgaagcagcacgaggacgcctacaagcgcgagatgaagatccggtga

SEQ ID NO: 12604 - RNA, 4326 nt, synthetic construct
  misc_feature 1..4326: note = derived and/or modified CDS sequence (opt1) from SAV__AF123486.1__GP
  source 1..4326: mol_type = other RNA
atgatccccctcctgttcctggtgaccctggtcagcgccggcccggtgttccagcgctgcttccaggacggggccatcgtgaagcagaacccctccaaggaggcggtcaccgaggtgtgcatcaaggacgacgtgagcatgatcaagacggaggcccggtacgtccgcaactccagcggcgtgttctccaacaacgtggccctccggaagtggctggtcagcgactggcacgactgcaagcccaagaaggtgtccgggggccacatcaacgtgatcgaggtcgggaacgacctgaccctccacaccgagagctacgtgtgctccgccgactgcaccatcggcatcgacaaggagacggcccagatccgcctgcagaccgacaccaccaaccacttcgaggtggcgggcacgaccgtcaagagcgggtggttcaagtccaccacctacatcacgctggaccagacctgcgagcacctcaaggtgagctgcggccccaagtccatccagttccacgcctgcttcaaccagcacatgagctgcgtgcggttcctgcaccgcaccatcctgccggggtccatggccaacagcatctgccagaacatcgagatcatcatcctcaccacgctggccctgctcatcttcctgctgctcaccatcctgtccaagacctacatctgctacctgctcatgcccatcttcatccccatcgcgcacctgtacggcctgatctacaacaagagctgcaagaagtgccagctctgcgggctggtctaccaccccttcaccgagtgcggcacgcactgcgtgtgcggcgcccggtacgagacctccgaccgcatgaagctgcaccgggccagcgggctctgcccgggctacaagagcctgcgcgccgcccgggtgatgtgcaagtccaaggggcccgcgagcaacctgtccatcatcaccgccgtcctcaccctgacgttcgtgacccccatcaacggcctgaccatcggcgacagcaaggaggtgctcaaccccgacgagctgccggacgacatgctggagatggcccagaagctcaacatgtaccagctgatctgcatcatcaactacaccgccacgtggtccatcatcatcatcgggctggccgtcttctacatcttcaagaagtaccagcaccgcttctacaactactacgcgatgtactgccaggagtgcgacatgtaccacgagcggagcggcctcaagtggaacggggacttcaccaacaagtgccgccagtgcacgtgcggcgagtacgaggacgccgccgggctgatctcccaccgcaagagctacaactgcctgctccagtacaaggtgaagtgggtcatgaacttcctgaccatctacgtggccctgatcatcctcaaggactccaccctgatcgtgcaggccgcgggcaccgacttcagcgactgcatcgagaccgaggagctgaactggaactgcaccggccccttcctcaacctggggaactgcgagaagaagcagaagaaggagtcctacagcaacatcgccgagcagctgaagggcctgcaggccatctccgtcctcgacatccccctgatcgcccggatccccgaggacatcagcgggggcctgcggtacatcgagtccatccgcacgcaccacgcccagctcaccgcggagtacgccatgctgacccggtactgcgactaccacaagctgttcggggacaacagcggctactcccagaccacctggcgcatgtacctccggagccacgacttcggcgcctgcatcctgtacccgaaccagcacttctgccgctgcgtgaagcacggggagaagtgctccagcagctcctgggacttcgccagcgagatgaagaactactactccggcaagcaggggaagttcaacaaggacctgaacctcgcgctgcagagcatccaccacgccttccgcggcacgtccagctcctacatcgccaccatcctgagcgagaagcggaacgaccagctcgtggagtacatggagaagctgcgcgagaagttcatcgggaacgccctgctccgggccgtcctggacttcatcacctacatgaagtccctgaccgagatgacgaacttcaagcacgacgagttctgggacgagttcgtgcacctccccgcgcccaccaaggcccccagcatgcgccggtccggcaacgagaactacgacttcaaggccccgaccagccccgccggcaccaagtcctgcaagaacatcaagaacgtggtctgcctgagcccccgctccggggccagctacgagggcatcgtggcgtgcggggagccctccgccccgcagatcttcaagatgcccagcgagagcatctaccacaacaacgccgaccagtccatgtactgcatcgccgacacgcactgcctgcaggactacagccccgtggaggacgaggagctcaacgccatcaagaagtccaagtgctgggagaccgagttcaccaacgcggtccccttcaagcagagcgacggcatccggtcctgccgcatgcgggacagcggcaactgcaacgtgaccacgaacctgtggccggtgatgcagtgcgacgacgggaagttctactactccgagcaccagaaggactacgacaaggaccaggacatcggccacttctgcctgagcccccgctgcaacatggtccggttccccatctccgagaagaacatcctcgcctgcgactggatcgtgagccacccgaacatcgacaagatcgacgtgcactccctggaggacctggagcagtacaagaaggccatcacccagaagctccagaccagcctgtccatcttcaagtacgccaagaccatgaacctgccccacgtcaagcccatctacaagtacatcagcatcgaggggacggagaccgcggagggcgtggagaacgccttcatcgagtccgagatccccgccctcgccgggaccagcatcggcttcaaggtgaactccaaggacggcaagcacatcatggacatcatcgggtacgtcaagaccgccagctactccagcgtgtacacgaagctgtacaccaccagcccgaccacgggcgtgaacaccaagcacgacgagctgtgcaccgggccctgccccaagcagatcgagcacaagaacggctggatcaccttctccaaggagcgcacgagctcctgggggtgcgaggagttcggctgcctcgcgatcagcgacggctgcgtcttcgggtcctgccaggacatcatcaaggacgagatgagcgtgtaccggaaggagaccgaggagaccaccatcgtggagctgtgcctgacgttctccgacaagacctactgcgtcgagctcaaccccgtgaccccgatcatcaccgacctgttcgaggtgcagttcaagacggtcgagagctacaccctgccccgcatcgtggccgtgaagaaccacgaggtcatggtgggccagatcaacgacctcggggtgtactccaagggctgcgggaacgtccagaaggtgaacggcaccgtgtacggcaacggggtccccaagttcgactacctgtgccacctggccagccggaaggaggtgatcatccgcaagtgcttcgacaacgactaccaggcctgcaagttcctccagtcccccagctcctaccggctggaggaggacgccagcaccgtgtccatcatcgactacaagaagatcctgggcaccatcaagatgaaggcgatcctcggggacgtccgctacaagacgttcagcgagtccatcgacatcagcgccgaggggacctgcaccggctgcgtgaactgcttcgagaacatccactgcgagttcaccatccactccacggtggaggccagctgcccggtcgtgagcacgtgcaccctgttccacgaccggatcctgatcggccccgacaaccacaagtacgccatgaaggtgatctgcaccgaggcccccaagacctccctcagcttcaagatctgcaacaccaaggtcgacgcggccatcaccatcgtggactccaagcccatcgtggagctggccccggtcgaccagaccgcctacatccgcgagaaggacgaccgctgcaagacgtggatgtgccgggtgcgcgacgagggcatgcaggtcctgagcgagcccttcaagaacctcttcgggtcctacatcggcatcttctacaccgggctggcggtgctgatcatcgccctcatcgccgtgtacatcgtcatgcccatctgcttcaaggtgaaggacatcctgaagaagcacgacgacgcctaccggcgcgagctgaagatccggtga

SEQ ID NO: 12605 - RNA, 4326 nt, synthetic construct
  misc_feature 1..4326: note = derived and/or modified CDS sequence (opt1) from SAV(20230)__KX817331.1__GP
  source 1..4326: mol_type = other RNA
atgatccccctcctgttcctggtgaccctggtcagcgccggcccggtgttccagcgctgcttccaggacggggccatcgtgaagcagaacccctccaaggaggcggtcaccgaggtgtgcatcaaggacgacgtgagcatgatcaagacggaggcccggtacgtccgcaactccagcggcgtgttctccaacaacgtggccctccggaagtggctggtcagcgactggcacgactgcaagcccaagaaggtgtccgggggccacatcaacgtgatcgaggtcgggaacgacctgaccctccacaccgagagctacgtgtgctccgccgactgcaccatcggcatcgacaaggagacggcccagatccgcctgcagaccgacaccaccaaccacttcgaggtggcgggcacgaccgtcaagagcgggtggttcaagtccaccacctacatcacgctggaccagacctgcgagcacctcaaggtgagctgcggccccaagtccatccagttccacgcctgcttcaaccagcacatgagctgcgtgcggttcctgcaccgcaccatcctgccggggtccatggccaacagcatctgccagaacatcgagatcatcatcctcaccacgctggccctgctcatcttcctgctgctcaccatcctgtccaagacctacatctgctacctgctcatgcccatcttcatccccatcgcgtacctgtacggcctgatctacaacaagagctgcaagaagtgccagctctgcgggctggtctaccaccccttcaccgagtgcggcacgcactgcgtgtgcggcgcccggtacgagacctccgaccgcatgaagctgcaccgggccagcgggctctgcccgggctacaagagcctgcgcgccgcccgggtgatgtgcaagtccaaggggcccgcgagcatcctgtccatcatcaccgccgtcctcatcctgaccttcgtgacgcccatcaacggcctgaccatcggcgacagcaaggaggtgttcaacctcgacgagctgcccgacgacatgctggagatggcccagaagctcaacatgtaccagctgatctgcatcatcaactacaccgccacctggtccatcatcatcatcgggctggccgtcttctacatcttcaagaagtaccagcaccgcttctacaactactacgcgatgtactgccaggagtgcgacatgtaccacgagcggagcggcctcaagtggaacggggacttcacgaacaagtgccgccagtgcacgtgcggcgagtacgaggacgccgccgggctgatctcccacaagaagtcctacaactgcctgctccagtacaaggtgaagtgggtcatgaacttcctgaccatctacgtggccctgatcatcctcaaggacagcaccctgatcgtgcaggccgcgggcaccgacttcagcgactgcatcgagaccgaggagctgaactggaactgcaccggcccgttcctcaacctggggaactgcgagaagaagcagaagaaggagtcctacagcaacatcgccgagcagctgaagggcctgcaggccatctccgtcctcgacatccccctgatcgcccggatccccgaggacatcagcgggggcctgcgctacatcgagtccatccggacccaccacgcccagctcacggcggagtacgccatgctgacccgctactgcgactactacaagctgttcggggacaacagcggctactcccagaccacctggcggatgtacctccgcagccacgacttcgaggcctgcatcctgtaccccaaccggcacttctgccgctgcgtgaagcacggcgagaagtgctccagcagctcctgggacttcgccagcgagatgaagaactactactccgggaagcagggcaagttcaacaaggacctgaacctcgcgctgcagagcatccaccacgccttccgcgggacctccagctcctacatcgccacgatcctgagcgagaagcggaacgaccagctcgtggagtacatgaagaagctgcgcgagaagttcatcggcaacgccctgctccgggccgtcctggacttcatcacctacatgaagtccctgaccgagatgaccaacttcaagcacgacgagttctgggacgagttcgtgcacctcccggcgcccacgaaggcccccagcatgcgccggtccgggaacgagaactacgacttcaaggcccccaccagcccggccggcaccaagtcctgcaagaacatcaagaacgtggtctgcctgagcccccgctccggcgccagctacgaggggatcgtggcgtgcggcgagccctccgcgccccagatcttcaagatgccgagcgagagcatctaccacaacaacgccgaccagtccatgtactgcatcgccgacacccactgcctgcaggactacagccccgtggaggacgaggagctcaacgccatcaagaagtccaagtgctgggagacggagttcaccaacgccgtccccttcaagcagagcgacgggatccggtcctgccgcatgcgggacagcggcaactgcaacgtgaccaccaacctgtggcccgtgatgcagtgcgacgacggcaagttctactactccgagcaccagaaggactacgacaaggaccaggacatcgggcacttctgcctgagcccgcgctgcaacatggtccggttccccatctccgagaagaacatcctcgcctgcgactggatcgtgagccaccccaacatcgacaagatcgacgtgcactccctggaggacctggagcagtacaagaaggccatcacgcagaagctccagaccagcctgtccatcttcaagtacgccaagaccatgaacctgccgcacatcaagcccatctacaagtacatcagcatcgagggcaccgagacggcggagggggtcgagaacgccttcatcgagtccgagatccccgccctcgccggcaccagcatcgggttcaaggtgaactccaaggacggcaagcacatcatggacatcatcggctacgtgaagaccgccagctactccagcgtctacaccaagctgtacacgaccgggcccaccaccggcgtgaacacgaagcacgacgagctgtgcaccgggccgtgccccaagcagatcgagcacaagaacggctggatcaccttcagcaaggagcgcacctccagctgggggtgcgaggagttcggctgcctcgcgatctccgacggctgcgtgttcgggagctgccaggacatcatcaaggacgagatgtccgtctaccggaaggagacggaggagaccaccatcgtggagctgtgcctgaccttcagcgacaagacgtactgcgtggagctcaaccccgtcacccccatcatcaccgacctgttcgaggtgcagttcaagaccgtggagtcctacacgctgccgcgcatcgtcgccgtgaagaaccacgaggtgatggtcggccagatcaacgacctcggggtgtacagcaagggctgcgggaacgtgcagaaggtcaacggcaccgtgtacggcaacggggtgcccaagttcgactacctgtgccacctggcctcccggaaggaggtcatcatccgcaagtgcttcgacaacgactaccaggcctgcaagttcctccagagcccctccagctaccggctggaggaggacgcctccaccgtgagcatcatcgactacaagaagatcctgggcaccatcaagatgaaggcgatcctcggggacgtgcgctacaagaccttctccgagagcatcgacatctccgccgagggcacgtgcaccgggtgcgtcaactgcttcgagaacatccactgcgagttcaccatccacagcaccgtggaggcctcctgccccgtggtcagcacgtgcaccctgttccacgaccggatcctgatcggcccggacaaccacaagtacgccatgaaggtgatctgcaccgaggcccccaagaccagcctctccttcaagatctgcaacacgaaggtggacgcggccatcaccatcgtcgacagcaagcccatcgtggagctggcccccgtggaccagaccgcctacatccgcgagaaggacgaccgctgcaagacctggatgtgccgggtccgcgacgagggcatgcaggtcctgctcgagccgttcaagaacctgttcgggtcctacatcggcatcttctacacggggctggcggtgctcatcatcgccctgatcgccgtgtacatcgtgatgcccatctgcttcaaggtcaaggacatcctgaagaagcacgacgacgcctaccggcgcgagctcaagatccggtga

SEQ ID NO: 12606 - RNA, 4329 nt, synthetic construct
  misc_feature 1..4329: note = derived and/or modified CDS sequence (opt1) from SDNV__AF123490.1__GP
  source 1..4329: mol_type = other RNA
atgatctgcatcctgctcctgatcgccctggccagcgcgtcccccgtgtaccagcgctgcttccaggacggcgccatcgtcaagcagtacccggccaaggacgccgtgaccgaggtgtgcctcaaggacgacgtcagcatgatcaagacccaggccaactacatgaagaacacgaccgggaccttctccaacaacgtggcgatgcggaagtggctggtggccgactggcacgactgccgcccccagaagtcctccggcgggcacatcaacgtcatcgaggtgggcgacgacctgagcctccacaccgaggcctacatctgctccgccgactgcgtgatcagcatcgacaaggagacggcgcagatccggctgcagaccgactccaccaaccacttcgaggtcagcgggaccacggtgaagtccggctggttcaagagcaccacctacatcaccctggaccagacgtgcgagcacctcaaggtgtcctgcggccccaagagcatccagttccacgcctgcttcaaccagcacatgtcctgcgtccgcttcctgcaccggaccatcctgcccgggagcatggccaactccatctgccagaacatcgagatcatcatcctcgtgaccctgaccctgatgatcttcatcctcctgacgatcatcagcaagacctacatctgctacatcctgatgccgatcttcatccccatcgcctacatctacggctggatctacaacaagtcctgcaagaagtgcaagctctgcgggctggtgtaccaccccttcaccgagtgcggcacccactgcgtctgcggggcccgctacgagacgagcgaccggatgaagctgcaccgcagctccggcctctgccccggctacaagagcctgcgggcggcccgcgtgatgtgcaagtcccgggggccggccagcatcctgtccatcctcaccgccgtgctgatcctgaccttcgtcacccccatgagcgccctcgtgatcggctccagcgaggagctgtacaagctggacgagctccccgacgacatgatcgacatggcggagaaggtgaacctgtactacctggtcatcgtgctcaactactccgccacgtgggggctgctgctcctgatgggcatcctggccctcctgttcaagaagtaccagcacatcttcctgaactactacgccatgtactgcaccgagtgcgacatgtaccacgacaagaaggagctcacctacaacggcgacagccccaccaacgcctggcagtgcacgtgcgggcagtacgaggacgcgaccggcctgatcgtgcaccagaagtcctacaactgcctggtcaagtacaaggtgaagtggatcaagaacatcctcatcatgtacatcgtcctgaccctgatcaaggacagcgtgctcatcgcctccgccgaggggccggacttcgcgacctgcatcgaggagaagacgatcacctggaactgcaccggccccttcctgaacctggggcgctgcgacaagacccagaagaagacggactacgccaccatcgccagccagctgaagggcatcgacgccatctccatcctcgacgtgcccatgatcagcaagatccccgaggacatctccggcgccctgaagtacatcgagagcctgaagacctaccacgagcagctcaccgccgagtacgcgatgttcacccggtactgcgactactacacgcagttctccgacaacagcgggtacagccagaccacctggcgcacctacctgcggtcccacgacttcgaggtctgcatcgcctacccgaaccagcacttctgccgctgcgtgaagaacggcgagaagtgcagctccgcccagtgggacttcgccacggagatcaaggggtactacaccggccggcagaacaagttcaacaaggacctgaacctcgccctgatgaccttccacaccgcgttccgcgggacggccaccagctacgtgaccgagctgatctccaagggcaagaacagctccctcctgatgtacgccagcgccatcaagtccaagttcaacggcaacgccctgctcaaggcgctgctggacttcatgatgtacctccagagcctgggggagatctccggcttcaagctgaccgacgagtgggaggacttcaagtacgaggaggagcccacggagcagaccctcatgccccgggggcaccgcggcgggcagtacaacttcaagaacgccgccagcaacggcaagaccaaggtctgcaagaacgtgaagaaggtgctgtgcctgagcccccggagccgcgccaccttcgacgacgtcatcgcctgcggcgagcacgcgaacccgtccgtgtacatgatccccaacacgaccatctaccagagcaacaccgagcgctcccactactgcatcgccgacagccactgcctcgaggagtacgagctggtgaagcccgagctgctcaccgccctgaagaagtcccggtgctgggccggggacatcgacacgatcgtcctgcacaagcagtccgacggcctccgcagctgccggatcaaggacaccgggtcctgcaacgtgatgggcaacgactggaccatcgtgctgtgcgaggacaacaagtactactacagcgaggtccaccaggactacgacaaggaccaggacgtgggccacttctgcctgagcccccgctgcaacaccatccggtacccgatcagcccccgccacatcaactcctgcaagtggcagatcagccactccacgatcgggaagatcagcgtgcacgagctcgcggacatcgagcagtacaagaaggccatctcccagaagctgcagaccagcctgtccatcttcaagtacgccaagaccaagaacctcccccacatcaagcccgtctacaagtacatcgccatcgagggcaccgagacggtggagggggtggagaacgccttcatcgagagcgagatcccggcgctggccggcaccgccatcgggttcaagatcaactccaaggagggctaccacctgatggacatcatcggctacgtcaagagcgcctcctacagctccacctacaccaagctctacacgaccgggcccaccatcggcatcaacaccaagcacgacgagaagtgcacggggagctgccccggcaccatccaccacaagaccgggtggctgaccttcagcaaggagcggacctccacgtggggctgcgaggagttcggctgcctggccgtgagcgacgggtgcgtgtacggctcctgccaggacatcatcaaggacgagctcaccgtctaccgcaagatcagcgacgaggtgaccgaggtggagctgtgcctgaccttctccgacaagacgtactgcaccaacctcaacgcggtcaccccgatcatcaccgacaagttcgaggtgcagttcaagacggtggagagctactccctgccccggatcgtcggggtgcgcaaccacaagatccagatcggccagatcaacgacatcggggtgtacagcaagggctgcggcaacgtccagaaggtgaacgggaccaactacggcaacggggtgcccaagttcgactacctgtgccacctcgcctcccggaaggaggtcatcatccgcaagtgcttcgacaacgactaccaggcctgcaagttcctgcagacccccgccagctaccggctggaggagcaccagggcaccgtgacgatcatcaactacaagaagatcctcgggtccatcaagatgaagccgtactgggtgatgctgcgctacaagaactacgccaacagcctggacatcaacgcggaggggacctgctccggctgcgtcggctgcttcgagaacatccactgcgagttcaccatccacaccacgatcgaggccagctgccagatcgagtccgactgcaccaccttccacgaccggatcctcgtgacccccaacgagcacaagtacgccctgaaggtgatctgccacgacaagcccaagacgatcttcaacttcaagatctgcaacaccgagatcgaggccgcgatcgccatcgtcgacgccaagcccatcatcgagctggccccggtggaccagaccgcctacatccgcgagaaggacgagcggtgcaagacctggatgtgccgcgtgcgggacgagggcatccaggtcctcctggagcccttcaagaacctgttcgggagctacatcggcatcttctacacgatcctcatcgtgatcttcatcctggtgatcatcatctacatcatcctgcccatctgcttcaagctccaggacaccctgaagcagcacgaggacgcgtacaagcgcgagatgaagatccgctga

SEQ ID NO: 12607 - RNA, 4329 nt, synthetic construct
  misc_feature 1..4329: note = derived and/or modified CDS sequence (opt1) from SDNV(BeAr103645)__KX817334.1__GP
  source 1..4329: mol_type = other RNA
atgatctgcatcctgctcctgatcgccctggccagcgcgtcccccgtgtaccagcgctgcttccaggacggcgccatcgtcaagcagtacccggccaaggacgccgtgaccgaggtgtgcctcaaggacgacgtcagcatgatcaagacccaggccaactacatgaagaacacgaccgggaccttctccaacaacgtggcgatgcggaagtggctggtggccgactggcacgactgccgcccccagaagtcctccggcgggcacatcaacgtcatcgaggtgggcgacgacctgagcctccacaccgaggcctacatctgctccgccgactgcgtgatcagcatcgacaaggagacggcgcagatccggctgcagaccgactccaccaaccacttcgaggtcagcgggaccacggtgaagtccggctggttcaagagcaccacctacatcaccctggaccagacgtgcgagcacctcaaggtgtcctgcggccccaagagcatccagttccacgcctgcttcaaccagcacatgtcctgcgtccgcttcctgcaccggaccatcctgcccgggagcatggccaactccatctgccagaacatcgagatcatcatcctcgtgaccctgaccctgatgatcttcatcctcctgacgatcatcagcaagacctacatctgctacatcctgatgccgatcttcatccccatcgcctacatctacggctggatctacaacaagtcctgcaagaagtgcaagctctgcgggctggtgtaccaccccttcaccgagtgcggcacccactgcgtctgcggggcccgctacgagacgagcgaccggatgaagctgcaccgcagctccggcctctgccccggctacaagagcctgcgggcggcccgcgtgatgtgcaagtcccgggggccggccagcatcctgtccatcctcaccgccgtgctgatcctgaccttcgtcacccccatgagcgccctcgtgatcggctccagcgaggagctgtacaagctggacgagctccccgacgacatgatcgacatggcggagaaggtgaacctgtactacctggtcatcgtgctcaactactccgccacgtgggggctgctgctcctgatgggcatcctggccctcctgttcaagaagtaccagcacatcttcctgaactactacgccatgtactgcaccgagtgcgacatgtaccacgacaagaaggagctcacctacaacggcgacttcaccaacaagtgccgccagtgcacgtgcgggcagtacgaggacgccaccggcctgatcgtgcaccagaagtcctacaactgcctggtcaagtacaaggtgaagtggatcaagaacatcctcatcatgtacatcatcctgaccctgatcaaggactccgtcctcatcgcgagcgccgaggggcccgacttcgcgacctgcatcgaggagaagacgatcacctggaactgcaccggcccgttcctgaacctggggcggtgcgacaagacccagaagaagacggactacgccaccatcgcctcccagctgaagggcatcgacgccatcagcatcctcgacgtgcccatgatctccaagatccccgaggacatcagcggcgccctgaagtacatcgagtccctgaagacctaccacgagcagctcaccgccgagtacgccatgttcacccgctactgcgactactacacgcagttcagcgacaactccgggtacagccagaccacctggcggacctacctgcgcagccacgacttcgaggtgtgcatcgcgtaccccaaccagcacttctgccggtgcgtcaagaacggcgagaagtgctccagcgcccagtgggacttcgccacggagatcaaggggtactacaccggcaagcagaacaagttcaacaaggacctgaacctcgccctgatgaccttccacaccgccttccgcgggacggcgacctcctacgtgaccgagctgatcagcaagggcaagaactccagcctcctgatgtacgcctccgccatcaagagcaagttcaacggcaacgccctgctcaaggccctgctggacttcatgatgtacctccagtccctgggggagatcagcggcttcaagctgaccgacgagtgggaggacttcaagtacgaggaggagccgacggagcagaccctcatgccccgggggcaccgcggcgggcagtacaacttcaagaacgcggcctccaacagcaagaccaaggtgtgcaagaacgtcaagaaggtgctgtgcctgagcccccggagccgcgccaccttcgacgacgtgatcgcctgcggcgagcacgccaacccctccgtctacatgatcccgaacacgaccatctaccagagcaacaccgagcgctcccactactgcatcgcggacagccactgcctcgaggagtacgagctggtgaagcccgagctgctcaccgccctgaagaagtcccggtgctgggccggcgacatcgacacgatcgtgctgcacaagcagagcgacgggctccgcagctgccggatcaaggacaccggctcctgcaacgtcatggggaacgactggaccatcgtgctgtgcgaggacaacaagtactactacagcgaggtgcaccaggactacgacaaggaccaggacgtcggccacttctgcctgagcccccgctgcaacaccatccggtaccccatcagcccgcgccacatcaactcctgcaagtggcagatcagccactccacgatcggcaagatcagcgtgcacgagctcgccgacatcgagcagtacaagaaggcgatctcccagaagctgcagaccagcctgtccatcttcaagtacgccaagaccaagaacctcccccacatcaagcccgtgtacaagtacatcgccatcgaggggaccgagacggtcgagggcgtggagaacgccttcatcgagagcgagatccccgccctggcggggaccgccatcggcttcaagatcaactccaaggaggggaaccacctgatggacatcatcggctacgtcaagagcgcctcctacagctccacctacaccaagctctacacgaccggcccgaccatcgggatcaacaccaagcacgacgagaagtgcacgggcagctgccccgggaccatccaccacaagaccggctggctgaccttcagcaaggagcggacctccacgtgggggtgcgaggagttcggctgcctggccgtgagcgacggctgcgtgtacgggtcctgccaggacatcatcaaggacgagctcaccgtgtaccgcaagatcagcgacgaggtcaccgaggtggagctgtgcctgaccttctccgacaagacgtactgcaccaacctcaacgccgtgacccccatcatcaccgacaagttcgaggtccagttcaagacggtggagagctactccctgccgcggatcgtgggcgtccgcaaccacaagatccagatcgggcagatcaacgacatcggcgtgtacagcaaggggtgcggcaacgtgcagaaggtcaacggcaccaactacgggaacggcgtgcccaagttcgactacctgtgccacctcgcgtcccggaaggaggtgatcatccgcaagtgcttcgacaacgactaccaggcctgcaagttcctgcagacccccgccagctaccggctggaggagcaccaggggaccgtcacgatcatcgactacaagaagatcctcggctccatcaagatgaaggccatcctgggggacgtgcgctacaagaactacgccaacagcctggacatcaacgcggaggggacctgcgccggctgcgtgggctgcttcgagaacatccactgcgagttcaccatccacaccacgatcgaggcctcctgccagatcgagagcgactgcaccaccttccacgaccggatcctcgtcacccccaacgagcacaagtacgccctgaaggtgatctgccacgacaagccgaagacgatcctgaacttcaagatctgcaacaccaagatcgaggcggccatcaccatcgtggacgccaagcccatcatcgagctcgcccccgtcgaccagaccgcctacatccgcgagaaggacgagcggtgcaagacgtggatgtgccgcgtgcgggacgagggcatccaggtgctgctggagcccttcaagaacctcttcgggtcctacatcggcatcttctacaccatcctgatcgtcatcttcatcctggtgatcatcatctacatcatcctcccgatctgcttcaagctgcaggacaccctgaagcagcacgaggacgcgtacaagcgcgagatgaagatccgctga

SEQ ID NO: 12608 - RNA, 4326 nt, synthetic construct
  misc_feature 1..4326: note = derived and/or modified CDS sequence (opt1) from SSHV__EU262553.1__GP
  source 1..4326: mol_type = other RNA
atgatctgcatcctgatcctcttcgccgtgaccgccgcgagccccgtctaccagcgctgcttccaggacggcgccatcgtgaagcagaacccgtccaaggaggccgtgaccgaggtctgcctgaaggacgacgtgagcatgatcaagacggaggcccggtacatcaagaacgccaccggggtgttctccaacaacgtcgcgatccgcaagtggctggtgagcgactggcacgactgccggcccaagaagatcaccggcgggcacatcaacgtgatcgaggtcggcgacgacctctccctgcacaccgagagctacgtgtgctccgccgactgcacgatcggggtggacaaggagaccgcccaggtccgcctgcagaccgacaccacgaaccacttcgagatcgccggcaccaccgtcaagagcggctggttcaagtccaccacgtacatcaccctcgaccagacctgcgagcacctgaaggtgagctgcgggcccaagtccatccagttccacgcgtgcttcaaccagcacatgagctgcgtgcggttcctgcaccgcaccatcctccccggctccatcgccaacagcatctgccagaacatcgagatcatcatcctggtgacgctgaccctcctgatcttcatcctgctctccgtgctgagcaagacctacatctgctacctgctcatgccggtcttcatccccatcgcctacgcctacgggatcatctacaacaagtcctgcaagaagtgcaagctgtgcggcctggtgtaccaccccttcaccgagtgcgggacgcactgcgtgtgcggcgcccggtacgacaccagcgaccgcatgaagctccaccgggcgtccggcctgtgccccgggtacaagagcctgcgcgccgcccgggtcatgtgcaagagcaagggcccggcctccatcctcagcgtgatcaccgccatcctgatcctgaccttcgtgacgcccatcaactccatggtcgtgggggagagcaaggaggtcttcgagctcgagcagctgcccgacgacatgctggacatggcgctccgcatcaacttctactacttcgtgtgcatcatgaactacgccgtgacctggggcctgatcatcatcggcctgctcatcgggctgctgttcaagaagtaccagcaccggttctccaacctctacgccatgtactgcgaggagtgcgacatgtaccacgaccgcagcggcctgaagcggaacggggacttcaccaacaagtgccgccagtgcacgtgcggccagtacgaggacgccaccgggctgatgacccaccggaagacctacaactgcctcgtccgctacaaggccaagtgggtgatgaacttcctgatcgcgtacatgctgctcaccctgatcaaggactccgccatcgtggtccaggccgccggcacggacttcacgacctgcctggagaccgagaacatcaactggaactgcaccggccccttcctcaacctggggaactgccagaagcagcagaagaaggagccgtacgccaacatcgcgacccagctgaagggcctccaggccatcagcgtgctggacatgcccatgatcgcctccatccccgaggacatcgccggggcgctgcggtacatcgaggagaaggagaccttccacgtgcagctgaccgccgagtacgccatgctcagccgctactgcgactactacgcccagttctccgacaacagcggctactcccagaccacgtggcgggtctacctgcgcagccacgacttcgacgcctgcatcctgtaccccaaccagcacttctgccgctgcgtgaagcacggggacaagtgctccagctccaaccgggacttcgcgaacgagatgaagaactactacagcggcaagcagaacaagttcgacaaggacctcaacctggccctgatggccctccaccacgccttccgcggcacctccagcgcctacatcgcgaccatgctgagcaagaagtccaacgacgacctgatcgcctacaccaacaagatcaaggagaagttcccggggaacgccctcctgaaggccatcgtggactacatcgcctacatgaagtccctgagcgagatgagctccttcaagtacgacgagttctgggacgacctcctgtacaagagcgcgcccacgaaggccccctccctgagccggggctccgagcccagctacaacttcaagctcgtcgtgtccagccgctccatcaagagctgcaagaacgtgaagtccgtcgtgtgcctgagcccgcggtccggggtgagctacgacagcatcatcgcctgcggcgaccccaacgggccctccgtctaccgcaagcccagcgacggcgtgttccagtccaacgccgaccagagcacctactgcctggcggactcccactgcctcgaggacttcgaggtggtcagccaggaggagctggacgccatcaagaagtccaagtgctgggaggccgagtacccggacgtgaagctgagcaagctcaccgacggcgtgaagtcctgccggatgaaggacagcgggaactgcaacgtcgccgccaaccgctggcccatcatccagtgcgagaacgacaagttctactactccgagctgcagaaggactacgacaagacccaggacatcggccacttctgcctgagccccgggtgctccacggtgcggttccccatcaacccgaagcacatcagcaactgcaactggcaggtctcccgcagctccatcgcgaagatcgacgtgcacaacatcgaggacatcgaccagtaccggaaggccatcacccagaagctccagaccagcctgtccctgttcaagtacgccaagaccaagaacctcccccacatcaagcccatctacaagtacatcacgatcgagggcaccgagaccgccgagggcatcgagagcgcctacatcgagagcgagatcccggcgctggccgggacctccatcggcttcaagatcacgagcaaggaggggaagcacctcctggacgtgatcggctacgtgaagtccgccagctactccagcatctacaccaagctgtacaccaccgggcccacgtccggcatcaacaccaagcacgacgagctgtgcaccggcccctgccccgccaagatcaaccaccagaccgggtggctcacgttcgccaaggagcgcaccagctcctggggctgcgaggagttcgggtgcctggcgatcagcgacggctgcgtcttcgggtcctgccaggacatcatccgggacgagctgaccgtgtaccgcaaggagaccgacgaggtgacggacgtcgagctctgcctgaccttcagcgacaagacctactgcaccaacctgaacccgatcacgcccatcatcaccgacctcttcgaggtgcagttcaagaccgtggagacctactccctgccccggatcgtcgccatccagaaccacgagatcaagatcggccaggtgaacgacctgggcgtgtacagcaaggggtgcggcaacgtccagaaggtgaacgggacggtgtacggcaacggggtccccaagttcgactacctctgccacctggcctcccgcaaggaggtgatcgtgcggaagtgcttcgacaacgactaccaggcctgcaagttcctgcagagcccggcgtcctaccgcctcgaggaggacagcggcaccgtcaccgtgatcgactacaagaagatcctgggcaccatcaagatgaaggccatcctgggggacgtgaagtacaagaccttcgccgacaacgtcgacatgacggccgagggctcctgcaccgggtgcatcaactgcttcgagaacatccactgcgagctcaccctgcacaccacgatcgaggccagctgccccatcgtgagcacgtgcaccgtgttccacgaccggatcctggtcacccccaacgagcacaagtacgcgctcaaggtggtctgcaccgagaagcccggcaacaccctgaccatccgcatctgcaacaccaaggtggaggcctccctggccctcgtggacgccaagccgatcctggagctggcccccgtcgaccagacggcgtacatccgcgagaaggacgagcggtgcaagacctggatgtgccgcgtgcgggacgaggggctccaggtgatcctggagcccttcaagaacctgttcggcagctacatcggcatcttctacaccttcatcatctccatcatcgccctcctgatcatcatctacatcgtcctgcccatctgcttcaagctccgcgacaccctgcggaagcacgaggacgcctacaagcgcgagatgaagatccggtga

SEQ ID NO: 12609 - RNA, 4326 nt, synthetic construct
  misc_feature 1..4326: note = derived and/or modified CDS sequence (opt1) from SSHV__K02539.1__GP
  source 1..4326: mol_type = other RNA
atgatctgcatcctgatcctcttcgccgtgaccgccgcgagccccgtctaccagcgctgcttccaggacggcgccatcgtgaagcagaacccgtccaaggaggccgtgaccgaggtctgcctgaaggacgacgtgagcatgatcaagacggaggcccggtacatcaagaacgccaccggggtgttctccaacaacgtcgcgatccgcaagtggctggtgagcgactggcacgactgccggcccaagaagatcaccggcgggcacatcaacgtgatcgaggtcggcgacgacctctccctgcacaccgagagctacgtgtgctccgccgactgcacgatcggggtggacaaggagaccgcccaggtccgcctgcagaccgacaccacgaaccacttcgagatcgccggcaccatcgtcaagagcggctggttcaagtccaccacctacatcacgctcgaccagacctgcgagcacctgaaggtgagctgcgggcccaagtccatccagttccacgcgtgcttcaaccagcacatgagctgcgtgcggttcctgcaccgcaccatcctccccggctccatcgccaacagcatctgccagaacatcgagatcatcatcctggtgaccctgacgctcctgatcttcatcctgctctccgtgctgagcaagacctacatctgctacctgctcatgccggtcttcatccccatcgcctacgcctacgggatcatctacaacaagtcctgcaagaagtgcaagctgtgcggcctggtgtaccaccccttcaccgagtgcgggacccactgcgtgtgcggcgcccggtacgacacgagcgaccgcatgaagctccaccgggcgtccggcctgtgccccgggtacaagagcctgcgcgccgcccgggtcatgtgcaagagcaagggcccggcctccatcctcagcgtgatcaccgccatcctgatcctgaccttcgtgacccccatcaactccatggtcgtgggggagagcaaggaggtcttcgagctcgagcagctgcccgacgacatgctggacatggcgctccgcatcaacttctactacttcgtgtgcatcatgaactacgccgtgacgtggggcctgatcatcatcggcctgctcatcgggctgctgttcaagaagtaccagcaccggttctccaacctctacgccatgtactgcgaggagtgcgacatgtaccacgaccgcagcggcctgaagcggaacggggacttcaccaacaagtgccgccagtgcacgtgcggccagtacgaggacgccaccgggctgatgacccaccggaagacctacaactgcctcgtccgctacaaggccaagtgggtgatgaacttcctgatcgcgtacatgctgctcaccctgatcaaggactccgccatcgtggtccaggccgccggcaccgacttcacgacctgcctggagaccgagaacatcaactggaactgcaccggccccttcctcaacctggggaactgccagaagcagcagaagaaggagccgtacgccaacatcgcgacgcagctgaagggcctccaggccatcagcgtgctggacatgcccatgatcgcctccatccccgaggacatcgccggggcgctgcggtacatcgaggagaaggagaccttccacgtgcagctgaccgccgagtacgccatgctcagccgctactgcgactactacgcccagttctccgacaacagcggctactcccagaccacctggcgggtctacctgcgcagccacgacttcgacgcctgcatcctgtaccccaaccagcacttctgccgctgcgtgaagcgcggggacaagtgctccagctccaacggcgacttcgcgaacgagatgaagaactactacagcggcaagcagaacaagttcgacaaggacctcaacctggccctgatggccctccaccacgccttccgggggacgtccagcgcctacatcgcgaccatgctgagcaagaagtccaacgacgacctgatcgcctacaccaacaagatcaaggagaagttcccgggcaacgccctcctgaaggccatcgtggactacatcgcctacatgaagtccctgagcgagatgagctccttcaagtacgacgagttctgggacgacctcctgtacaagagcgcgcccaccaaggccccctccctgagccgggggtccgagcccagctacaacttcaagctcgtcgtgtccagccgctccatcaagagctgcaagaacgtgaagtccgtcgtgtgcctgagcccgcggtccggcgtgagctacgacagcatcatcgcctgcggggaccccaacggcccctccgtctaccgcaagcccagcgacggcgtgttccagtccaacgccgaccagagcacgtactgcctggcggactcccactgcctcgaggacttcgaggtggtcagccaggaggagctggacgccatcaagaagtccaagtgctgggaggccgagtacccggacgtgaagctgagcaagctcaccgacggggtgaagtcctgccggatgaaggacagcggcaactgcaacgtcgccgccaaccgctggcccatcatccagtgcgagaacgacaagttctactactccgagctgcagaaggactacgacaagacccaggacatcgggcacttctgcctgagccccggctgctccaccgtgcggttccccatcaacccgaagcacatcagcaactgcaactggcaggtctcccgcagctccatcgcgaagatcgacgtgcacaacatcgaggacatcgaccagtaccggaaggccatcacgcagaagctccagaccagcctgtccctgttcaagtacgccaagaccaagaacctcccccacatcaagcccatctacaagtacatcaccatcgagggcacggagaccgccgaggggatcgagagcgcctacatcgagagcgagatcccggcgctggccggcacctccatcgggttcaagatcaccagcaaggagggcaagcacctcctggacgtgatcgggtacgtgaagtccgccagctgctccagcatctacacgaagctgtacaccaccggccccacctccggcatcaacacgaagcacgacgagctgtgcaccgggccctgccccgccaagatcaaccaccagaccggctggctcaccttcgccaaggagcgcacgagctcctgggggtgcgaggagttcggctgcctggcgatcagcgacgggtgcgtcttcggctcctgccaggacatcatccgggacgagctgaccgtgtaccgcaaggagaccgacgaggtgaccgacgtcgagctctgcctgacgttcagcgacaagacctactgcaccaacctgaacccgatcacccccatcatcacggacctcttcgaggtgcagttcaagaccgtggagacctactccctgccccggatcgtcgccatccagaaccacgagatcaagatcggccaggtgaacgacctgggggtgtacagcaagggctgcgggaacgtccagaaggtgaacggcaccgtgtacgggaacggcgtccccaagttcgactacctctgccacctggcctcccgcaaggaggtgatcgtgcggaagtgcttcgacaacgactaccaggcctgcaagttcctgcagagcccggcgtcctaccgcctcgaggaggacagcggcacggtcaccgtgatcgactacaagaagatcctggggaccatcaagatgaaggccatcctgggcgacgtgaagtacaagaccttcgccgacaacgtcgacatgaccgccgaggggtcctgcacgggctgcatcaactgcttcgagaacatccactgcgagctcaccctgcacaccaccatcgaggccagctgccccatcgtgagcacgtgcaccgtgttccacgaccggatcctggtcacccccaacgagcacaagtacgcgctcaaggtggtctgcaccgagaagcccgggaacacgctgaccatccgcatctgcaacaccaaggtggaggcctccctggccctcgtggacgccaagccgatcctggagctggcccccgtcgaccagaccgcgtacatccgcgagaaggacgagcggtgcaagacgtggatgtgccgcgtgcgggacgagggcctccaggtgatcctggagcccttcaagaacctgttcggcagctacatcgggatcttctacaccttcatcatctccatcatcgccctcctgatcatcatctacatcgtcctgcccatctgcttcaagctccgcgacaccctgcggaagcacgaggacgcctacaagcgcgagatgaagatccggtga

SEQ ID NO: 12610 - RNA, 4335 nt, synthetic construct
  misc_feature 1..4335: note = derived and/or modified CDS sequence (opt1) from SORV__AF123488.1__GP
  source 1..4335: mol_type = other RNA
atggaggtgctgagcctcatctggctgctgaccctctgctccgccagccccgtcttccagcgctgcttccaggacggcgccatcgtgaagcagaacccgtccaaggaggcggtgaccgaggtctgcctgaaggacgacgtgagcatgatcaagacggagaccaagtacgtgaagaacaccaccgggacgttcgccaacaacatcgccatgcggaagtggctggtcgccgactggcacgactgccgcccccagaagtccagcggcgggcacatcaacgtgatcgaggtgggcgacgacctctccctgcacaccgagagctacatctgctccgccgactgcgtcatcaccgtggacaaggagaccgcgcagatccggctgcagacggacaacaccaaccacttcgaggtggccgggaccaccgtcaagagcggctggttcaagtccacgacctacatcaccctcgaccagacctgcgagcacctgaaggtgagctgcggccccaagtccatccagttccacgcctgcttcaaccagcacatgagctgcgtgcgcttcctgcaccggacgatcctccccgggtccatcgccaacagcatctgccagaacatcgagatcatcatcctggtcaccctgtccctcgtgatcttcatcttcctgaccatcgtgagcaagacctacatctgctacctgctcatgccgatcttcatccccatcgcgttcatctacggctggatctacaacaagtcctgcaagaagtgcaagctgtgcgggctggtctaccaccccttcacggagtgcggcacccactgcgtgtgcggggcccgctacgagaccagcgaccggatgaagctccaccgcgccagcggcctgtgccccggctacaagtccctgcgggccgcccgcgtgatgtgcaagagcaaggggccggcgtccatcctcagcatcctgaccgccatcctgatcctcacgttcgtcacccccatctccgccatggtggtgggcgagagcaacgagatctacaccctggacgacctgcccgacgacatggtccagatggccgagcggatcaacatctactaccagatcctcatcatcaactacggggtgacctgggccttcctgctgctcggcctggtcctggcgtacttcttcaagaagtaccagcacaagttcctcgactactacgccatgtactgcgaggagtgcgacatgtaccacgagaagtccggcatgacgtactggggcgacttcaccaacaagtgccgccagtgcacgtgcgggcagttcgaggacgccaccgggctgatggtgcacaagaagtcctacaactgcctggtgaagtacaaggccaagtggatccggaacatcctcatcgcctacctgatgatcatgctggtcaaggacagcctcctgttcgtgggcgcgacccgcgccgacttcgccagctgcgtggacgagaagaccgtcacctggaactgcaccgggcccttcctgaacctcggccggtgcgacaagacgcagaagaagaccggctacaaggacatcgccaaccagctgaaggggctgggcgtgatctccatcctcgacatcccgatgatcgagaagatgcccgacgagatcagcgggtccctgaagtacatcgacagcctggagacctaccacgagcagctgaccgccgagtacgcgttcctcacccgctactgcgactactacacgcagtacaccgacaactccggctacagccagaccgtgtggcggacctacctgcgctcccacgacttcggggcctgcgtcgtgtaccccaaccagcacttctgccggtgcgtgaagtacgacgacaagtgcaacagcgccaagtgggacttcgccaacgagatgaagacgttctacaccggccgcaaggtcaagttcaacaaggacctgaacctcgcgctgctggtgctccacaaggccttccggggcaccgggaccgcctacatcgccgaggccatggcgcgcaaggacaacggctccatggcccacttcgccctggagatccgcaagaagttccccacgaacgccctgctcgccgcgctgatcgactacatcgtgtacctgcagagcctcgccgagatcagcaccttcgagctggaggaggactgggaggacttcaagtacaagccggagcccaccgagtccaccctgcagccccggagccaccgctccgaccagtacaacttcaagaacgccgacagcaactccaacgtcaaggtgtgcaagaacgtgaagaaggtcctctgcgtgagcccccggtcccgcgccaagttcgagaacatcatcgcctgcggggagcacgcgaacccgagcgtgtacatgatgcccaacatctccatctaccagagcaactccgagcggagccactactgcatcgccgactcccactgcctggaggagtacgagatcgtcaacacggagctgctcaccgccctgaagaagtcccgctgctgggccaaggagatggacgacgtggtgctgcacaagcagagcgacggcctccggagctgccgcatcaaggacaccgggtcctgcaacgtcctgggcaacgactggaccatcgtgctgtgcgagaacggcaactactactacagcgagatccacaaggactacgacaaggaccaggacgtggggcacttctgcctcagcccccggtgctccacgatccgctaccccatcaaccggcgccacatccggaagtgcgactggcagatcagccactccaccatcgacaagatcagcgtccaggagctggcggacatcgagcagtacaagaaggccatctcccagaagctgcagaccagcctctccatcttcaagtacgtgaagaccaagaacctgccgcacatcaagcccgcctacaagtacatcacggtggagggcaccgagaccatcgaggggatcgagaacgccttcatcgagagcgagatccccgccctggcgggcaccgccatcggcttcaagatcaactcccgcgaggggaactacctcatggacgtcatcggctacgtcaagagcgcctcctacagcgccacgtacaccaagctgtacaccaccgggcccacgatcggcatcaacacccggcacgacgagaagtgcaccgggccgtgccccgtgaccatcgaccacaaggacggctggctgacgttctccaaggagcgcaccagcacctggggctgcgaggagttcgggtgcctcgccgtgtccgacggctgcgtgttcgggagctgccaggacatcatcaaggacgagctggcggtgtaccggaagaccacggaggagctgaccaccgtcgagctctgcctgaccttctccgacaagacctactgcacgaacctgaacgccatcacccccatcatcaccgacaagttcgaggtgcagttcaagaccgtggagagctacacgctcccgcgcatcatcgccgtcaagaaccacgagatcaaggtgggccagatcaacgacctgggggtgtactccaagggctgcggcaacgtccagaaggtgaacgggaccaactacggcaacggggtgcccaagttcgactacctgtgccacctcgccagccggaaggaggtcatcctgcgcaagtgcttcgacaacgactaccaggcctgcaagttcctgcagagccccgcgtcctaccgcctcgaggagcaccagggcaccgtgaccgtgatcgactacaagaagatcctggggagcatcaagatgaaggccatcctgggcgacgtcaagtacaagaactaccagtccaacatcgagatcaacgccgagggcacgtgcgccgggtgcgtgaactgcttcgagaacatccactgcgagttcaccatccacaccaccgtggagacgagctgccccatcgtcaccgactgcgtgtccttccacgaccggatcctcatcaccccggacgagcacaagtacgcgctgaagatcgtctgccaggacaagcccaaggtgagcctgaagttcaagatctgcaacaccaacatcgacgcctccatgacgatcgtggacagcaagcccatcctcgagctggcccccgtcgaccagaccgcctacatcaaggagaaggacgagcgctgcaagacctggatgtgccgggtgcgcgacgagggcttccaggtgatcctggagccgttcaagaacctcttcgggtcctacatcggcatcttctacaccgggatcctgagcgtcatctgcctgctcatcgtgatctacatcgtgctgcccatctgcttcaagctgcgggacacgctcaagcagcacgaggacgcctacaagaaggagatgaagatccgctga

SEQ ID NO: 12611 - RNA, 4335 nt, synthetic construct
  misc_feature 1..4335: note = derived and/or modified CDS sequence (opt1) from SORV(SORV-252)__JN815081.1__GP
  source 1..4335: mol_type = other RNA
atggaggtgctgagcctcatctggctgctggccgtctgctccgccaaccccgtgttccagcgctgcttccaggacggcgcgatcgtgaagcagaacccgagcaaggaggccgtcaccgaggtgtgcctcaaggacgacgtgtccatgatcaagaccgaggccaagtacgtcaagaacacgaccgggaccttcagcaacaacgtggccatgcggaagtggctggtggccgactggcacgactgccgcccccagaagtccagcggcgggcacatcaacgtcatcgaggtgggcgacgacctgtccctccacaccgagagctacatctgctccgcggactgcgtgatcacggtcgacaaggagaccgcccagatccggctgcagaccgacagcaccaaccacttcgaggtggccgggacgaccgtgaagtccggctggttcaagagcaccacctacatcacgctggaccagacctgcgagcacctcaaggtctcctgcggccccaagagcatccagttccacgcctgcttcaaccagcacatgtcctgcgtgcgcttcctgcaccggaccatcctgcccgggagcatcgcgaactccatctgccagaacatcgagatcatcatcctcgtgaccctgagcctgatcatcttcatcttcctcacgatcgtctccaagacctacatctgctacctgctgatgccgatcttcatccccatcgccttcatctacggctggatctacaacaagagctgcaagaagtgcaagctctgcgggctggtgtaccaccccttcaccgagtgcggcacccactgcgtgtgcggggcccgctacgagacgagcgaccggatgaagctgcaccgcgcctccggcctctgccccggctacaagagcctgcgggccgcgcgcgtcatgtgcaagtccaaggggccggccagcatcctgtccatcctcaccgccgtgctgatcctgaccttcgtgacccccatcagcgccatcatcatcgacgagtccaaggagatctacacgctcgacgacctgcccgacgacatggtccagatggccgagcggatcaacatctactaccagatcctgctcatcaactacggcgtgacctgggcgttcctgctgctcgggctgatcctggcctacttcttcaagaagtaccagcacaagttcctcgactactacgccatgtactgcgaggagtgcgacatgtaccacgagaagtccggcatgacctactggggcgacttcaccaacaagtgccgccagtgcacgtgcgggcagtacgaggacgccgccggcctgatggtccacaagaagtcctacaactgcctgatcaagtacaaggcgaagtggatcaagaacatcctcatcctgtacctgatcatgatcctcgtgaaggacagcctgctgttcgtgggggccaccggcaccgacttcgccgcctgcatcgacgagaagtccgtcacctggaactgcacggggcccttcctcaacctgggccggtgcgacaagccgcagaagaaggccagcttcaaggacatcgcgaaccagctgaagggcctcggggtgatctccgtgctggacatccccatgatcgagaagatgcccgacgacatcagcggctccctgaagtacatcgacagcctgcgcacctaccacgagcagctcaccgccgagtacgccttcctgacccggtactgcgactactacgcccagtacacggacaactccgggtacagccagaccgtctggcgcacctacctgcggtcccacgacttcggcgcgtgcgtggtgtaccccaaccagcacttctgccgctgcgtcaagtacggggacaagtgcaacagcgccaagtgggacttcgccaacgagatgaagtccttctacaccggccagaaggccaagttcaacaaggacctcaacctggccctgctcgtgctgcacaaggcgttccggggcaccgggacggcctacatcgccgagaccctggcccgcaaggacaacggcagcatggtgcacttcgccctcgagatccggaagaagttcccgaccaacgcgctgctggccgccctcatcgactacatcgtctacctgcagagcctggccgagatctccaccttcgagcccgaggaggactgggaggacagcaagtaccagcccgagcccacggagtccgtgctccagccgcgcgcccaccgcagcgaccagtacaacttcaagaacgcggactccaacagcaacgtgaaggtctgcaagaacatcaagaaggtgctgtgcatcagcccccggagccgcgccaagttcgagaacatcatcgcctgcggggagcacgccaacccctccgtgtacatgatgcccaacaccagcatctaccagtccaacagcgagcggtcccactactgcatcgcggacagccactgcctggaggagtacgagatcgtcaacaccgagctcctgaccgccttcaagaagtcccgctgctgggccaaggagatcgacgacatcgtgctgcacaagcagagcgacggcctccggagctgccgcatcaaggacacggggtcctgcaacgtgctgggcaacgactggaccatcgtcctgtgcgagaacggcaactactactacagcgaggtgcacaaggactacgacaaggaccaggacgtggggcacttctgcctctccccgcggtgcaacaccatccgctaccccatcagccggcgccacatcggcgagtgcaactggcagatcacccactccacgatcgacaagatcagcgtccaggagctggccgacatcgagcagtacaagaaggccatctcccagaagctgcagaccagcctctccatcttcaagtacgtgaagaccaagaacctgccccacatcaagcccgcgtaccggtacatcaccgtcgggggcacggagaccatcgagggcgtggagaacgccttcatcgagagcgagatcccggccctggccgggaccgccatcggcttcaagatcaactcccgcgaggggaactacctcatggacgtgatcggctacgtcaagagcgcgtcctacagcgccacctacacgaagctgtacaccaccgggcccaccatcggcatcaacacgaagcacgacgagaagtgcaccggctcctgccccgtgaccatcaaccacaaggacgggtggctgaccttcagcaaggagcggacgtccacctggggctgcgaggagttcgggtgcctcgccgtgagcgacggctgcgtgttcgggtcctgccaggacatcatcaaggacgagctggccgtctaccgcaagaccaccgaggagctgacgaccgtggagctctgcctgaccttcagcgacaagacctactgcacggacctgaacgccatcaccccgatcatcaccgacaagttcgaggtgcagttcaagaccgtcgagagctacaccctcccccggatcatcgcggtgaagaaccacgagatccgcacgggccagatcaacgacctgggcgtgtactccaaggggtgcggcaacgtccagaaggtgaacgggaccagctacggcaacggggtgcccaagttcgactacctgtgccacctcgcctcccggaaggaggtcatcctgcgcaagtgcttcgacaacgactaccaggcctgcaagttcctgcagagccccgcctcctaccggctcgaggagcaccagggcaccgtgaccgtgatcgactacaagaagatcctgggcagcatcaagatgaaggcgatgctgggggacgtcaagtacaagaactaccagtccaacatcgagatcaacgccgagggcacgtgcgccgggtgcatcgactgcttcgagaacatccactgcgagttcaccatccacaccaccgtggaggccagctgcccgatcacgaccgactgcgtgtccttccacgaccgcatcctcatcacccccgaggagcacaagtacgccctgaagatcgtctgccaggacaagcccaaggtgagcctgaagttcaagatctgcaacaccaacgtggaggcgtccatgacgatcatcgacagcaagcccatcctcgagctggccccggtcgaccagaccacctacatcaaggagaaggacgagcgctgcaagacctggatgtgccgggtgcgcgacgagggcttccaggtcatcctggagcccttcaagaacctcttcgggtcctacatcggcatcttctacacgggcgtgctgagcatcatctgcctgctcatcgtgatctacatcatcctgcccatctgctacaagctgcgggacaccctcaagcagcacgaggacgcctacaagaaggagatgaagatccgctga

SEQ ID NO: 12612 - RNA, 4335 nt, synthetic construct
  misc_feature 1..4335: note = derived and/or modified CDS sequence (opt1) from SORV(NJO-94F)__KX817337.1__GP
  source 1..4335: mol_type = other RNA
atggaggtgctgagcctcatctggctgctgaccctctgctccgccagccccgtcttccagcgctgcttccaggacggcgccatcgtgaagcagaacccgtccaaggaggcggtgaccgaggtctgcctgaaggacgacgtgagcatgatcaagacggagaccaagtacgtgaagaacaccaccgggacgttcgccaacaacatcgccatgcggaagtggctggtcgccgactggcacgactgccgcccccagaagtccagcggcgggcacatcaacgtgatcgaggtgggcgacgacctctccctgcacaccgagagctacatctgctccgccgactgcgtcatcaccgtggacaaggagaccgcgcagatccggctgcagacggacaacaccaaccacttcgaggtggccgggaccaccgtcaagagcggctggttcaagtccacgacctacatcaccctcgaccagacctgcgagcacctgaaggtgagctgcggccccaagtccatccagttccacgcctgcttcaaccagcacatgagctgcgtgcgcttcctgcaccggacgatcctccccgggtccatcgccaacagcatctgccagaacatcgagatcatcatcctggtcaccctgtccctcgtgatcttcatcttcctgaccatcgtgagcaagacctacatctgctacctgctcatgccgatcttcatccccatcgcgttcatctacggctggatctacaacaagtcctgcaagaagtgcaagctgtgcgggctggtctaccaccccttcacggagtgcggcacccactgcgtgtgcggggcccgctacgagaccagcgaccggatgaagctccaccgcgccagcggcctgtgccccggctacaagtccctgcgggccgcccgcgtgatgtgcaagagcaaggggccggcgtccatcctcagcatcctgaccgccatcctgatcctcacgttcgtcacccccatctccgccatggtggtgggcgagagcaacgagatctacaccctggacgacctgcccgacgacatggtccagatggccgagcggatcaacatctactaccagatcctcatcatcaactacggggtgacctgggccttcctgctgctcggcctggtcctggcgtacttcttcaagaagtaccagcacaagttcctcgactactacgccatgtactgcgaggagtgcgacatgtaccacgagaagtccggcatgacgtactggggcgacttcaccaacaagtgccgccagtgcacgtgcgggcagttcgaggacgccaccgggctgatggtgcacaagaagtcctacaactgcctggtgaagtacaaggccaagtggatccggaacatcctcatcgcctacctgatgatcatgctggtcaaggacagcctcctgttcgtgggcgcgacccgcgccgacttcgccagctgcgtggacgagaagaccgtcacctggaactgcaccgggcccttcctgaacctcggccggtgcgacaagacgcagaagaagaccggctacaaggacatcgccaaccagctgaaggggctgggcgtgatctccatcctcgacatcccgatgatcgagaagatgcccgacgagatcagcgggtccctgaagtacatcgacagcctggagacctaccacgagcagctgaccgccgagtacgcgttcctcacccgctactgcgactactacacgcagtacaccgacaactccggctacagccagaccgtgtggcggacctacctgcgctcccacgacttcggggcctgcgtcgtgtaccccaaccagcacttctgccggtgcgtgaagtacggcgacaagtgcaacagcgccaagtgggacttcgccaacgagatgaagacgttctacaccggccgcaaggtcaagttcaacaaggacctgaacctcgcgctgctggtgctccacaaggccttccgggggaccggcaccgcctacatcgccgaggccatggcgcgcaaggacaacgggtccatggcccacttcgccctggagatccgcaagaagttccccacgaacgccctgctcgccgcgctgatcgactacatcgtgtacctgcagagcctcgccgagatcagcaccttcgagctggaggaggactgggaggacttcaagtacaagccggagcccaccgagtccaccctgcagccccggagccaccgctccgaccagtacaacttcaagaacgccgacagcaactccaacgtcaaggtgtgcaagaacgtgaagaaggtcctctgcgtgagcccccggtcccgcgccaagttcgagaacatcatcgcctgcggcgagcacgcgaacccgagcgtgtacatgatgcccaacatctccatctaccagagcaactccgagcggagccactactgcatcgccgactcccactgcctggaggagtacgagatcgtcaacacggagctgctcaccgccctgaagaagtcccgctgctgggccaaggagatggacgacgtggtgctgcacaagcagagcgacgggctccggagctgccgcatcaaggacaccggctcctgcaacgtcctgggcaacgactggaccatcgtgctgtgcgagaacgggaactactactacagcgagatccacaaggactacgacaaggaccaggacgtgggccacttctgcctcagcccccggtgctccacgatccgctaccccatcaaccggcgccacatccggaagtgcgactggcagatcagccactccaccatcgacaagatcagcgtccaggagctggcggacatcgagcagtacaagaaggccatctcccagaagctgcagaccagcctctccatcttcaagtacgtgaagaccaagaacctgccgcacatcaagcccgcctacaagtacatcacggtggaggggaccgagaccatcgagggcatcgagaacgccttcatcgagagcgagatccccgccctggcgggcaccgccatcgggttcaagatcaactcccgcgagggcaactacctcatggacgtcatcgggtacgtcaagagcgcctcctacagcgccacgtacaccaagctgtacaccaccggccccacgatcgggatcaacacccggcacgacgagaagtgcaccggcccgtgccccgtgaccatcgaccacaaggacggctggctgacgttctccaaggagcgcaccagcacctgggggtgcgaggagttcggctgcctcgccgtgtccgacgggtgcgtgttcggcagctgccaggacatcatcaaggacgagctggcggtgtaccggaagaccacggaggagctgaccaccgtcgagctctgcctgaccttctccgacaagacctactgcacgaacctgaacgccatcacccccatcatcaccgacaagttcgaggtgcagttcaagaccgtggagagctacacgctcccgcgcatcatcgccgtcaagaaccacgagatcaaggtggggcagatcaacgacctgggcgtgtactccaagggctgcgggaacgtccagaaggtgaacggcaccaactacgggaacggcgtgcccaagttcgactacctgtgccacctcgccagccggaaggaggtcatcctgcgcaagtgcttcgacaacgactaccaggcctgcaagttcctgcagagccccgcgtcctaccgcctcgaggagcaccaggggaccgtgaccgtgatcgactacaagaagatcctgggcagcatcaagatgaaggccatcctgggcgacgtcaagtacaagaactaccagtccaacatcgagatcaacgccgaggggacgtgcgccggctgcgtgaactgcttcgagaacatccactgcgagttcaccatccacaccaccgtggagacgagctgccccatcgtcaccgactgcgtgtccttccacgaccggatcctcatcaccccggacgagcacaagtacgcgctgaagatcgtctgccaggacaagcccaaggtgagcctgaagttcaagatctgcaacaccaacatcgacgcctccatgacgatcgtggacagcaagcccatcctcgagctggcccccgtcgaccagaccgcctacatcaaggagaaggacgagcgctgcaagacctggatgtgccgggtgcgcgacgaggggttccaggtgatcctggagccgttcaagaacctcttcggctcctacatcgggatcttctacaccggcatcctgagcgtcatctgcctgctcatcgtgatctacatcgtgctgcccatctgcttcaagctgcgggacacgctcaagcagcacgaggacgcctacaagaaggagatgaagatccgctga

SEQ ID NO: 12613 - RNA, 4323 nt, synthetic construct
  misc_feature 1..4323: note = derived and/or modified CDS sequence (opt1) from TAHV__AF123485.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccggcctgctgacccaccgcaagacctacaactgcctcgtgcagtacaagtccaagtggctgacgaacttcctgatcgtgtacatcatcctcatgctgatcaaggacagcgtcctgatcgtgcacgcggacgggaccgacttcgagaagtgctccggcgaggtggacatcacctggaactgcaccgggcccttcctcaacctgggcaactgcgagaagaagcagaagaaggagagctacaacaacatcgccacgcagctgaagggcctcgacgccatctccgtcctggacatcccgatgatcagcaagatccccgaggacatcgccggggcgctgcggttcatcgaggagcagcgctcctaccacgtgcagctgaccgccgagtacgccatgctcacccggtactgcgactactacacccagttcaccgacaacagcggctactcccagacgacctggcgcgtgtacctgcggagccacgacttcaaggcctgcatcctgtaccccaaccagcacttctgccgctgcgtcaagcacggggacaagtgctccagctccaactgggacttcgccaacgagatgaagaactactacagcggcaagcagtccaagttcgacaaggacctcaacctggcgctgatgagcctccaccacgccttccgcgggaccagctccttctacatcgccaagctgctgaaggagaagaagaacgaggacctcgtgacctacgccgagaagatcaagggcaagtaccccggcaacgccctgctgaaggcgatcatcgactacatcaagtacatggaggacctcacggagatgaacaacttcaagcacgacgagatgtgggacgacttcatcttcgaggtgccgcccaccaagagcccctccatccggcgcctggagagctcctacgacttcaagaccaacgtcaacagcaacccctcccacatctgcaagaacatcaagaccgtggtgtgcctgagcccgaagtccggggtcagctacgactccatcatcgcctgcggcgagcccagccagccctccatctaccggaagcccgacagccaggtgttccagtccaacgccgaccagacgcacttctgcctcagcgacacccactgcctggagaactacgagaccgtgggggaggagatcatcgacgccatcaagaagtccaagtgctgggagaccgagttcacggagtacatccagttcaagcagagcgacggcgtccgcagctgccggatgaaggactccggggagtgcaccgtgaccaccaaccgctggccgatcatcctgtgcgacaacgacaagttctactacagcgagctccagaaggactacgacaaggaccaggacatcggccacttctgcctgagcccccggtgcaacacgatccgccaccccatcaaccggaagcacatcagcaactgcacctggcaggtctcccacaacaacatcgacaagatcgaggtgcacgagctggaggacctcgagcagtacaagaaggccatcacccagaagctgcagaccagcctgaccctcttcaagtactccaagaccaagaacctgccccacatcaagccgatgtacaagtacatcaccatcgagggcaccgagacggcggaggggctggagagcgcctacatcgagtccgagatccccgccctcgccggcaccagcatcgggttcaagatcacctccaagagcggcaagcacctcctggacgtgatcggctacgtgaagtccgcgagctactccgccgtctacaccaagctgtacacgaccgggcccaccatcggcgtgaacaccaagcacgacgagctgtgcacggggccgtgccccgtgaacgtcccccacggcaccgggtggctgaccttcgccaaggagcgcaccagctcctggggctgcgaggagttcggctgcctcgccatcagcgacgggtgcgtgttcggctcctgccaggacatcatcaaggacgagatcacggtgtaccggaaggagaccgaggagaccaccgacgtcgagctgtgcctgaccttcgccgacaagacgtactgcaccaacctcaacgcgatcacccccatcatcaccgaccagttcgaggtgcagttcaagacggtggaggcctacagcctgccgcgcatcatcgccgtccggaaccacgagatcatggtggggcagatcaacgacatcggcgtgtacagcaaggggtgcggcaacgtccagaaggtgaacaacaccaactacggcaacggggtgcccaagttcgactacctgtgccacctcgcctcccgcaaggaggtcatcgtgcggaagtgcttcgacaacgactaccaggcctgcaagttcctgcagacccccgcgagctaccgcctggaggaggagggcgggtccgtgaccgtcatcgactacaagaagatcctcggcacgatcaagatgaaggccatcctgggggacgtgaagtacaagaccttcgccgacaacgtggacctgaccgtcgagggcgtgtgcaccggctgcatcaactgcttcgagaacatccactgcgagctcacgatccacagcaccgtggaggcctcctgccccgtcgtgagctcctgcaccgtgttccacgaccggatcctgatcaccccgaacgagcacaagtacgccatcaaggtcatctgcaacgagaagcccgggcccacgctgcccttcaagatctgcagcgcgaagaccgacgccgccatgaccctcgccgacgcgaagccgatcctggagctggcccccgtggaccagaccacgtacatcaaggagaaggacgagcgctgcaagacctggatgtgccgggtccgcgacgagggcttccaggtgatcttcgagcccttcaagaacctcttcgggtcctacatcggcatcttctacaccttcatcatcagcctgatggccatcttcatcgtgatctacatcgtcctgcccatctgcttcaagctccgcgacaccctgcggcagcacgaggacgcctacaagcgcgagatgaagatccggtga

SEQ ID NO: 12614 - RNA, 4323 nt, synthetic construct
  misc_feature 1..4323: note = derived and/or modified CDS sequence (opt1) from TAHV__AF229129.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtcaagagcggctggttcaagtccaccacgtacatcaccctcgaccagacctgcgagcacctgaaggtgagctgcgggcccaagtccatccagttccacgcctgcttcaaccagcacatgagctgcgtgcgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacggcgacgccgccgggctgctgacccaccgcaagacctacaactgcctcgtgcagtacaagtccaagtggctgaccaacttcctgatcggctacatcatcctcatgctgatcaaggacagcgtgctgctcgtccacgcggacgggaccgacttcgagaagtgctccggcgaggccgacatcacctggaactgcaccggccccttcctgagcctggggaactgcgagaagaagcagaagaaggagtcctacaacaacatcgccacgcagctcaagggcctggacgccatcagcgtgctggacatcccgatgatctccaagatccccgaggacatcgcgggggccctgcggttcatcgaggagcagcgcagctaccacgtgcagctcaccgccgagtacgccatgctgacccggtactgcgactactacacccagttcaccgacaactccggctacagccagacgacctggcgcgtctacctgcggtcccacgacttcgaggcctgcatcctctaccccaaccgccacttctgccgctgcgtgaagcacggggacaagtgcagctccagcaactgggacttcgcgaacgagatgaagaactactactccggcaagcagagcaagttcaacaaggacctgaacctggccctcatgagcctgcaccacgccttccggggcacctccagcttctacatcgccaagctgctcaaggagaagaagaacgaggacctggtgacctacgccgagaagatcaaggggaagtaccccggcaacgcgctgctcaaggccatcatcgactacatcaagtacatgaaggggctgacggagatgaacaacttcaagcacgacgagatgtgggacgacttcatcttcgaggtcccgcccaccaagtcccccagcgtgcgccggctggagtccagctacgacttcaagaccaacgtgaactccaaccccagccacatctgcaagaacatcaagaccgtcgtgtgcctctcccccaagagcggcgtgtcctacgacagcatcatcgcctgcggggagccgtcccagcccagcatctaccgcaagcccgactcccaggtcttccagagcaacgccgaccagacgcacttctgcctgtccgacacccactgcctggagaactacgagaccgtgggcgaggagatcatcgacgccatcaagaagtccaagtgctgggagaccgagttcacggagtacacccagctcaagcagagcgacggcgtgcggagctgccgcatgaaggacagcggggagtgcaccgtcaccacgaaccggtggccgatcatcctgtgcgacaacgacaagttctactactccgagctgcagaaggactacgacaaggaccaggacatcggccacttctgcctcagcccccgctgcaacaccatccggcaccccatcaaccgcaagcacatctccaactgcacctggcaggtcaaccacaacaacatcgacaagatcgaggtgcacgagctggaggacctggagcagtacaagaaggcgatcacccagaagctccagacgagcctgaccctgttcaagtactccaagaccaagaacctcccccacatcaagccgatgtacaagtacatcaccatcgaggggacggagaccgccgagggcatcgagagcgcctacatcgagtccgagatccccgccctggcgggcaccagcatcgggttcaagatcacctccaagagcggcaagcacctcctggacgtgatcgggtacgtgaagtccgccagctactccgccgtgtacacgaagctgtacaccaccggccccaccatcggggtcaacacgaagcacgacgagctgtgcaccggcccgtgccccgtgaacgtgccccacggcaccgggtggctcaccttcgccaaggagcggacgagctcctggggctgcgaggagttcgggtgcctggccatcagcgacggctgcgtcttcgggtcctgccaggacatcatcaaggacgagatcaccgtgtaccgcaaggagaccgaggagaccaccgacgtggagctgtgcctcacgttcgcggacaagacctactgcaccaacctgaacgccatcacccccatcatcacggaccagttcgaggtccagttcaagaccgtggaggcctacagcctgccgcggatcatcgccgtgcgcaaccacgagatcatggtcggccagatcaacgacatcggcgtgtacagcaaggggtgcggcaacgtgcagaaggtcaacaacaccaactacgggaacggcgcccccaagttcgactacctctgccacctggcgtcccggaaggaggtgatcgtgcgcaagtgcttcgacaacgactaccaggcctgcaagttcctgcagacccccgccagctaccggctcgaggaggagggcgggtccgtcacggtgatcgactacaagaagatcctgggcaccatcaagatgaaggccatcctgggggacgtgaagtacaagaccttcgccgacaacgtcgacctcaccgtggagggcgtgtgcacggggtgcgtcaactgcttcgagaacatccactgcgagagcaccatccactccaccgtggaggcgagctgccccgtgatctccagctgcaccgtcttccacgaccgcatcctgatcacgccgaacgagcacaagtacgccatcaaggtgatctgcaacgagaagcccggccccaccctgcccttcaagatctgctccgccaagaccgacgccgcgatgaccctcgccgacgccaagccgatcctggagctggcccccgtggaccagacgacctacatcaaggagaaggtcgagcggtgcaagacctggatgtgccgcgtgcgcgacgaggggttccaggtcatcttcgagcccttcaagaacctcttcggcagctacatcggcatcttctacaccttcatcatctccctgatggccatcttcatcgtgatctacatcgtgctgcccatctgcttcaagctccgggacacgctgcgccagcacgaggacgcgtacaagcgggagatgaagatccgctga

SEQ ID NO: 12615 - RNA, 4323 nt, synthetic construct
  misc_feature 1..4323: note = derived and/or modified CDS sequence (opt1) from TAHV(22595-6)__HM036218.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccggcctgctgacccaccgcaagacctacaactgcctcgtgcagtacaagtccaagtggctgaccaacttcctgatcgtgtacatcatcctcatgctgatcaaggacagcgtcctgatcgtgcacgcggacgggaccgacttcgagaagtgctccggcgaggccgacatcacctggaactgcaccgggcccttcctcaacctgggcaactgcgagaagaagcagaagaaggagagctacaacaacatcgccacgcagctgaagggcctcgacgccatctccgtgctggacatcccgatgatcagcaagatccccgaggacatcgcgggggccctgcggttcatcgaggagcagcgctcctaccacgtccagctgaccgccgagtacgccatgctcacccggtactgcgactactacacccagttcaccgacaacagcggctactcccagacgaccctgcgcgtgtacctgcggagccacgacttcaaggcctgcatcctctaccccaaccagcacttctgccgctgcgtgaagcacggggacaagtgctccagctccaactgggacttcgcgaacgagatgaagaactactacagcggcaagcagtccaagttcgacaaggacctgaacctggccctcatgagcctgcaccacgccttccgcgggaccagctccttctacatcgccaagctgctcaaggagaagaagaacgaggacctggtcacctacgccgagaagatcaagggcaagtaccccggcaacgcgctgctcaaggccatcatcgactacatcaagtacatggaggacctgacggagatgaacaacttcaagcacgacgagatgtgggacgacttcatcttcgaggtgccgcccaccaagagcccctccatccggcgcctggagagctcctacgacttcaagaccaacgtgaacagcaacccctcccacatctgcaagaacatcaagaccgtcgtgtgcctcagcccgaagtccggggtgagctacgactccatcatcgcctgcggcgagcccagccagccctccatctaccggaagcccgacagccaggtcttccagtccaacgccgaccagacgcacttctgcctgagcgacacccactgcctggagaactacgagaccgtgggggaggagatcatcgacgccatcaagaagtccgagtgctgggagaccgagttcacggagtacatccagttcaagcagagcgacggcgtgcgcagctgccggatgaaggactccggggagtgcaccgtcaccaccaaccgctggccgatcatcctctgcgacaacgacaagttctactacagcgagctgcagaaggactacgacaaggaccaggacatcggccacttctgcctgagcccccggtgcaacacgatccgccaccccatcaaccggaagcacatcagcaactgcacctggcaggtctcccacaacaacatcgacaagatcgaggtgcacgagctcgaggacctggagcagtacaagaaggcgatcacccagaagctgcagaccagcctcacgctgttcaagtactccaagaccaagaacctgccccacatcaagccgatgtacaagtacatcaccatcgagggcaccgagacggccgaggggatcgagagcgcctacatcgagtccgagatccccgccctcgcgggcaccagcatcgggttcaagatcacctccaagagcggcaagcacctcctggacgtgatcggctacgtgaagtccgccagctactccgccgtgtacaccaagctgtacacgaccgggcccaccatcggcgtcaacaccaagcacgacgagctgtgcacggggccgtgccccgtgaacgtgccccacggcaccgggtggctgaccttcgccaaggagcgcaccagctcctggggctgcgaggagttcggctgcctcgccatcagcgacgggtgcgtcttcggctcctgccaggacatcatcaaggacgagatcacggtgtaccggaaggagaccgaggagaccaccgacgtggagctgtgcctgaccttcgcggacaagacgtactgcaccaacctcaacgccatcacccccatcatcaccgaccagttcgaggtccagttcaagacggtggaggcctacagcctgccgcgcatcatcgccgtgcggaaccacgagatcatggtcgggcagatcaacgacatcggcgtgtacagcaaggggtgcggcaacgtgcagaaggtcaacaacaccaactacggcaacggggtgcccaagttcgactacctgtgccacctcgcctcccgcaaggaggtgatcgtccggaagtgcttcgacaacgactaccaggcgtgcaagttcctgcagacccccgccagctaccgcctggaggaggagggcgggtccgtgaccgtgatcgactacaagaagatcctcggcacgatcaagatgaaggccatcctgggggacgtcaagtacaagaccttcgccgacaacgtggacctgaccgtggagggcgtctgcaccggctgcatcaactgcttcgagaacatccactgcgagctcacgatccacagcaccgtggaggcctcctgccccgtggtcagctcctgcaccgtgttccacgaccggatcctgatcaccccgaacgagcacaagtacgcgatcaaggtgatctgcaacgagaagcccgggcccacgctgcccttcaagatctgcagcgccaagaccgacgccgccatgaccctcgcggacgccaagccgatcctggagctggcccccgtcgaccagaccacgtacatcaaggagaaggacgagcgctgcaagacctggatgtgccgggtgcgcgacgagggcttccaggtcatcttcgagcccttcaagaacctcttcgggtcctacatcggcatcttctacaccttcatcatcagcctgatggccatcttcatcgtgatctacatcgtgctgcccatctgcttcaagctccgcgacaccctgcggcagcacgaggacgcctacaagcgcgagatgaagatccggtga

SEQ ID NO: 12616 - RNA, 4323 nt, synthetic construct
  misc_feature 1..4323: note = derived and/or modified CDS sequence (opt1) from TAHV(92' Bardos)__HM036209.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtcaagagcggctggttcaagtccaccacgtacatcaccctcgaccagacctgcgagcacctgaaggtgagctgcgggcccaagtccatccagttccacgcctgcttcaaccagcacatgagctgcgtgcgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacaacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacgaggacttcacgaacaagtgccggcagtgcacgtgcggccagtacgaggacgccgccgggctgctgacccaccgcaagacctacaactgcctcgtgcagtacaagtccaagtggctgacgaacttcctgatcgtgtacatcatcctcatgctgatcaaggacagcgtcctgatcgtgcacgcggacggcaccgacttcgagaagtgctccggggaggccgacatcacctggaactgcaccggccccttcctcaacctggggaactgcgagaagaagcagaagaaggagagctacaacaacatcgccacgcagctgaagggcctcgacgccatctccgtgctggacatcagcatgatctccaagatcccggaggacatcgcgggcgccctgcggttcatcgaggagcagcgcagctaccacgtccagctgaccgccgagtacgccatgctcacccggtactgcgactactacacccagttcaccgacaactccgggtacagccagacgacctggcgcgtgtacctgcggtcccacgacttcgaggcctgcatcctgtaccccaaccagcacttctgccgctgcgtgaagcacggcgacaagtgcagctccagcaactgggacttcgcgaacgagatgaagaacttctactccgggaagcagagcaagttcgacaaggacctcaacctggccctgatgagcctccaccacgccttccgcggcacctccagcttctacatcgccaagctgctgaaggagaagaagaacgaggacctcgtcacctacgccgagaagatcaaggggaagtaccccggcaacgcgctgctgaaggccatcatcgactacatcaagtacatggaggacctcacggagatgaacaacttcaagtacgacgagatgtgggacgacttcatcttcgaggtgcccccgaccaagtcccccagcatccggcgcctggagtccagctacgacttcaagaccaacgtgaactccaaccccagccacatctgcaagaacatcaagaccgtcgtgtgcctgtcccccaagagcggcgtgtcctacgacagcatcatcgcctgcggggagccgtcccagcccagcatctaccggaagcccgactcccaggtcttccagagcaacgccgaccagacgcacttctgcctctccgacacccactgcctggagaactacgagaccgtgggcgaggagatcatcgacgccatcaagaagtccaagtgctgggagaccgagttcacggagtacatccagttcaagcagagcgacggggtgcgcagctgccggatgaaggacagcggcgagtgcaccgtcaccaccaaccgctggcccatcatcctgtgcgacaacgacaagttctactactccgagctccagaaggactacgacaaggaccaggacatcgggcacttctgcctgagcccgcggtgcaacacgatccgccaccccatcaaccggaagcacatctccaactgcacctggcaggtcagccacaacaacatcgacaagatcgaggtgcacgagctggaggacctcgagcagtacaagaaggcgatcacccagaagctgcagacctccctgaccctcttcaagtacagcaagaccaagaacctgccccacatcaagcccatgtacaagtacatcaccatcgagggcaccgagacggccgagggcatcgagtccgcctacatcgagagcgagatcccggccctggcggggacctccatcggcttcaagatcaccagcaagtccgggaagcacctcctggacgtgatcggctacgtcaagagcgcctcctacagcgccgtgtacaccaagctgtacacgaccggccccaccatcggggtgaacaccaagcacgacgagctctgcacgggcccctgcccggtgaacgtgccccacgggaccggctggctgaccttcgccaaggagcgcacctccagctgggggtgcgaggagttcggctgcctggccatctccgacggctgcgtcttcgggagctgccaggacatcatcaaggacgagatcacggtgtaccggaaggagaccgaggagaccaccgacgtggagctctgcctgaccttcgcggacaagacgtactgcaccaacctgaacgccatcacccccatcatcaccgaccagttcgaggtccagttcaagacggtggaggcctacagcctcccccgcatcatcgccgtgcggaaccacgagatcatggtcggccagatcaacgacatcggggtgtactccaagggctgcgggaacgtgcagaaggtcaacaacaccaactacggcaacggcgtgccgaagttcgactacctgtgccacctggccagccgcaaggaggtgatcgtccggaagtgcttcgacaacgactaccaggcgtgcaagttcctccagacccccgcctcctaccgcctggaggaggagggcgggagcgtgaccgtgatcgactacaagaagatcctggggacgatcaagatgaaggccatcctcggcgacgtcaagtacaagaccttcgccgacaacgtggacctgaccgtggagggggtctgcaccggctgcatcaactgcttcgagaacatccactgcgagctgacgatccactccaccgtggaggccagctgccccgtggtctccagctgcaccgtgttccacgaccggatcctcatcacccccaacgagcacaagtacgcgatcaaggtgatctgcaacgagaagccgggccccacgctgcccttcaagatctgctccgccaagaccgacgccgccatgaccctggcggacgccaagcccatcctcgagctggccccggtcgaccagaccacgtacatcaaggagaaggacgagcgctgcaagacctggatgtgccgggtgcgcgacgaggggttccaggtcatcttcgagcccttcaagaacctgttcggcagctacatcgggatcttctacaccttcatcatctccctcatggccatcttcatcgtgatctacatcgtgctgcccatctgcttcaagctgcgcgacaccctccggcagcacgaggacgcctacaagcgcgagatgaagatccggtga

SEQ ID NO: 12617 - RNA, 4323 nt, synthetic construct
  misc_feature 1..4323: note = derived and/or modified CDS sequence (opt1) from TAHV(92' Bardos)__HM036212.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtcaagagcggctggttcaagtccaccacgtacatcaccctcgaccagacctgcgagcacctgaaggtgagctgcgggcccaagtccatccagttccacgcctgcttcaaccagcacatgagctgcgtgcgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccatcaagctcgaggacctgcccgacgacatgctgagcaccgccatgaaggtgaacatgtactacatcatgtgcatgatcaactacgccgtcacgtggtccttcatcctctgcgcgctgctgatcgccctcctgttcaagaagtaccagcaccggttcctgaacttctacgccatgtactgccacgagtgcgacatgtaccacgaccgcagcggcctcaagtacaacgaggacttcaccaacaagtgccggcagtgcacgtgcggccagtacgaggacgccgccgggctgctgacccaccgcaagacctacaactgcctcgtgcagtacaagtccaagtggctgaccaacttcctgatcgtgtacatcatcctcatgctgatcaaggacagcgtcctgatcgtgcacgcggacggcaccgacttcgagaagtgctccggggaggccgacatcacctggaactgcacgggccccttcctcaacctggggaactgcgagaagaagcagaagaaggagagctacaacaacatcgccacccagctgaagggcctcgacgccatctccgtgctggacatcagcatgatctccaagatcccggaggacatcgcgggcgccctgcggttcatcgaggagcagcgcagctaccacgtccagctgaccgccgagtacgccatgctcacccggtactgcgactactacacccagttcacggacaactccgggtacagccagaccacctggcgcgtgtacctgcggtcccacgacttcaaggcctgcatcctgtaccccaaccagcacttctgccgctgcgtgaagcacggcgacaagtgcagctccagcaactgggactccgcgaacgagatgaagaacttctacagcgggaaccagagcaagttcgacaaggacctcaacctggccctgatgtccctccaccacgccttccgcggcaccagctccttctacatcgccaagctgctgaaggagaagaagaacgaggacctcgtcacgtacgccgagaagatcaaggggaagtaccccggcaacgcgctgctgaaggccatcatcgactacatcaagtacatggaggacctcaccgagatgaacaacttcaagtacgacgagatgtgggacgacttcatcttcgaggtgcccccgaccaagagcccctccatccggcgcctggagagctcctacgacttcaagaccaacgtgaacagcaacccctcccacatctgcaagaacatcaagacggtcgtgtgcctgagccccaagtccggcgtgagctacgactccatcatcgcctgcggggagccgagccagccctccatctaccggaagcccgacagccaggtcttccagtccaacgccgaccagacccacttctgcctcagcgacacccactgcctggagaactacgagaccgtgggcgaggagatcatcgacgccatcaagaagtccaagtgctgggagacggagttcaccgagtacatccagttcaagcagagcgacggggtgcgcagctgccggatgaaggactccggcgagtgcaccgtcaccacgaaccgctggcccatcatcctgtgcgacaacgacaagttctactacagcgagctccagaaggactacgacaaggaccaggacatcgggcacttctgcctgtccccgcggtgcaacaccatccgccaccccatcaaccggaagcacatcagcaactgcacctggcaggtctcccacaacaacatcgacaagatcgaggtgcacgagctggaggacctcgagcagtacaagaaggcgatcacccagaagctgcagacgagcctgaccctcttcaagtactccaagaccaagaacctgccccacatcaagcccatgtacaagtacatcaccatcgagggcacggagaccgccgagggcatcgagagcgcctacatcgagtccgagatcccggccctggcggggaccagcatcggcttcaagatcacctccaagagcgggaagcacctcctggacgtgatcggctacgtgaagtccgccagctactccgccgtgtacacgaagctgtacaccaccggccccaccatcggggtcaacacgaagcacgacgagctctgcaccggcccctgcccggtgaacgtgccccacgggaccggctggctgaccttcgccaaggagcgcacgagctcctgggggtgcgaggagttcggctgcctggccatcagcgacggctgcgtcttcgggagctgccaggacatcatcaaggacgagatcaccgtgtaccggaaggagaccgaggagaccaccgacgtggagctctgcctgacgttcgcggacaagacctactgcaccaacctgaacgccatcacccccatcatcacggaccagttcgaggtccagttcaagaccgtggaggcctactccctcccccgcatcatcgccgtgcggaaccacgagatcatggtcggccagatcaacgacatcggggtgtacagcaagggctgcgggaacgtgcagaaggtcaacaacaccaactacggcaacggcgtgccgaagttcgactacctgtgccacctggcctcccgcaaggaggtgatcgtccggaagtgcttcgacaacgactaccaggcgtgcaagttcctccagacccccgccagctaccgcctggaggaggagggcgggtccgtgacggtgatcgactacaagaagatcctggggaccatcaagatgaaggccatcctcggcgacgtcaagtacaagaccttcgccgacaacgtggacctgaccgtggagggggtctgcacgggctgcatcaactgcttcgagaacatccactgcgagctgaccatccacagcaccgtggaggcctcctgccccgtggtcagctcctgcaccgtgttccacgaccggatcctcatcacgcccaacgagcacaagtacgcgatcaaggtgatctgcaacgagaagccgggccccaccctgcccttcaagatctgcagcgccaagaccgacgccgccatgaccctggcggacgccaagcccatcctcgagctggccccggtcgaccagacgacctacatcaaggagaaggacgagcgctgcaagacctggatgtgccgggtgcgcgacgaggggttccaggtcatcttcgagcccttcaagaacctgttcggctcctacatcgggatcttctacaccttcatcatcagcctcatggccatcttcatcgtgatctacatcgtgctgcccatctgcttcaagctgcgcgacacgctccggcagcacgaggacgcctacaagcgcgagatgaagatccggtga

SEQ ID NO: 12618 - RNA, 4323 nt, synthetic construct
  misc_feature 1..4323: note = derived and/or modified CDS sequence (opt1) from TAHV(Souche D C14019-29)__HM036215.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttcaagaacgccacggggacctacgcgaacaacgtggccatccgcaagtggctggtcagcgactggcacgactgccggcccaagaaggtgtccggcgggcacatcaacgtgatcgaggtcggcgacgacctcaccctgcacaccgaggcctacgtgtgcaacgccgactgcacgatcggggtggacaaggagaccgcgcaggtccgcctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccggttcctgcaccgcaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcggtacgagacctccgaccgcatgaagctccaccgggccagcggcctgtgccccgggtacaagtccctgcgcgccgcccgggtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccgcttcctgaacttctacgccatgtactgccacgagtgcgacatgtaccacgaccggagcggcctcaagtacaacggcgacttcacgaacaagtgccgccagtgcacgtgcgggcagtacgaggacgccgccggcctgctgacccaccggaagacctacaactgcctcgtgcagtacaagtccaagtggctgaccaacttcctgatcgtgtacatcatcctcatgctgatcgaggacagcgtcctgatcgtgcacgcggacgggaccgacttcgagaagtgctccggcgaggccgacatcacctggaactgcaccgggcccttcctcaacctgggcaactgcgagaagaagcagaagaaggagagctacaacaacatcgccacgcagctgaagggcctcgacgccatctccgtgctggacatcccgatgatcagcaagatccccgaggacatcgcgggggccctgcgcttcatcgaggagcagcggtcctaccacgtccagctgaccgccgagtacgccatgctcacccgctactgcgactactacacccagttcaccgacaacagcggctactcccagacgacctggcgggtgtacctgcgcagccacgacttcgaggcctgcatcctgtaccccaaccggcacttctgccgctgcgtgaagcacggggacaagtgctccagctccaactgggacttcgcgaacgagatgaagaactactacagcggcaagcagtccaagttcaacaaggacctcaacctggccctgatgagcctccaccacgccttccgcgggaccagctccttctacatcgccaagctgctgaaggagaagaagaacgaggacctcgtcacctacgccgagaagatcaagggcaagtaccccggcaacgcgctgctgaaggccatcatcgactacatcaagtacatgaaggacctcacggagatgaacaacttcaagcacgacgagatgtgggaggacttcatcttcgaggtgccgcccaccaagagcccctccgtgcggcgcctggagagctcctacgacttcaagaccaacgtcaacagcaacccctcccacatctgcaagaacatcaagaccgtggtgtgcctgagcccgaagtccggggtcagctacgactccatcatcgcctgcggcgagcccagccagccctccatctaccggaagcccgacagccaggtgttccagtccaacgccgaccagacgcacttctgcctcagcgacacccactgcctggagaactacgagaccgtgggggaggagatcatcgacgccatcaagaagtccaagtgctgggagaccgagttcacggagtacatccagttcaagcagagcgacggcgtccgcagctgccggatgaaggactccggggagtgcaccgtggcgaccaaccgctggccgatcatcctgtgcgacaacaacaagttctactacagcgagctccaggaggactacgacaaggaccaggacatcggccacttctgcctgagcccccggtgcaacaccatccgccaccccatcaaccggaagcacatcagcaactgcacgtggcaggtctcccacaacaacatcgacaagatcgaggtgcacgagctggaggacctcgagcagtacaagaaggccatcacccagaagctgcagaccagcctgaccctcttcaagtactccaagacgaagaacctgccccacatcaagccgatgtacaagtacatcaccatcgagggcaccgagaccgccgaggggatcgagagcgcctacatcgagtccgagatccccgcgctggccggcacgagcatcgggttcaagatcacctccaagagcggcaagcacctcctggacgtgatcggctacgtgaagtccgccagctactccgccgtctacaccaagctgtacaccacggggcccaccatcggcgtgaacaccaagcacgacgagctctgcaccgggccgtgccccgtgaacgtcccccacggcacggggtggctgaccttcgccaaggagcgcaccagctcctggggctgcgaggagttcggctgcctggcgatcagcgacgggtgcgtgttcggctcctgccaggacatcatcaaggacgagatcaccgtgtaccggaaggagacggaggagaccaccgacgtcgagctctgcctgaccttcgccgacaagacctactgcacgaacctgaacgccatcacccccatcatcaccgaccagttcgaggtgcagttcaagaccgtggaggcctacagcctcccgcgcatcatcgccgtccggaaccacgagatcatggtggggcagatcaacgacatcggcgtgtacagcaaggggtgcggcaacgtccagaaggtgaacaacacgaactacggcaacggggtgcccaagttcgactacctgtgccacctggcgtcccgcaaggaggtcatcgtgcggaagtgcttcgacaacgactaccaggcctgcaagttcctccagacccccgccagctaccgcctggaggaggagggcgggtccgtgaccgtcatcgactacaagaagatcctgggcaccatcaagatgaaggccatcctcggggacgtgaagtacaagacgttcgccgacaacgtggacctgaccgtcgagggcgtgtgcaccggctgcatcaactgcttcgagaacatccactgcgagctgaccatccacagcacggtggaggcgtcctgccccgtcgtgagctcctgcaccgtgttccacgaccggatcctcatcaccccgaacgagcacaagtacgccatcaaggtcatctgcaacgagaagcccgggcccatcctgcccttcaagatctgcagcgccaagaccgacgccgcgatgacgctggccgacgccaagccgatcctcgagctggcccccgtggaccagaccacctacatcaaggagaaggacgagcgctgcaagacctggatgtgccgggtccgcgacgagggcttccaggtgatcttcgagcccttcaagaacctgttcgggtcctacatcggcatcttctacacgttcatcatcagcctcatggccatcttcatcgtgatctacatcgtcctgcccatctgcttcaagatccgcgacaccctgcggcagcacgaggacgcgtacaagcgcgagatgaagatccggtga

SEQ ID NO: 12619 - RNA, 4323 nt, synthetic construct
  misc_feature 1..4323: note = derived and/or modified CDS sequence (opt1) from TAHV(1014)__GQ386833.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtcaagagcggctggttcaagtccaccacgtacatcaccctcgaccagacctgcgagcacctgaaggtgagctgcgggcccaagtccatccagttccacgcctgcttcaaccagcacatgagctgcgtgcgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggaagtacgaggacgccgccggcctgctgacccaccgcaagacctacaactgcctcgtgcagtacaagtccaagtggctgacgaacttcctgatcgtgtacatcatcctcatgctgatcaaggacagcgtcctgatcgtgcacgcggacgggaccgacttcgagaagtgctccggcgaggccgacatcacctggaactgcaccgggcccttcctcaacctgggcaactgcgagaagaagcagaagaaggagagctacaacaacatcgccacgcagctgaagggcctcgacgccatctccgtgctggacatcccgatgatcagcaagatccccgaggacatcgcgggggccctgcggttcatcgaggagcagcgctcctaccacgtccagctgaccgccgagtacgccatgctcacccggtactgcgactactacacccagttcaccgacaacagcggctactcccagacgacctggcgcgtgtacctgcggagccacgacttcgaggcctgcatcctgtaccccaaccagcacttctgccgctgcgtgaagcacggggacaagtgctccagctccaactgggacttcgcgaacgagatgaagaactactacagcggcaagcagtccaagttcgacaaggacctcaacctggccctgatgagcctccaccacgccttccgcgggaccagctccttctacatcgccaagctgctgcgggagaagaagaacgaggacctcgtcacctacgtggagaagatcaagggcaagtaccccggcaacgccctgctgaaggcgatcatcgactacatcaagtacatgaaggggctcacggagatgaacaacagcaagcacgacgagatgtgggacgacttcatcttcgaggtgccgcccaccaagtcccccagcgtccgccggctggagtccagctacgacttcaagaccaacgtgaactccaaccccagccacatctgcaagaacatcaagaccgtggtctgcctgtcccccaagagcggcgtgtcctacgacagcatcatcgcctgcggggagccgtcccagcccagcatctaccgcaagcccgactcccaggtgttccagagcaacgccgaccagacgcacttctgcctctccgacacccactgcctggagaacttcgagaccgtcggcgaggagatcatcgacgccatcaagaagtccaagtgctgggagaccgagttcacggagtacatccagttcaagcagagcgacggggtgcggagctgccgcatgaaggacagcggcgagtgcaccgtgaccaccaaccggtggccgatcatcctgtgcgacaacgacaagttctactactccgagctccagaaggactacgacaagggccaggacatcgggcacttctgcctgagcccccgctgcaacacgatccggcaccccatcaaccgcaagcacatctccaactgcacctggcaggtcaaccacaacaacatcgacaagatcgaggtgcacgagctggaggacctcgagcagtacaagaaggccatcacccagaagctgcagaccagcctgaccctcttcaagtactccaagaccaagaacctgccccacatcaagccgatgtacaagtacatcaccatcgagggcaccgagacggcggaggggatcgagagcgcctacatcgagtccgagatccccgccctggccggcaccagcatcggcttcaagatcacctccaagagcgggaagcacctcctggacgtgatcggctacgtcaagtccgcgagctactccgccgtgtacaccaagctgtacacgaccgggcccaccatcggcgtgaacaccaagcacgacgagctctgcacggggccgtgccccgtcaacgtgccccacggcaccggctggctgaccttcgccaaggagcggaccagctcctgggggtgcgaggagttcggctgcctggccatcagcgacgggtgcgtgttcggctcctgccaggacatcatcaaggacgagatcacggtctaccgcaaggagaccgaggagaccaccgacgtggagctctgcctgaccttcgccgacaagacgtactgcaccaacctgaacgcgatcacccccatcatcaccgaccagttcgaggtgcagttcaagacggtcgaggcctacagcctcccgcggatcatcgccgtgcgcaaccacgagatcatggtggggcagatcaacgacatcggcgtctacagcaagggctgcgggaacgtgcagaaggtgaacaacaccaactacggcaacggggtccccaagttcgactacctgtgccacctggcctcccggaaggaggtgatcgtgcgcaagtgcatcgacaacgactaccaggcctgcaagttcctccagacccccgcgagctaccggctggaggaggagggcgggtccgtcaccgtgatcgactacaagaagatcctgggcacgatcaagatgaaggccatcctcggcgacgtgaagtacaagaccttcgccgacaacgtcgacctgaccgtggagggggtgtgcaccggctgcatcaactgcttcgagaacatccactgcgagctgacgatccacagcaccgtcgaggcctcctgccccgtggtgagctcctgcaccgtcttccacgaccgcatcctcatcaccccgaacgagcacaagtacgccatcaaggtgatctgcaacgagaagcccgggcccacgctgcccttcaagatctgcagcgcgaagaccgacgccgccatgaccctggccgacgcgaagccgatcctcgagctggcccccgtcgaccagaccacgtacatcaaggagaaggacgagcggtgcaagacctggatgtgccgcgtgcgcgacgagggcttccaggtgatcttcgagcccttcaagaacctgttcgggtcctacatcggcatcttctacaccttcatcatcagcctcatggccatcttcatcgtcatctacatcgtgctgcccatctgcttcaagctgcgggacaccctccgccagcacgaggacgcctacaagcgggagatgaagatccgctga

SEQ ID NO: 12620 - RNA, 4323 nt, synthetic construct
  misc_feature 1..4323: note = derived and/or modified CDS sequence (opt1) from TAHV(105)__GQ386829.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccggcctgctgacccaccgcaagacctacaactgcctcgtgcagtacaagtccaagtggctgacgaacttcctgatcgtgtacatcatcctcatgctgatcaaggacagcgtcctgatcgtgcacgcggacgggaccgacttcgagaagtgctccggcgaggccgacatcacctggaactgcaccgggcccttcctcaacctgggcaactgcgagaagaagcagaagaaggagagctacaacaacatcgccacgcagctgaagggcctcgacgccatctccgtgctggacatcccgatgatcagcaagatccccgaggacatcgcgggggccctgcggttcatcgaggagcagcgctcctaccacgtccagctgaccgccgagtacgccatgctcacccggtactgcgactactacacccagttcaccgacaacagcggctactcccagacgacctggcgcgtgtacctgcggagccacgacttcgaggcctgcatcctgtaccccaaccagcacttctgccgctgcgtgaagcacggggacaagtgctccagctccaactgggacttcgcgaacgagatgaagaactactacagcggcaagcagtccaagttcgacaaggacctcaacctggccctgatgagcctccaccacgccttccgcgggaccagctccttctacatcgccaagctgctgaaggagaagaagaacgaggacctcgtcacctacgccgagaagatcaagggcaagtaccccggcaacgcgctgctgaaggccatcatcgactacatcaagtacatgaaggacctcacggagatgaacaacttcaagcacgacgagatgtgggacgacttcatcttcgaggtgccgcccaccaagagcccctccgtgcggcgcctggagagctcctacgacttcaagaccaacgtcaacagcaacccctcccacatctgcaagaacatcaagaccgtggtgtgcctgagcccgaagtccggggtcagctacgactccatcatcgcctgcggcgagcccagccagccctccatctaccggaagcccgacagccaggtgttccagtccaacgccgaccagacgcacttctgcctcagcgacacccactgcctggagaactacgagaccgtgggggaggagatcatcgacgccatcaagaagtccaagtgctgggagaccgagttcacggagtacatccagttcaagcagagcgacggcgtccgcagctgccggatgaaggactccggggagtgcaccgtgaccaccaaccgctggccgatcatcctgtgcgacaacgacaagttctactacagcgagctccagaaggactacgacaaggaccaggacatcggccacttctgcctgagcccccggtgcaacacgatccgccaccccatcaaccggaagcacatcagcaactgcacctggcaggtctcccacaacaacatcgacaagatcgaggtgcacgagctggaggacctcgagcagtacaagaaggcgatcacccagaagctgcagaccagcctgaccctcttcaagtactccaagaccaagaacctgccccacatcaagccgatgtacaagtacatcaccatcgagggcaccgagacggccgaggggatcgagagcgcctacatcgagtccgagatccccgccctggcgggcaccagcatcgggttcaagatcacctccaagagcggcaagcacctcctggacgtgatcggctacgtgaagtccgccagctactccgccgtctacaccaagctgtacacgaccgggcccaccatcggcgtgaacaccaagcacgacgagctctgcacggggccgtgccccgtgaacgtcccccacggcaccgggtggctgaccttcgccaaggagcgcaccagctcctggggctgcgaggagttcggctgcctggccatcagcgacgggtgcgtgttcggctcctgccaggacatcatcaaggacgagatcacggtgtaccggaaggagaccgaggagaccaccgacgtcgagctctgcctgaccttcgcggacaagacgtactgcaccaacctgaacgccatcacccccatcatcaccgaccagttcgaggtgcagttcaagacggtggaggcctacagcctcccgcgcatcatcgccgtccggaaccacgagatcatggtggggcagatcaacgacatcggcgtgtacagcaaggggtgcggcaacgtccagaaggtgaacaacaccaactacggcaacggggtgcccaagttcgactacctgtgccacctggcctcccgcaaggaggtcatcgtgcggaagtgcttcgacaacgactaccaggcgtgcaagttcctccagacccccgccagctaccgcctggaggaggagggcgggtccgtgaccgtcatcgactacaagaagatcctgggcacgatcaagatgaaggccatcctcggggacgtgaagtacaagaccttcgccgacaacgtggacctgaccgtcgagggcgtgtgcaccggctgcatcaactgcttcgagaacatccactgcgagctgacgatccacagcaccgtggaggcctcctgccccgtcgtgagctcctgcaccgtgttccacgaccggatcctcatcaccccgaacgagcacaagtacgcgatcaaggtcatctgcaacgagaagcccgggcccacgctgcccttcaagatctgcagcgccaagaccgacgccgccatgaccctggcggacgccaagccgatcctcgagctggcccccgtggaccagaccacgtacatcaaggagaaggacgagcgctgcaagacctggatgtgccgggtccgcgacgagggcttccaggtgatcttcgagcccttcaagaacctgttcgggtcctacatcggcatcttctacaccttcatcatcagcctcatggccatcttcatcgtgatctacatcgtcctgcccatctgcttcaagctgcgcgacaccctccggcagcacgaggacgcctacaagcgcgagatgaagatccggtga

SEQ ID NO: 12621 - RNA, 4323 nt, synthetic construct
  misc_feature 1..4323: note = derived and/or modified CDS sequence (opt1) from TAHV(106)__GQ386830.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtcaagagcggctggttcaagtccaccacgtacatcaccctcgaccagacctgcgagcacctgaaggtgagctgcgggcccaagtccatccagttccacgcctgcttcaaccagcacatgagctgcgtgcgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccggcctgctgacccaccgcaagacctacaactgcctcgtgcagtacaagtccaagtggctgacgaacttcctgatcgtgtacatcatcctcatgctgatcaaggacagcgtcctgatcgtgcacgcggacgggaccgacttcgagaagtgctccggcgaggccgacatcacctggaactgcaccgggcccttcctcaacctgggcaactgcgagaagaagcagaagaaggagagctacaacaacatcgccacgcagctgaagggcctcgacgccatctccgtgctggacatcccgatgatcagcaagatccccgaggacatcgcgggggccctgcggttcatcgaggagcagcgctcctaccacgtccagctgaccgccgagtacgccatgctcacccggtactgcgactactacacccagttcaccgacaacagcggctactcccagacgacctggcgcgtgtacctgcggagccacgacttcgaggcctgcatcctgtaccccaaccagcacttctgccgctgcgtgaagcacggggacaagtgctccagctccaactgggacttcgcgaacgagatgaagaactactacagcggcaagcagtccaagttcgacaaggacctcaacctggccctgatgagcctccaccacgccttccgcgggaccagctccttctacatcgccaagctgctgaaggagaagaagaacgaggacctcgtcacctacgccgagaagatcaagggcaagtaccccggcaacgcgctgctgaaggccatcatcgactacatcaagtacatgaaggggctcacggagatgaacaacttcaagcacgacgagatgtgggacgacttcatcagcgaggtgccgcccaccaagtcccccagcgtgcggcgcctggagtccagctacgacttcaagaccaacgtcaactccaaccccagccacatctgcaagaacatcaagaccgtggtgtgcctgtcccccaagagcggcgtctcctacgacagcatcatcgcctgcggggagccgtcccagcccagcatctaccggaagcccgactcccaggtgttccagagcaacgccgaccagacgcacttctgcctctccgacacccactgcctggagaactacgagaccgtgggcgaggagatcatcgacgccatcaagaagtccaagtgctgggagaccgagttcacggagtacatccagttcaagcagagcgacggggtccgcagctgccggatgaaggacagcggcgagtgcaccgtgaccaccaaccgctggccgatcatcctgtgcgacaacgacaagttctactactccgagctccagaaggactacgacaaggaccaggacatcggccacttctgcctgagcccccggtgcaacacgatccgccaccccatcaaccggaagcacatctccaactgcacctggcaggtcagccacaacaacatcgacaagatcgaggtgcacgagctggaggacctcgagcagtacaagaaggcgatcacccagaagctgcagacctccctgaccctcttcaagtacagcaagaccaagaacctgccccacatcaagccgatgtacaagtacatcaccatcgaggggaccgagacggccgagggcatcgagtccgcctacatcgagagcgagatccccgccctggcggggacctccatcggcttcaagatcaccagcaagtccggcaagcacctcctggacgtgatcgggtacgtcaagagcgcctcctacagcgccgtgtacaccaagctgtacacgaccggccccaccatcgacgtgaacaccaagcacgacgagctctgcacggggccgtgccccgtgaacgtcccccacggcaccgggtggctgaccttcgccaaggagcgcacctccagctggggctgcgaggagttcggctgcctggccatctccgacgggtgcgtgttcggcagctgccaggacatcatcaaggacgagatcacggtgtaccggaaggagaccgaggagaccaccgacgtcgagctctgcctgaccttcgcggacaagacgtactgcaccaacctgaacgccatcacccccatcatcaccgaccagttcgaggtgcagttcaagacggtggaggcctacagcctcccgcgcatcatcgccgtccggaaccacgagatcatggtggggcagatcaacgacatcggcgtgtactccaaggggtgcggcaacgtccagaaggtgaacaacaccaactacggcaacggggtgcccaagttcgactacctgtgccacctggccagccgcaaggaggtcatcgtgcggaagtgcttcgacaacgactaccaggcgtgcaagttcctccagacccccgcctcctaccgcctggaggaggagggcgggagcgtgaccgtcatcgactacaagaagatcctgggcacgatcaagatgaaggccatcctcggggacgtgaagtacaagaccttcgccgacaacgtggacctgaccgtcgagggcgtgtgcaccggctgcatcaactgcttcgagaacatccactgcgagctgacgatccactccaccgtggaggccagctgccccgtcgtgtccagctgcaccgtgttccacgaccggatcctcatcaccccgaacgagcacaagtacgcgatcaaggtcatctgcaacgagaagcccgggcccacgctgcccttcaagatctgctccgccaagaccgacgccgccatgaccctggcggacgccaagccgatcctcgagctggcccccgtggaccagaccacgtacatcaaggagaaggacgagcgctgcaagacctggatgtgccgggtccgcgacgagggcttccaggtgatcttcgagcccttcaagaacctgttcgggagctacatcggcatcttctacaccttcatcatctccctcatggccatcttcatcgtgatctacatcgtcctgcccatctgcttcaagctgcgcgacaccctccggcagcacgaggacgcctacaagcgcgagatgaagatccggtga

SEQ ID NO: 12622 - RNA, 4323 nt, synthetic construct
  misc_feature 1..4323: note = derived and/or modified CDS sequence (opt1) from TAHV(181)__GQ386831.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacggcgacgccgccgggctgctgacccaccgcaagacctacaactgcctcgtgcagtacaagtccaagtggctgacgaacttcctgatcggctacatcatcctcatgctgatcaaggacagcgtgctgatcgtccacgcggacgggaccgacttcgagaagtgctccggcgaggccgacatcacctggaactgcaccggccccttcctcaacctggggaactgcgagaagaagcagaagaaggagagctacaacaacatcgccacgcagctgaagggcctcgacgccatctccgtgctggacatcccgatgatcagcaagatccccgaggacatcgcgggggccctgcggttcatcgaggagcagcgctcctaccacgtgcagctgaccgccgagtacgccatgctcacccggtactgcgactactacacccagttcaccgacaacagcggctactcccagacgacctggcgcgtctacctgcggagccacgacttcgaggcctgcatcctgtaccccaaccgccacttctgccgctgcgtgaagcacggggacaagtgctccagctccaactgggacttcgcgaacgagatgaagaactactacagcggcaagcagtccaagttcgacaaggacctcaacctggccctgatgagcctccaccacgccttccggggcaccagctccttctacatcgccaagctgctgaaggagaagaagaacgaggacctcgtgacctacgccgagaagatcaaggggaagtaccccggcaacgcgctgctgaaggccatcatcgactacatcaagtacatgaaggggctcacggagatgaacaacttcaagcacgacgagatgtgggacgacttcatcttcgaggtcccgcccaccaagagcccctccgtgcgccggctggagagctcctacgacttcaagaccaacgtgaacagcaacccctcccacatctgcaagaacatcaagaccgtcgtgtgcctgagcccgaagtccggcgtgagctacgactccatcatcgcctgcggggagcccagccagccctccatctaccgcaagcccgacagccaggtcttccagtccaacgccgaccagacgcacttctgcctcagcgacacccactgcctggagaactacgagaccgtgggcgaggagatcatcgacgccatcaagaagtccaagtgctgggagaccgagttcacggagtacatccagttcaagcagagcgacggcgtgcggagctgccgcatgaaggactccggggagtgcaccgtcaccaccaaccggtggccgatcatcctgtgcgacaacgacaagttctactacagcgagctccagaaggactacgacaaggaccaggacatcggccacttctgcctgagcccccgctgcaacacgatccggcaccccatcaaccgcaagcacatcagcaactgcacctggcaggtcaaccacaacaacatcgacaagatcgaggtgcacgagctggaggacctcgagcagtacaagaaggcgatcacccagaagctgcagacctccctgaccctcttcaagtacagcaagaccaagaacctgccccacatcaagccgatgtacaagtacatcaccatcgaggggaccgagacggccgagggcatcgagtccgcctacatcgagagcgagatccccgccctggcgggcacctccatcgggttcaagatcaccagcaagtccggcaagcacctcctggacgtgatcgggtacgtcaagagcgcctcctacagcgccgtgtacaccaagctgtacacgaccggccccaccatcggggtgaacaccaagcacgacgagctctgcacgggcccgtgccccgtgaacgtgccccacggcaccgggtggctgaccttcgccaaggagcggacctccagctggggctgcgaggagttcgggtgcctggccatctccgacggctgcgtcttcgggagctgccaggacatcatcaaggacgagatcacggtgtaccgcaaggagaccgaggagaccaccgacgtggagctctgcctgaccttcgcggacaagacgtactgcaccaacctgaacgccatcacccccatcatcaccgaccagttcgaggtccagttcaagacggtggaggcctactccctcccgcggatcatcgccgtgcgcaaccacgagatcatggtcggccagatcaacgacatcggcgtgtacagcaaggggtgcggcaacgtgcagaaggtcaacaacaccaactacgggaacggcgtgcccaagttcgactacctgtgccacctggccagccggaaggaggtgatcgtccgcaagtgcttcgacaacgactaccaggcgtgcaagttcctccagacccccgcctcctaccggctggaggaggagggcgggagcgtgaccgtgatcgactacaagaagatcctgggcacgatcaagatgaaggccatcctcggggacgtcaagtacaagaccttcgccgacaacgtggacctgaccgtggagggcgtctgcaccgggtgcatcaactgcttcgagaacatccactgcgagctgacgatccactccaccgtggaggccagctgccccgtggtctccagctgcaccgtgttccacgaccgcatcctcatcaccccgaacgagcacaagtacgcgatcaaggtgatctgcaacgagaagcccggccccacgctgcccttcaagatctgctccgccaagaccgacgccgccatgaccctggcggacgccaagccgatcctcgagctggcccccgtcgaccagaccacgtacatcaaggagaaggacgagcggtgcaagacctggatgtgccgcgtgcgcgacgaggggttccaggtcatcttcgagcccttcaagaacctgttcggcagctacatcggcatcttctacaccttcatcatctccctcatggccatcttcatcgtgatctacatcgtgctgcccatctgcttcaagctgcgggacaccctccgccagcacgaggacgcctacaagcgggagatgaagatccgctga

SEQ ID NO: 12623 - RNA, 4323 nt, synthetic construct
  misc_feature 1..4323: note = derived and/or modified CDS sequence (opt1) from TAHV(236)__GQ386832.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccatcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccggcctgctgacccaccgcaagacctacaactgcctcgtccagtacaagtccaagtggctgaccaacttcctgatcgtgtacatcatcctcatgctgatcaaggacagcgtgctgatcgtccacgcggacgggaccgacttcgagaagtgctccggcgaggccgacatcacctggaactgcaccgggcccttcctcaacctgggcaactgcgagaagaagcagaagaaggagagctacaacaacatcgccacgcagctgaagggcctcgacgccatctccgtgctggacatgccgatgatcagcaagatccccgaggacatcgcgggggccctgcggttcatcgaggagcagcgctcctaccacgtgcagctgaccgccgagtacgccatgctcacccggtactgcgactactacacccagttcaccgacaacagcggctactcccagacgacctggcgcgtctacctgcggagccacgacttcgaggcctgcatcctgtaccccaaccagcacttctgccgctgcgtgaagcacggggacaagtgctccagctccaactgggacttcgcgaacgagatgaagaactactacagcggcaagcagtccaagttcgacaaggacctcaacctggccctgatgagcctccaccacgccttccgcgggaccagctccttctacatcgccaagctgctgaaggagaagaagaacgaggacctcgtgacctacgccgagaagatcaagggcaagtaccccggcaacgcgctgctgaaggccatcatcgactacatcaagtacatgaaggacctcacggagatgaacaacttcaagcacgacgagatgtgggacgacttcatcttcgaggtcccgcccaccaagagcccctccgtgcggcgcctggagagctcctacgacttcaagaccaacgtgaacagcaacccctcccacatctgcaagaacatcaagaccgtcatctgcctgagcccgaagtccggggtgagctacgactccatcatcgcctgcggcgagcccagccagccctccatctaccggaagcccgacagccaggtgttccagtccaacgccgaccagacgcacttctgcctcagcgacacccactgcctggagaactacgagaccgtcggggaggagatcatcgacgccatcaagaagtccaagtgctgggagaccgagctgacggagtacatccagttcaagcagagcgacggcgtgcgcagctgccggatgaaggactccggggagtgcaccgtgaccaccaaccgctggccgatcatcctctgcgacaacgacaagttctactacagcgagctgcagaaggactacgacaaggaccaggacatcggccacttctgcctgagcccccggtgcaacacgatccgccaccccatcaaccggaagcacatcagcaactgcacctggcaggtctcccacaacaacatcgacaagatcgaggtgcacgagctcgaggacctggagcagtacaagaaggcgatcacccagaagctgcagaccagcctcacgctgttcaagtactccaagaccaagaacctgccccacatcaagccgatgtacaagtacatcaccatcgagggcaccgagacggccgaggggatcgagagcgcctacatcgagtccgagatccccgccctcgcgggcaccagcatcgggttcaagatcacctccaagagcggcaagcacctcctggacgtgatcggctacgtcaagtccgccagctactccgccgtgtacaccaagctgtacacgaccgggcccaccatcggcgtgaacaccaagcacgacgagctgtgcacggggccgtgccccgtcaacgtgccccacggcaccgggtggctgaccttcgccaaggagcgcaccagctcctggggctgcgaggagttcggctgcctcgccatcagcgacgggtgcgtgttcggctcctgccaggacatcatcaaggacgagatcacggtctaccggaaggagaccgaggagaccaccgacgtggagctgtgcctgaccttcgcggacaagacgtactgcaccaacctcaacgccatcacccccatcatcaccgaccagttcgaggtgcagttcaagacggtcgaggcctacagcctgccgcgcatcatcgccgtgcggaaccacgagatcatggtggggcagatcaacgacatcggcgtctacagcaaggggtgcggcaacgtgcagaaggtgaacaacaccaactacggcaacggggtccccaagttcgactacctgtgccacctcgcctcccgcaaggaggtgatcgtgcggaagtgcttcgacaacgactaccaggcgtgcaagttcctgcagacccccgccagctaccgcctggaggaggagggctccagcgtcaccgtgatcgactacaagaagatcctcgggacgatcaagatgaaggccatcctgggcgacgtgaagtacaagaccttcgccgacaacgtcgacctgaccgtggagggggtgtgcaccggctgcatcaactgcttcgagaacatccactgcgagctcacgatccactccaccgtcgaggccagctgccccgtggtgtccagctgcaccgtcttccacgaccggatcctgatcaccccgaacgagcacaagtacgcgatcaaggtgatctgcaacgagaagcccggccccacgctgcccttcaagatctgctccgccaagaccgacgccgccatgaccctcgcggacgccaagccgatcctggagctggcccccgtggaccagaccacgtacatcaaggagaaggacgagcgctgcaagacctggatgtgccgggtccgcgacgaggggttccaggtgatcttcgagcccttcaagaacctcttcggcagctacatcgggatcttctacaccttcatcatctccctgatggccatcttcatcgtcatctacatcgtgctgcccatctgcttcaagctccgcgacgccctgcggcagcacgaggacgcgtacaagcgcgagatgaagatccggtga

SEQ ID NO: 12624 - RNA, 4323 nt, synthetic construct
  misc_feature 1..4323: note = derived and/or modified CDS sequence (opt1) from TAHV(29)__GQ386823.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccggcctgctgacccaccgcaagacctacaactgcctcgtgcagtacaagtccaagtggctgacgaacttcctgatcgtgtacatcatcctcatgctgatcaaggacagcgtcctgatcgtgcacgcggacgggaccgacttcgagaagtgctccggcgaggccgacatcacctggaactgcaccgggcccttcctcaacctgggcaactgcgagaagaagcagaagaaggagagctacgacaacatcgccacgcagctgaagggcctcgacgccatctccgtgctggacatcccgatgatcagcaagatccccgaggacatcgcgggggccctgcggttcatcgaggagcagcgctcctaccacgtccagctgaccgccgagtacgccatgctcacccggtactgcgactactacacccagttcaccgacaacagcggctactcccagacgacctggcgcgtgtacctgcggagccacgacttcgaggcctgcatcctgtaccccaaccagcacttctgccgctgcgtgaagcacggggacaagtgctccagctccaactgggacttcgcgaacgagatgaagaactactacagcggcaagcagtccaagttcgacaaggacctcaacctggccctgatgagcctccaccacgccttccgcgggaccagctccttctacatcgccaagctgctgaaggagaagaagaacgaggacctcgtcacctacgccgagaagatcaagggcaagtaccccggcaacgcgctgctgaaggccatcatcgactacatcaagtacatgaaggacctcacggagatgaacaacttcaagcacgacgagatgtgggacgacttcatcttcgaggtgccgcccaccaagagcccctccgtgcggcgcctggagagctcctacgacttcaagaccaacgtcaacagcaacccctcccacatctgcaagaacatcaagaccgtggtgtgcctgagcccgaagtccggggtcagctacgactccatcatcgcctgcggcgagcccagccagccctccatctaccggaagcccgacagccaggtgttccagtccaacgccgaccagacgcacttctgcctcagcgacacccactgcctggagaactacgagaccgtgggggaggagatcatcgacgccatcaagaagtccaagtgctgggagaccgagttcacggagtacatccagttcaagcagagcgacggcgtccgcagctgccggatgaaggactccggggagtgcaccgtgaccaccaaccgctggccgatcatcctgtgcgacaacgacaagttctactacagcgagctccagaaggactacgacaaggaccaggacatcggccacttctgcctgagcccccggtgcaacacgatccgccaccccatcaaccggaagcacatcagcaactgcacctggcaggtctcccacaacaacatcgacaagatcgaggtgcacgagctggaggacctcgagcagtacaagaaggcgatcacccagaagctgcagaccagcctgaccctcttcaagtactccaagaccaagaacctgccccacatcaagccgatgtacaagtacatcaccatcgagggcaccgagacggccgaggggatcgagagcgcctacatcgagtccgagatccccgccctggcgggcaccagcatcgggttcaagatcacctccaagagcggcaagcacctcctggacgtgatcggctacgtgaagtccgccagctactccgccgtctacaccaagctgtacacgaccgggcccaccatcggcgtgaacaccaagcacgacgagctctgcacggggccgtgccccgtgaacatgccccacggcaccgggtggctgaccttcgccaaggagcgcaccagctcctggggctgcgaggagttcggctgcctggccatcagcgacgggtgcgtcttcggctcctgccaggacatcatcaaggacgagatcacggtgtaccggaaggagaccgaggagaccaccgacgtggagctctgcctgaccttcgcggacaagacgtactgcaccaacctgaacgccatcacccccatcatcaccgaccagttcgaggtccagttcaagacggtggaggcctacagcctcccgcgcatcatcgccgtgcggaaccacgagatcatggtcgggcagatcaacgacatcggcgtgtacagcaaggggtgcggcaacgtgcagaaggtcaacaacaccaactacggcaacggggtgcccaagttcgactacctgtgccacctggcctcccgcaaggaggtgatcgtccggaagtgcttcgacaacgactaccaggcgtgcaagttcctccagacccccgccagctaccgcctggaggaggagggcgggtccgtgaccgtgatcgactacaagaagatcctgggcacgatcaagatgaaggccatcctcggggacgtcaagtacaagaccttcgccgacaacgtggacctgaccgtggagggcgtctgcaccggctgcatcaactgcttcgagaacatccactgcgagctgacgatccacagcaccgtggaggcctcctgccccgtggtcagctcctgcaccgtgttccacgaccggatcctcatcaccccgaacgagcacaagtacgcgatcaaggtgatctgcaacgagaagcccgggcccacgctgcccttcaagatctgcagcgccaagaccgacgtcgccatgaccctggccgacgcgaagccgatcctcgagctggcccccgtggaccagaccacgtacatcaaggagaaggacgagcgctgcaagacctggatgtgccgggtcaaggacgagggcttccaggtgatcttcgagcccttcaagaacctgttcgggtcctacatcggcatcttctacaccttcatcatcagcctcatggccatcttcatcgtgatctacatcgtcctgcccatctgcttcaagctgcgcgacaccctccgccagcacgaggacgcctacaagcgggagatgaagatccgctga

SEQ ID NO: 12625 - RNA, 4323 nt, synthetic construct
  misc_feature 1..4323: note = derived and/or modified CDS sequence (opt1) from TAHV(4019)__GQ386834.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtcaagagcggctggttcaagtccaccacgtacatcaccctcgaccagacctgcgagcacctgaaggtgagctgcgggcccaagtccatccagttccacgcctgcttcaaccagcacatgagctgcgtgcgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccggcctgctgacccaccgcaagacctacaactgcctcgtgcagtacaagtccaagtggctgaccaacttcctgatcgtgtacatcatcctcatgctgatcaaggacagcgtcctgatcgtgcacgcggacgggaccgacttcgagaagtgctccggcgaggccgacatcacctggaactgcaccgggcccttcctcaacctgggcaactgcgagaagaagcagaagaaggagagctacaacaacatcgccacgcagctgaagggcctcgacgccatctccgtgctggacatcccgatgatcagcaagatccccgaggacatcgcgggggccctgcggttcatcgaggagcagcgctcctaccacgtccagctgaccgccgagtacgccatgctcacccggtactgcgactactacacccagttcaccgacaacagcggctactcccagacgacctggcgcgtgtacctgcggagccacgacttcgaggcctgcatcctgtaccccaaccgccacttctgccgctgcgtgaagcacggggacaagtgctccagctccaactgggacttcgcgaacgagatgaagaactactacagcggcaagcagtccaagttcgacaaggacctcaacctggccctgatgagcctccaccacgccttccgggggaccagctccttctacatcgccaagctgctgaaggagaagaagaacgaggacctcgtcacctacgccgagaagatcaagggcaagtaccccggcaacgcgctgctgaaggccatcatcgactacatcaagtacatgaaggacctcacggagatgaacaacttcaagcacgacgagatgtgggacgacagcatcttcgaggtgccgcccaccaagtcccccagcgtgcgccggctggagtccagctacgacttcaagaccaacgtcaactccaaccccagccacatctgcaagaacatcaagaccgtggtgtgcctgtcccccaagagcggggtctcctacgacagcatcatcgcctgcggcgagccgtcccagcccagcatctaccgcaagcccgactcccaggtgttccagagcaacgccgaccagacgcacttctgcctctccgacacccactgcctggagaactacgaggccgtgggggaggagatcatcgacgcgatcaagaagtccaagtgctgggagaccgagttcaccgagtacatccagttcaagcagagcgacggcgtccggagctgccgcatgaaggacagcggggagtgcacggtgaccaccaaccggtggccgatcatcctgtgcgacaacgacaagttctactactccgagctccagaaggactacgacaaggaccaggacatcggccacttctgcctgagcccccgctgcaacaccatccggcaccccatcaaccgcaagcacatctccaactgcacgtggcaggtcagccacaacaacatcgacaagatcgaggtgcacgagctggaggacctcgagcagtacaagaaggccatcacccagaagctgcagacctccctgaccctcttcaagtacagcaagacgaagaacctgccccacatcaagccgatgtacaagtacatcaccatcgagggcaccgagaccgccgaggggatcgagtccgcctacatcgagagcgagatccccgcgctggccggcacgtccatcgggttcaagatcaccagcaagtccggcaagcacctcctggacgtgatcagctacgtgaagtccgccagctactccgccgtctacaccaagctgtacaccacgggccccaccatcggggtgaacaccaagcacgacgagctctgcaccggcccgtgccccgtgaacgtcccccacgggacgggctggatcaccttcgccaaggagcggaccagctcctgggggtgcgaggagttcggctgcctggcgatcagcgacggctgcgtgttcgggagctgccaggacatcatcaaggacgagatcaccgtgtaccgcaaggagacggaggagaccaccgacgtcgagctgtgcctcaccttcgccgacaagacctactgcacgaacctgaacgccatcacccccatcatcaccgaccagttcgaggtgcagttcaagaccgtggaggcctactccctgccgcggatcatcgccgtccgcaaccacgagatcatggtgggccagatcaacgacatcggggtgtacagcaagggctgcgggaacgtccagaaggtgaacaacacgaactacggcaacggcgtgcccaagttcgactacctctgccacctggcgtcccggaaggaggtcatcgtgcgcaagtgcttcgacaacgactaccaggcctgcaagttcctgcagacccccgccagctaccggctcgaggaggagggcgggtccgtgaccgtcatcgactacaagaagatcctggggaccatcaagatgaaggccatcctgggcgacgtgaagtacaagacgttcgccgacaacgtggacctcaccgtcgagggggtgtgcaccggctgcatcaactgcttcgagaacatccactgcgagctgaccatccacagcacggtggaggcgtcctgccccgtcgtgagctcctgcaccgtgttccacgaccgcatcctgatcaccccgaacgagcacaagtacgccatcaaggtcatctgcaacgagaagcccggccccaccctccccttcaagatctgcagcgccaagacggacgccgcgatgaccctggccgacgccaagccgatcctggagctcgcccccgtggaccagaccacctacatcaaggagaaggacgagcggtgcaagacgtggatgtgccgcgtccgcgacgaggggttccaggtgatcttcgagcccttcaagaacctgttcggctcctacatcgggatcttctacaccttcatcatcagcctgatggccatcttcatcgtgatctacatcgtcctccccatctgcttcaagctgcgggacaccctgcgccagcacgaggacgcgtacaagcgggagatgaagatccgctga

SEQ ID NO: 12626 - RNA, 4323 nt, synthetic construct
  misc_feature 1..4323: note = derived and/or modified CDS sequence (opt1) from TAHV(4020)__GQ386835.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtcaagagcggctggttcaagtccaccacgtacatcaccctcgaccagacctgcgagcacctgaaggtgagctgcgggcccaagtccatccagttccacgcctgcttcaaccagcacatgagctgcgtgcgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccggcctgctgacccaccgcaagacctacaactgcctcgtgcagtacaagtccaagtggctgaccaacttcctgatcgtgtacatcatcctcatgctgatcaaggacagcgtcctgatcgtgcacgcggacgggaccgacttcgagaagtgctccggcgaggccgacatcacctggaactgcaccgggcccttcctcaacctgggcaactgcgagaagaagcagaagaaggagagctacaacaacatcgccacgcagctgaagggcctcgacgccatctccgtgctggacatcccgatgatcagcaagatccccgaggacatcgcgggggccctgcggttcatcgaggagcagcgctcctaccacgtccagctgaccgccgagtacgccatgctcacccggtactgcgactactacacccagttcaccgacaacagcggctactcccagacgacctggcgcgtgtacctgcggagccacgacttcgaggcctgcatcctgtaccccaaccagcacttctgccgctgcgtgaagcacggggacaagtgctccagctccaactgggacttcgcgaacgagatgaagaactactacagcggcaagcagtccaagttcgacaaggacctcaacctggccctgatgagcctccaccacgccttccgcgggaccagctccttctacatcgccaagctgctgaaggagaagaagaacgaggacctcgtcacctacgccgagaagatcaagggcaagtacagcggcaacgcgctgctgaaggccatcatcgactacatcaagtacatgaaggggctcacggagatgaacaacttcaagcacgacgagatgtgggacgacttcatcttcgaggtgcccccgcccaagtcccccagcgtgcggcgcctggagtccagctacgacttcaagaccaacgtcaactccaaccccagccacatctgcaagaacatcaagaccgtggtgtgcctgtcccccaagagcggcgtctcctacgacagcatcatcgcctgcggggagccgtcccagcccagcatctaccggaagcccgactcccaggtgttccagagcaacgccgaccagacccacttctgcctctccgacacgcactgcctggagaactacgagaccgtgggcgaggagatcatcgacgccatcaagaagtccaagtgctgggagaccgagttcaccgagtacatccagttcaagcagagcgacggggtccgcagctgccggatgaaggacagcggcgagtgcacggtgaccaccaaccgctggccgatcatcctgtgcgacaacgacaagttctactactccgagctccagaaggactacgacaaggaccaggacatcggccacttctgcctgagcccccggtgcaacaccatccgccaccccatcaaccggaagcacatctccaactgcacgtggcaggtcagccacaacaacatcgacaagatcgaggtgcacgagctggaggacctcgagcagtacaagaaggcgatcacccagaagctgcagacctccctgaccctcttcaagtacagcaagacgaagaacctgccccacatcaagccgatgtacaagtacatcaccatcgaggggaccgagaccgccgagggcatcgagtccgcctacatcgagagcgagatccccgccctggcggggacgtccatcggcttcaagatcaccagcaagtccggcaagcacctcctggacgtgatcgggtacgtcaagagcgcctcctacagcgccgtgtacaccaagctgtacaccacgggccccaccatcggggtgaacaccaagcacgacgagctctgcaccggcccgtgccccgtgaacgtcccccacgggacgggctggctgaccttcgccaaggagcgcacctccagctggggctgcgaggagttcgggtgcctggccatctccgacggctgcgtgttcgggagctgccaggacatcatcaaggacgagatcaccgtgtaccggaaggagacggaggagaccaccgacgtcgagctctgcctgaccttcgcggacaagacctactgcacgaacctgaacgccatcacccccatcatcaccgaccagttcgaggtgcagttcaagaccgtggaggcctacagcctcccgcgcatcatcgccgtccggaaccacgagatcatggtgggccagatcaacgacatcggggtgtactccaagggctgcggcaacgtccagaaggtgaacaacacgaactacgggaacggcgtgcccaagttcgactacctgtgccacctggccagccgcaaggaggtcatcgtgcggaagtgcttcgacaacgactaccaggcgtgcaagttcctccagacccccgcctcctaccgcctggaggaggagggcgggagcgtgaccgtcatcgactacaagaagatcctggggaccatcaagatgaaggccatcctcggcgacgtgaagtacaagacgttcgccgacaacgtggacctgaccgtcgagggcgtgtgcaccgggtgcatcaactgcttcgagaacatccactgcgagctgaccatccactccacggtggaggccagctgccccgtcgtgtccagctgcaccgtgttccacgaccggatcctcatcaccccgaacgagcacaagtacgcgatcaaggtcatctgcaacgagaagcccggccccaccctgcccttcaagatctgctccgccaagacggacgccgccatgaccctggcggacgccaagccgatcctcgagctggcccccgtggaccagaccacctacatcaaggagaaggacgagcgctgcaagacgtggatgtgccgggtccgcgacgaggggttccaggtgatcttcgagcccttcaagaacctgttcggcagctacatcgggatcttctacaccttcatcatctccctcatggccatcttcatcgtgatctacatcgtcctgcccatctgcttcaagctgcgcgacaccctccggcagcacgaggacgcctacaagcgcgagatgaagatccggtga

SEQ ID NO: 12627 - RNA, 4323 nt, synthetic construct
  misc_feature 1..4323: note = derived and/or modified CDS sequence (opt1) from TAHV(4030)__GQ386836.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgcaacgagtgcgacatgtaccacgaccgcagcggcctcaagtacaacggcgacttcacgaacaagtgccggcagtgcacgtgcgggcagtacgaggacgccgccggcctgctgacccaccgcaagacctacaactgcctcgtgcagtacaagtccaagtggctgacgaacttcctgatcgtgtacatcatcctcatgctgatcaaggacagcgtcctgatcgtgcacgcggacgggaccgacttcgagaagtgctccggcgaggccgacatcacctggaactgcaccgggcccttcctcaacctgggcaactgcgagaagaagcagaagaaggagagctacaacaacatcgccacgcagctgaagggcctcgacgccatctccgtgctggacatcccgatgatcagcaagatccccgaggacatcgcgggggccctgcggttcatcgaggagcagcgctcctaccacgtccagctgaccgccgagtacgccatgctcacccggtactgcgactactacacccagttcaccgacaacagcggctactcccagacgacctggcgcgtgtacctgcggagccacgacttcgaggcctgcatcctgtaccccaaccagcacttctgccgctgcgtgaagcacggggacaagtgctccagctccaactgggacttcgcgaacgagatgaagaactactacagcggcaagcagtccaagttcgacaaggacctcaacctggccctgatgagcctccaccacgccttccgcgggaccagctccttctacatcgccaagctgctgaaggagaagaagaacgaggacctcatcacctacgccgagaagatcaagggcaagtaccccggcaacgcgctgctgaaggccatcatcgactacatcaagtacatgaaggacctcacggagatgaacaacttcaagcacgacgagatgtgggacgacttcatcttcgaggtcccgcccaccaagagcccctccgtgcggcgcctggagagctcctacgacttcaagaccaacgtgaacagcaacccctcccacatctgcaagaacatcaagaccgtcgtgtgcctgagcccgaagtccggggtgagctacgactccatcatcgcctgcggcgagcccagccagccctccatctaccggaagcccgacagccaggtcttccagtccaacgccgaccagacgcacttctgcctcagcgacacccactgcctggagaactacgagaccgtgggggaggagatcatcgacgccatcaagaagtccaagtgctgggagaccgagttcacggagtacatccagttcaagcagagcgacggcgtgcgcagctgccggatgaaggactccggggagtgcaccgtcaccaccaaccgctggccgatcatcctgtgcgacaacgacaagttctactacagcgagctccagaaggactacgacaaggaccaggacatcggccacttctgcctgagcccccggtgcaacacgatccgccaccccatcaaccggaagcacatcagcaactgcacctggcaggtctcccacaacaacatcgacaagatcgaggtgcacgagctggaggacctcgagcagtacaagaaggcgatcacccagaagctgcagaccagcctgaccctcttcaagtactccaagaccaagaacctgccccacatcaagccgatgtacaagtacatcaccatcgagggcaccgagacggccgaggggatcgagagcgcctacatcgagtccgagatccccgccctggcgggcaccagcatcgggttcaagatcacctccaagagcggcaagcacctcctggacgtgatcggctacgtgaagtccgccagctactccgccgtgtacaccaagctgtacacgaccgggcccaccatcggcgtcaacaccaagcacgacgagctctgcacggggccgtgccccgtgaacgtgccccacggcaccgggtggctgaccttcgccaaggagcgcaccagctcctggggctgcgaggagttcggctgcctggccatcagcgacgggtgcgtcttcggctcctgccaggacatcatcaaggacgagatcatcgtgtaccggaaggagacggaggagaccaccgacgtggagctctgcctgaccttcgcggacaagacctactgcacgaacctgaacgccatcacccccatcatcaccgaccagttcgaggtccagttcaagaccgtggaggcctacagcctcccgcgcatcatcgccgtgcggaaccacgagatcatggtcgggcagatcaacgacatcggcgtgtacagcaaggggtgcggcaacgtgcagaaggtcaacaacacgaactacggcaacggggtgcccaagttcgactacctgtgccacctggcctcccgcaaggaggtgatcgtccggaagtgcttcgacaacgactaccaggcgtgcaagttcctccagacccccgccagctaccgcctggaggaggagggcgggtccgtgaccgtgatcgactacaagaagatcctgggcaccatcaagatgaaggccatcctcggggacgtcaagtacaagacgttcgccgacaacgtggacctgaccgtggagggcgtctgcaccggctgcgtgaactgcttcgagaacatccactgcgagctgaccatccacagcacggtggaggcctcctgcagcgtcgtgtccagctgcaccgtgttccacgaccggatcctcatcacccccaacgagcacaagtacgcgatcaaggtcatctgcaacgagaagccggggcccaccctgcccttcaagatctgctccgccaagacggacgccgccatgaccctggcggacgccaagcccatcctcgagctggccccggtggaccagaccacctacatcaaggagaaggacgagcgctgcaagacgtggatgtgccgggtccgcgacgagggcttccaggtgatcttcgagcccttcaagaacctgttcgggagctacatcggcatcttctacaccttcatcatctccctcatggccatcttcatcgtgatctacatcgtcctgcccatctgcttcaagctgcgcgacaccctccggcagcacgaggacgcctacaagcgcgagatgaagatccggtga

SEQ ID NO: 12628 - RNA, 4323 nt, synthetic construct
  misc_feature 1..4323: note = derived and/or modified CDS sequence (opt1) from TAHV(4033)__GQ386837.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtcaagagcggctggttcaagtccaccacgtacatcaccctcgaccagacctgcgagcacctgaaggtgagctgcgggcccaagtccatccagttccacgcctgcttcaaccagcacatgagctgcgtgcgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcacggcttcctgaacttctacgccatgtactgccacgagtgcgacatgtaccacgaccggagcggcctcaagtacaacggggacttcacgaacaagtgccgccagtgcacgtgcggccagtacgaggacgccgccgggctgctgacccaccggaagacctacaactgcctcgtgcagtacaagtccaagtggctgacgaacttcctgatcgtgtacatcatcctcatgctgatcaaggacagcgtcctgatcgtgcacgcggacggcaccgacttcgagaagtgctccggggaggccgacatcacctggaactgcaccggccccttcctcagcctgggcaactgcgagaagaagcagaagaaggagtcctacaacaacatcgccacgcagctgaaggggctcgacgccatcagcgtgctggacatcccgatgatctccaagatccccgaggacatcgcgggcgccctgcgcttcatcgaggagcagcggagctaccacgtccagctgaccgccgagtacgccatgctcacccgctactgcgactactacacccagttcaccgacaactccgggtacagccagacgacctggcgggtgtacctgcgctcccacgacttcgaggcctgcatcctgtaccccaaccagcacttctgccggtgcgtgaagcacggcgacaagtgcagctccagcaactgggacttcgcgaacgagatgaagaactactactccgggaagcagagcaagttcgacaaggacctcaacctggccctgatgagcctccaccacgccttccgcggcacctccagcttctacatcgccaagctgctgaaggagaagaagaacgaggacctcgtcacctacgccgagaagatcaagggcaagtaccccgggaacgcgctgctgaaggccatcatcgactacatcaagtacatgaaggacctcacggagatgaacaacttcaagcacgacgagatgtgggacgacttcatcttcgaggtgccgcccaccaagtcccccagcgtgcgccggctggagtccagctacgacttcaagaccaacgtcaactccaaccccagccacatctgcaagaacatcaagaccgtggtgtgcctgtcccccaagagcggcgtctcctacgacagcatcatcgcctgcggggagccgtcccagcccagcatctaccgcaagcccgactcccaggtgttccagagcaacgccgaccagacgcacttctgcctctccgacacccactgcctggagaactacgagaccgtgggcgaggagatcatcgacgccatcaagaagtccaagtgctgggagaccgagttcacggagtacatccagttcaagcagagcgacggggtccggagctgccgcatgaaggacagcggcgagtgcaccgtgaccaccaaccggtggccgatcatcctgtgcgacaacgacaagttctactactccgagctccagaaggactacgacaaggaccaggacatcggccacttctgcctgagcccccgctgcaacacgatccggcaccccatcaaccgcaagcacatctccaactgcacctggcaggtcagccacaacaacatcgacaagatcgaggtgcacgagctggaggacctcgagcagtacaagaaggcgatcacccagaagctgcagacctccctgaccctcttcaagtacagcaagaccaagaacctgccccacatcaagccgatgtacaagtacatcaccatcgaggggaccgagacggccgagggcatcgagtccgcctacatcgagagcgagatccccgccctggcggggacctccatcggcttcaagatcaccagcaagtccggcaagcacctcctggacgtgatcgggtacgtcaagagcgcctcctacagcgccgtgtacaccaagctgtacacgaccggccccaccatcggggtgaacaccaagcacgacgagctctgcacgggcccgtgccccgtgaacgtcccccacgggaccggctggctgaccttcgccaaggagcggacctccagctggggctgcgaggagttcgggtgcctggccatctccgacggctgcgtgttcgggagctgccaggacatcatcaaggacgagatcacggtgtaccgcaaggagaccgaggagaccaccgacgtcgagctctgcctgaccttcgcggacaagacgtactgcaccaacctgaacgccatcacccccatcatcaccgaccagttcgaggtgcagttcaagacggtggaggcctacagcctcccgcggatcatcgccgtccgcaaccacgagatcatggtgggccagatcaacgacatcggggtgtactccaagggctgcggcaacgtccagaaggtgaacaacaccaactacgggaacggcgtgcccaagttcgactacctgtgccacctggccagccggaaggaggtcatcgtgcgcaagtgcttcgacaacgactaccaggcgtgcaagttcctccagacccccgcctcctaccggctggaggaggagggcgggagcgtgaccgtcatcgactacaagaagatcctggggacgatcaagatgaaggccatcctcggcgacgtgaagtacaagaccttcgccgacaacgtggacctgaccgtcgagggcgtgtgcaccgggtgcatcaactgcttcgagaacatccactgcgagctgacgatccactccaccgtggaggccagctgccccgtcgtgtccagctgcaccgtgttccacgaccgcatcctcatcaccccgaacgagcacaagtacgcgatcaaggtcatctgcaacgagaagcccggccccacgctgcccttcaagatctgctccgccaagaccgacgccgccatgaccctggcggacgccaagccgatcctcgagctggcccccgtggaccagaccacgtacatcaaggagaaggacgagcggtgcaagacctggatgtgccgcgtccgggacgaggggttccaggtgatcttcgagcccttcaagaacctgttcggcagctacatcgggatcttctacaccttcatcatctccctcatggccatcttcatcgtgatctacatcgtcctgcccatctgcttcaagctgcgcgacaccctccgccagcacgaggacgcctacaagcgggagatgaagatccgctga

SEQ ID NO: 12629 - RNA, 4323 nt, synthetic construct
  misc_feature 1..4323: note = derived and/or modified CDS sequence (opt1) from TAHV(4034)__GQ386838.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacaccctgatgccgatcttcatccccctcgcctacatctacggggtcatctacaacaagagctgcaagaagtgcaagctgtgcggcctggtgtaccaccccttcacggagtgcgggacccactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgacgttcgtgacccccatcaacgccatggtcgccggggacacccaggagaccttcaagctcgaggacctgcccgacgacatgctgagcatggccatgaaggtgaacatgtactacatcatgtgcatgatcaactacgccgtcacgtggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcaccaacaagtgccggcagtgcacgtgcgggcagtacgaggacgccgccggcctgctgacccaccgcaagacctacaactgcctcgtgcagtacaagtccaagtggctgaccaacttcctgatcgtgtacatcatcctcatgctgatcaaggacagcatcctgatcgtccacgcggacgggaccgacttcgagaagtgctccggcgaggccgacatcacctggaactgcacggggcccttcctcaacctgggcaactgcgagaagaagcagaagaaggagagctacaacaacatcgccacccagctgaagggcctcgacgccatctccgtgctggacatcccgatgatcagcaagatccccgaggacatcgcgggggccctgcggttcatcgaggagcagcgctcctaccacgtgcagctgaccgccgagtacgccatgctcacccggtgctgcgactactacacccagttcacggacaacagcggctactcccagaccacctggcgcgtctacctgcggagccacgacttcgaggcctgcatcctgtaccccaaccagcacttctgccgctgcgtgaagcacgggaacaagtgctccagctccaactgggacttcgcgaacgagatgaagaactactacagcggcaagcagtccaagttcgacaaggacctcaacctggccctgatgagcctccaccacgccttccgcgggaccagctccttctacatcgccaagctgctgaaggagaagaagaacgaggacctcgtgacgtacgccgagaagatcaagggcaagtaccccggcaacgcgctgctgaaggccatcatcgactacatcaagtacatgaaggacctcaccgagatgaacaacttcaagcacgacgagatgtgggacgacttcatcttcgaggtcccgcccaccaagagcccctccgtgcggcgcctggagagctcctacgacttcaagaccaacgtgaacagcaacccctcccacatctgcaagaacatcaagacggtcgtgtgcctgagcccgaagtccggggtgagctacgactccatcatcgcctgcggcgagcccagccagccctccatctaccggaagcccgacagccaggtcttccagtccaacaccgaccagacccacttctgcctcagcgacacccactgcctggagaactacgaggccgtgggggaggagatcatcgacgccatcaagaagtccaagtgctgggagacggagttcaccgagtacatccagttcaagcagagcgacggcgtgcgcagctgccggatgaaggactccggggagtgcaccgtcaccacgaaccgctggccgatcatcctgtgcgacaacgacaagttctactacagcgagctccagaaggactacgacaaggaccaggacatcggccacttctgcctgagcccccggtgcaacaccatccgccaccccatcaaccggaagcacatcagcaactgcacctggcaggtcaaccacaacaacatcgacaagatcgaggtgcacgagctggaggacctcgagcagtacaagaaggcgatcacccagaagctgcagacgtccctgaccctcttcaagtacagcaagaccaagaacctgccccacatcaagccgatgtacaagtacatcaccatcgagggcacggagaccgccgaggggatcgagtccgcctacatcgagagcgagatccccgccctggcgggcacctccatcgggttcaagatcaccagcaagtccggcaagcacctcctggacgtgatcggctacgtcaagagcgcctcctacagcgccgtgtacacgaagctgtacaccaccgggcccaccatcggcgtgaacacgaagcacgacgagctctgcaccgggccgtgccccgtgaacgtgccccacggcaccgggtggctgaccttcgccaaggagcgcacgtccagctggggctgcgaggagttcggctgcctggccatctccgacgggtgcgtcttcggcagctgccaggacatcatcaaggacgagatcaccgtgtaccggaaggagaccgaggagaccaccgacgtggagctctgcctgacgttcgcggacaagacctactgcaccaacctgaacgccatcacccccatcatcacggaccagttcgaggtccagttcaagaccgtggaggcctactccctcccgcgcatcatcgccgtgcggaaccacgagatcatggtcgggcagatcaacgacatcggcgtgtacagcaaggggtgcggcaacgtgcagaaggtcaacaacaccaactacggcaacggggtgcccaagttcgactacctgtgccacctggccagccgcaaggaggtgatcgtccggaagtgcttcgacaacgactaccaggcgtgcaagttcctccagatccccgcctcctaccgcctggaggaggagggcgggagcgtgaccgtgatcgactacaagaagatcctgggcacgatcaagatgaaggccatcctcggggacgtcaagtacaagaccttcgccgacaacgtggacctgaccgtggagggcgtctgcaccggctgcatcaactgcttcgagaacatccactgcgagctgacgatccactccaccgtggaggccagctgccccgtggtctccagctgcaccgtgttccacgaccggatcctcatcaccccgaacgagcacaagtacgcgatcaaggtgatctgcaacgagaagcccgggcccacgctgcccttcaagatctgctccgccaagaccgacgccgccatgaccctggcggacgccaagccgatcctcgagctggcccccgtcgaccagaccacgtacatcaaggagaaggacgagcgctgcaagacctggatgtgccgggtgcgcgacgagggcttccaggtcatcttcgagcccttcaagaacctgttcgggagctacatcggcatcttctacaccttcatcatctccctcatggccatcttcatcgtgatctacatcgtgctgcccatctgcttcaagctgcgcgacaccctccggcagcacgaggacgcctacaagcgcgagatgaagatccggtga

SEQ ID NO: 12630 - RNA, 4323 nt, synthetic construct
  misc_feature 1..4323: note = derived and/or modified CDS sequence (opt1) from TAHV(4057)__GQ386839.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggggagctgcggccccaagtccatccagttccacgcctgcttcaaccagcacatgagctgcgtgcgcttcctgcaccggaccatcctccccgggtccatcgccagctccatctgccagaacgtcgagatcatcatcctgacggtgctgaccctcctgatcttcatcctgctcagcatcctgtccaagacctacatctgctacatcctgatgccgatcttcatccccctcgcctacatctacggcgtgatctacaacaagagctgcaagaagtgcaagctgtgcgggctggtctaccaccccttcaccgagtgcggcacgcactgcgtgtgcggcgcgcgctacgagacctccgaccggatgaagctccaccgcgccagcgggctgtgccccggctacaagtccctgcgggccgcccgcgtgatgtgcaagagcaaggggccggccagcatcctctccatcatcaccgcggtcctgatcctgaccttcgtgacgcccatcaacgccatggtggccggcgacacccaggagaccttcaagctcgaggacctgcccgacgacatgctgagcatggccatgaaggtcaacatgtactacatcatgtgcatcatcaactacgccgtgacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggggacttcacgaacaagtgccggcagtgcacgtgcggccagtacgaggacgccgccgggctgctgacccaccgcaagacctacaactgcctcgtccagtacaagtccaagtggctgacgaacttcctgatcgtgtacatcatcctcatgctgatcaaggacagcgtgctgatcgtccacgcggacggcaccgacttcgagaagtgctccggggaggccgacatcacctggaactgcaccggccccttcctcaacctgggcaactgcgagaagaagcagaagaaggagagctacaacaacatcgccacgcagctgaaggggctcgacgccatctccgtgctggacatcccgatgatcagcaagatccccgaggacatcgcgggcgccctgcggttcatcgaggagcagcgctcctaccacgtgcagctgaccgccgagtacgccatgctcacccggtactgcgactactacacccagttcaccgacaacagcgggtactcccagacgacctggcgcgtctacctgcggagccacgacttcgaggcctgcatcctgtaccccaaccagcacttctgccgctgcgtgaagcacggcgacaagtgctccagctccaactgggacttcgcgaacgagatgaagaactactacagcgggaagcagtccaagttcgacaaggacctcaacctggccctgatgagcctccaccacgccttccgcggcaccagctccttctacatcgccaagctgctgaaggagaagaagaacggcgacctcgtgacctacgccgagaagatcaaggggaagtaccccggcaacgcgctgctgaaggccatcatcgactacatcaagtacatgaaggacctcacggagatgaacaacttcaagcacgacgagatgtgggacgacttcatcttcgaggtcccgcccaccaagagcccctccgtgcggcgcctggagagctcctacgacttcaagaccaacgtgaacagcaacccctcccacatctgcaagaacatcaagaccgtcgtgtgcctgagcccgaagtccggggtgagctacgactccatcatcgcctgcggcgagcccagccagccctccatctaccggaagcccgacagccaggtcttccagtccaacgccgaccagacgcacttctgcctcagcgacacccactgcctggagaactacgagaccgtgggggaggagatcatcgacgccatcaagaagtccaagtgctgggagaccgagttcacggagtacatccagttcaagcagagcgacggcgtgcgcagctgccggatgaaggactccggcgagtgcaccgtcaccaccaacaagtggccgatcatcctgtgcgacaacgacaagttctactacagcgagctccagaaggactacgacaaggaccaggacatcgggcacttctgcctgagcccccgctgcaacacgatccggcaccccatcaaccgcaagcacatcagcaactgcacctggcaggtctcccacaacaacatcgacaagatcgaggtgcacgagctggaggacctcgagcagtacaagaaggcgatcacccagaagctgcagaccagcctgaccctcttcaagtactccaagaccaagaacctgccccacatcaagccgatgtacaagtacatcaccatcgagggcaccgagacggccgaggggatcgagagcgcctacatcgagtccgagatccccgccctggcgggcaccagcatcggcttcaagatcacctccaagagcgggcggcacctcctggacgtgatcggctacgtgaagtccgccagctactccgccgtgtacaccaagctgtacacgaccgggcccaccatcggcgtcaacaccaagcacgacgagctctgcacggggccgtgccccgtgaacgtgccccacggcaccggctggctgaccttcgccaaggagcgcaccagctcctgggggtgcgaggagttcggctgcctggccatcagcgacgggtgcgtcttcggctcctgccaggacatcatcaaggacgagatcacggtgtaccggaaggagaccgaggagaccaccgacgtggagctctgcctgaccttcgcggacaagacgtactgcaccaacctgaacgccatcacccccatcatcaccgaccagttcgaggtccagttcaagacggtggaggcctacagcctcccgcgcatcatcgccgtgcggaaccacgagatcatggtcgggcagatcaacgacatcggcgtgtacagcaagggctgcgggaacgtgcagaaggtcaacaacaccaactacggcaacggggtgcccaagttcgactacctgtgccacctggcctcccgcaaggaggtgatcgtccggaagtgcttcgacaacgactaccaggcgtgcaagttcctccagacccccgccagctaccgcctggaggaggagggcgggtccgtgaccgtgatcgactacaagaagatcctgggcacgatcaagatgaaggccatcctcggcgacgtcaagtacaagaccttcgccgacaacgtggacctgaccgtggagggggtctgcaccggctgcgtgaactgcttcgagaacatccactgcgagagcacgatccactccaccgtggaggccagctgccccgtcgtgtccagctgcaccgtgttccacgaccggatcctgatcaccccgaacgagcacaagtacgcgatcaaggtcatctgcaacgagaagcccgggcccacgctccccttcaagatctgctccgccaagaccgacgccgccatgaccctggcggacgccaagccgatcctggagctcgcccccgtggaccagaccacgtacatcaaggagaaggacgagcgctgcaagacctggatgtgccgggtccgcgacgagggcttccaggtgatcttcgagcccttcaagaacctgttcgggagctacatcggcatcttctacaccttcatcatctccctgatggccatcttcatcgtgatctacatcgtcctccccatctgcttcaagctgcgcgacaccctgcggcagcacgaggacgcctacaagcgcgagatgaagatccggtga

SEQ ID NO: 12631 - RNA, 4323 nt, synthetic construct
  misc_feature 1..4323: note = derived and/or modified CDS sequence (opt1) from TAHV(4060)__GQ386840.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcgatcctgatcctgaccttcgtgacgcccatcaacgccatggtggccggggacacccaggagaccttcaagctcgaggacctgcccgacgacatgctgagcatggccatgaaggtcaacatgtactacatcatgtgcatgatcaactacgccgtgacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccggcctgcagacccaccgcaagacctacaactgcctggtccagtacaagtccaagtggctcaccaacttcctgatcgtgtacatcatcctgatgctcatcaaggacagcgtgctgatcgtccacgcggacgggaccgacttcgagaagtgctccggcgaggccgacatcacctggaactgcaccgggcccttcctgaacctcggcaactgcgagaagaagcagaagaaggagagctacaacaacatcgccacgcagctgaagggcctggacgccatctccgtgctcgacatcccgatgatcagcaagatccccgaggacatcgcgggggccctgcggttcatcgaggagcagcgctcctaccacgtgcagctgaccgccgagtacgccatgctgacccggtactgcgactactacacccagttcaccgacaacagcggctactcccagacgacctggcgcgtctacctccggagccacgacttcgaggcctgcatcctgtaccccaaccagcacttctgccgctgcgtgaagcacggggacaagtgctccagctccaactgggacttcgcgaacgagatgaagaactactacagcggcaagcagtccaagttcgacaaggacctgaacctcgccctgatgagcctgcaccacgccttccgcgggaccagctccttctacatcgccaagctcctgaaggagaagaagaacgaggacctggtgacctacgccgagaagatcaagggcaagtaccccggcaacgcgctcctgaaggccatcatcgactacatcaagtacatgaaggacctgacggagatgaacaacttcaagcacgacgagatgtgggacgacttcatcttcgaggtcccgcccaccaagagcccctccgtgcggcgcctcgagagctcctacgacttcaagaccaacgtgaacagcaacccctcccacatctgcaagaacatcaagaccgtcgtgtgcctgagcccgaagtccggggtgagctacgactccatcatcgcctgcggcgagcccagccagccctccatctaccggaagcccgacagccaggtcttccagtccaacgccgaccagacgcacttctgcctgagcgacacccactgcctcgagaactacgagaccgtgggggaggagatcatcgacgccatcaagaagtccaagtgctgggagaccgagttcacggagtacacccagttcaagcagagcgacggcgtgcgcagctgccggatgaaggactccggggagtgcaccgtcaccacgaaccgctggccgatcatcctgtgcgacaacgacaagttctactacagcgagctgcagaaggactacgacaaggaccaggacatcggccacttctgcctcagcccccggtgcaacaccatccgccaccccatcaaccggaagcacatcagcaactgcacctggcaggtctcccacaacaacatcgacaagatcgaggtgcacgagctggaggacctggagcagtacaagaaggcgatcacccagaagctccagacgagcctgaccctgttcaagtactccaagaccaagaacctcccccacatcaagccgatgtacaagtacatcaccatcgagggcacggagaccgccgaggggatcgagagcgcctacatcgagtccgagatccccgccctggcgggcaccagcatcgggttcaagatcacctccaagagcggcaagcacctcctggacgtgatcggctacgtgaagtccgccagctactccgccgtgtacacgaagctgtacaccaccgggcccaccatcggcgtcaacacgaagcacgacgagctgtgcaccgggccgtgccccgtgaacgtgccccacggcaccgggtggctcaccttcgccaaggagcgcacgagctcctggggctgcgaggagttcggctgcctggccatcagcgacgggtgcgtcttcggctcctgccaggacatcatcaaggacgagatcaccgtgtaccggaaggagaccgaggagaccaccgacgtggagctgtgcctcacgttcgcggacaagacctactgcaccaacctgaacgccatcacccccatcatcacggaccagttcgaggtccagttcaagaccgtggaggcctacagcctgccgcgcatcatcgccgtgcggaaccacgagatcatggtcgggcagatcaacgacatcggcgtgtacagcaaggggtgcggcaacgtgcagaaggtcaacaacaccaactacggcaacggggtgcccaagttcgactacctctgccacctggcctcccgcaaggaggtgatcgtccggaagtgcttcgacaacgactaccaggcgtgcaagttcctgcagacccccgccagctaccgcctcgaggaggagggcgggtccgtgacggtgatcgactacaagaagatcctgggcaccatcaagatgaaggccatcctgggggacgtcaagtacaagaccttcgccgacaacgtggacctcaccgtggagggcgtctgcacgggctgcatcaactgcttcgagaacatccactgcgagctgaccatccacagcaccgtggaggcctcctgccccgtggtcagctcctgcaccgtgttccacgaccggatcctgatcacgccgaacgagcacaagtacgcgatcaaggtgatctgcaacgagaagcccgggcccaccctccccttcaagatctgcagcgccaagaccgacgccgccatgaccctggcggacgccaagccgatcctggagctcgcccccgtcgaccagacgacctacatcaaggagaaggacgagcgctgcaagacctggatgtgccgggtgcgcgacgagggcttccaggtcatcttcgagcccttcaagaacctgttcgggtcctacatcggcatcttctacaccttcatcatcagcctgatcgccatcttcatcgtgatctacatcgtgctccccatctgcttcaagctgcgcgacacgctgcggcagcacgaggacgcctacaagcgcgagatgaagatccggtga

SEQ ID NO: 12632 - RNA, 4323 nt, synthetic construct
  misc_feature 1..4323: note = derived and/or modified CDS sequence (opt1) from TAHV(5060)__GQ386841.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtcaagagcggctggttcaagtccaccacgtacatcaccctcgaccagacctgcgagcacctgaaggtgagctgcgggcccaagtccatccagttccacgcctgcttcaaccagcacatgagctgcgtgcgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatcatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccggcctgctgacccaccgcaagacctacaactgcctcgtgcagtacaagtccaagtggctgacgaacttcctgatcgtgtacatcatcctcatgctgatcaaggacagcgtcctgatcgtgcacgcggacgggaccgacttcgagaagtgctccggcgaggccgacatcacctggaactgcaccgggcccttcctcaacctgggcaactgcgagaagaagcagaagaaggagagctacaacaacatcgccacgcagctgaagggcctcgacgccatctccgtgctggacatcccgatgatcagcaagatccccgaggacatcgcgggggccctgcggttcatcgaggagcagcgctcctaccacgtccagctgaccgccgagtacgccatgctcacccggtactgcgactactacacccagttcaccgacaacagcggctactcccagacgacctggcgcgtgtacctgcggagccacgacttcgaggcctgcatcctgtaccccaaccagcacttctgccgctgcgtgaagcacggggacaagtgctccagctccaactgggacttcgcgaacgagatgaagaactactacagcggcaagcagtccaagttcgacaaggacctcaacctggccctgatgagcctccaccacgccttccgcgggaccagctccttctacatcgccaagctgctgaaggagaagaagaacggcgacctcgtcacctacgccgagaagatcaagggcaagtaccccgggaacgcgctgctgaaggccatcatcgactacatcaagtacatgaaggacctcacggagatgaacaacttcaagcacgacgagatgtgggacgacttcatcttcgaggtgagcccgaccaagtcccccagcgtgcggcgcctggagtccagctacgacttcaagaccaacgtcaactccaaccccagccacatctgcaagaacatcaagaccgtggtgtgcctgtcccccaagagcggcgtctcctacgacagcatcatcgcctgcggggagccgtcccagcccagcatctaccggaagcccgactcccaggtgttccagagcaacgccgaccagacgcacttctgcctctccgacacccactgcctggagaactacgagaccgtgggcgaggagatcatcgacgccatcaagaagtccaagtgctgggagaccgagttcacggagtacatccagttcaagcagagcgacggggtccgcagctgccggatgaaggacagcggcgagtgcaccgtgaccaccaacaagtggcccatcatcctgtgcgacaacgacaagttctactactccgagctccagaaggactacgacaaggaccaggacatcggccacttctgcctgagcccgcgctgcaacacgatccggcaccccatcaaccgcaagcacatctccaactgcacctggcaggtcagccactccaacatcgacaagatcgaggtgcacgagctggaggacctcgagcagtacaagaaggcgatcacccagaagctgcagaccagcctgaccctcttcaagtactccaagaccaagaacctgccccacatcaagcccatctacaagtacatcaccatcgaggggaccgagacggccgagggcatcgagagcgcctacatcgagtccgagatcccggccctggcggggaccagcatcggcttcaagatcacctccaagagcggcaagcacctcctggacgtgatcgggtacgtgaagtccgccagctactccgccgtctacaccaagctgtacacgaccggccccaccatcggggtgaacaccaagcacgacgagctctgcacgggcccctgcccggtgaacgtcccccacgggaccggctggctgaccttcgccaaggagcggaccagctcctggggctgcgaggagttcgggtgcctggccatcagcgacggctgcgtgttcgggagctgccaggacatcatcaaggacgagatcacggtgtaccgcaaggagaccgaggagaccaccgacgtcgagctctgcctgaccttcgcggacaagacgtactgcaccaacctgaacgccatcacccccatcatcaccgaccagttcgaggtgcagttcaagacggtggaggcctactccctcccccggatcatcgccgtccgcaaccacgagatcatggtgggccagatcaacgacatcggggtgtacagcaagggctgcggcaacgtccagaaggtgaacaacaccaactacgggaacggcgtgccgaagttcgactacctgtgccacctggcctcccggaaggaggtcatcgtgcgcaagtgcttcgacaacgactaccaggcgtgcaagttcctccagacccccgccagctaccggctggaggaggagggcgggtccgtgaccgtcatcgactacaagaagatcctggggacgatcaagatgaaggccatcctcggcgacgtgaagtacaagaccttcgccgacaacgtggacctgaccgtcgagggcgtgtgcaccgggtgcatcaactgcttcgagaacatccactgcgagctgacgatccacagcaccgtggaggcctcctgccccgtcgtgagctcctgcaccgtgttccacgaccgcatcctcatcacccccaacgagcacaagtacgcgatcaaggtcatctgcaacgagaagccgggccccacgctgcccttcaagatctgcagcgccaagaccgacgccgccatgaccctggcggacgccaagcccatcctcgagctggccccggtggaccagaccacgtacatcaaggagaaggacgagcggtgcaagacctggatgtgccgcgtccgggacgaggggttccaggtgatcttcgagcccttcaagaacctgttcggctcctacatcgggatcttctacaccttcatcatcagcctcatggccatcttcatcgtgatctacatcgtcctgcccatctgcttcaagctgcgcgacaccctccgccagcacgaggacgcctacaagcgggagatgaagatccgctga

SEQ ID NO: 12633 - RNA, 4323 nt, synthetic construct
  misc_feature 1..4323: note = derived and/or modified CDS sequence (opt1) from TAHV(76)__GQ386824.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacggcgacgccgccgggctgctgacccaccgcaagacctacaactgcctcgtgcagtacaagtccaagtggctgaccaacttcctgatcgtgtacatcatcctcatgctgatcaaggacagcgtcctgatcgtgcacgcggacggcaccgacttcgagaagtgctccggggaggccgacatcacctggaactgcaccggccccttcctcaacctgggcaactgcgagaagaagcagaagaaggagagctacaacaacatcgccacgcagctgaaggggctcgacgccatctccgtgctggacatcccgatgatcagcaagatccccgaggacatcgcgggcgccctgcggttcatcgaggagcagcgctcctaccacgtccagctgaccgccgagtacgccatgctcacccggtactgcgactactacacccagttcaccgacaacagcgggtactcccagacgacctggcgcgtgtacctgcggagccacgacttcgaggcctgcatcctgtaccccaaccagcacttctgccgctgcgtgaagcacggcgacaagtgctccagctccaactgggacttcgcgaacgagatgaagaactactacagcgggaagcagtccaagttcgacaaggacctcaacctggccctgatgagcctccaccacgccttccgcggcaccagctccttctacatcgccaagctgctgaaggagaagaagaacgaggacctcgtcacctacgccgagaagatcaagggcaagtaccccgggaacgcgctgctgaaggccatcatcgactacatcaagtacatgaaggacctcacggagatgaacaacttcaagcacgacgagatgtgggacgacttcatcttcgaggtgccgcccaccaagagcccctccgtgcggcgcctggagagctcctacgacttcaagaccaacgtcaacagcaacccctcccacatctgcaagaacatcaagaccgtggtgtgcctgagcccgaagtccggcgtcagctacgactccatcatcgcctgcggggagcccagccagccctccatctaccggaagcccgacagccaggtgttccagtccaacgccgaccagacgcacttctgcctcagcgacacccactgcctggagaactacgaggccgtgggcgaggagatcatcgacgcgatcaagaagtccaagtgctgggagaccgagttcaccgagtacatccagttcaagcagagcgacggggtccgcagctgccggatgaaggactccggcgagtgcacggtgaccaccaaccgctggccgatcatcctgtgcgacaacgacaagttctactacagcgagctccagaaggactacgacaaggaccaggacatcggccacttctgcctgagcccccggtgcaacaccatccgccaccccatcaaccggaagcacatcagcaactgcacgtggcaggtctcccacaacaacatcgacaagatcgaggtgcacgagctggaggacctcgagcagtacaagaaggccatcacccagaagctgcagaccagcctgaccctcttcaagtactccaagacgaagaacctgccccacatcaagccgatgtacaagtacatcaccatcgaggggaccgagaccgccgagggcatcgagagcgcctacatcgagtccgagatccccgcgctggccgggacgagcatcggcttcaagatcacctccaagagcggcaagcacctcctggacgtgatctcctacgtcaagagcgcctcctacagcgccgtgtacaccaagctgtacaccacggggcccaccatcggcgtgaacaccaagcacgacgagctctgcaccgggccgtgccccgtgaacgtcccccacggcacggggtggatcaccttcgccaaggagcgcacctccagctggggctgcgaggagttcggctgcctggcgatctccgacgggtgcgtgttcggcagctgccaggacatcatcaaggacgagatcaccgtgtaccggaaggagacggaggagaccaccgacgtcgagctgtgcctcaccttcgccgacaagacctactgcacgaacctgaacgccatcacccccatcatcaccgaccagttcgaggtgcagttcaagaccgtggaggcctacagcctgccgcgcatcatcgccgtccggaaccacgagatcatggtggggcagatcaacgacatcggcgtgtactccaaggggtgcggcaacgtccagaaggtgaacaacacgaactacggcaacggggtgcccaagttcgactacctctgccacctggcgagccgcaaggaggtcatcgtgcggaagtgcttcgacaacgactaccaggcctgcaagttcctgcagacccccgcctcctaccgcctcgaggaggagggcgggagcgtgaccgtcatcgactacaagaagatcctgggcaccatcaagatgaaggccatcctgggggacgtgaagtacaagacgttcgccgacaacgtggacctcaccgtcgagggcgtgtgcaccggctgcatcaactgcttcgagaacatccactgcgagctgaccatccactccacggtggaggcgagctgccccgtcgtgtccagctgcaccgtgttccacgaccggatcctgatcaccccgaacgagcacaagtacgccatcaaggtcatctgcaacgagaagcccgggcccaccctccccttcaagatctgctccgccaagacggacgccgcgatgaccctggccgacgccaagccgatcctggagctcgcccccgtggaccagaccacctacatcaaggagaaggacgagcgctgcaagacgtggatgtgccgggtccgcgacgagggcttccaggtgatcttcgagcccttcaagaacctgttcgggagctacatcggcatcttctacaccttcatcatctccctgatggccatcttcatcgtgatctacatcgtcctccccatctgcttcaagctgcgcgacaccctgcggcagcacgaggacgcgtacaagcgcgagatgaagatccggtga

SEQ ID NO: 12634 - RNA, 4323 nt, synthetic construct
  misc_feature 1..4323: note = derived and/or modified CDS sequence (opt1) from TAHV(83)__GQ386825.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccggcctgctgacccaccgcaagacctacaactgcctcgtgcagtacaagtccaagtggctgacgaacttcctgatcgtgtacatcatcctcatgctgatcaaggacagcgtcctgatcgtgcacgcggacgggaccgacttcgagaagtgctccggcgaggccgacatcacctggaactgcaccgggcccttcctcaacctgggcaactgcgagaagaagcagaagaaggagagctacaacaacatcgccacgcagctgaagggcctcgacgccatctccgtgctggacatcccgatgatcagcaagatccccgaggacatcgcgggggccctgcggttcatcgaggagcagcgctcctaccacgtccagctgaccgccgagtacgccatgctcacccggtactgcgactactacacccagttcaccgacaacagcggctactcccagacgacctggcgcgtgtacctgcggagccacgacttcgaggtgtgcatcctgtaccccaaccagcacttctgccgctgcgtcaagcacggggacaagtgctccagctccaactgggacttcgccaacgagatgaagaactactacagcggcaagcagtccaagttcgacaaggacctcaacctggcgctgatgagcctccaccacgccttccgcgggaccagctccttctacatcgccaagctgctgaaggagaagaagaacgaggacctcgtgacctacgccgagaagatcaagggcaagtaccccggcaacgccctgctgaaggcgatcatcgactacatcaagtacatgaaggggctcacggagatgaacaacttcaagcacgacgaggtgtgggacgacttcatcttcgaggtcccgcccaccaagagcccctccgtgcggcgcctggagagctcctacgacttcaagaccaacgtgaacagcaacccctcccacatctgcaagaacatcaagaccgtcgtgtgcctgagcccgaagtccggcgtgagctacgactccatcatcgcctgcggggagcccagccagccctccatctaccggaagcccgacagccaggtcttccagtccaacgccgaccagacgcacttctgcctcagcgacacccactgcctggagaactacgagaccgtgggcgaggagatcatcgacgccatcaagaagtccaagtgctgggagaccgagttcacggagtacatccagttcaagcagagcgacggggtgcgcagctgccggatgaaggactccggcgagtgcaccgtcaccaccaaccgctggccgatcatcctgtgcgacaacgacaagttctactacagcgagctccagaaggactacgacaaggaccaggacatcggccacttctgcctgagcccccggtgcaacacgatccgccaccccatcaaccggaagcacatcagcaactgcacctggcaggtctcccacaacaacatcgacaagatcgaggtgcacgagctggaggacctcgagcagtacaagaaggccatcacccagaagctgcagaccagcctgaccctcttcaagtactccaagaccaagaacctgccccacatcaagccgatgtacaagtacatcaccatcgaggggaccgagacggcggagggcatcgagagcgcctacatcgagtccgagatccccgccctggccgggaccagcatcggcttcaagatcacctccaagagcggcaagcacctcctggacgtgatcgggtacgtgaagtccgcgagctactccgccgtgtacaccaagctgtacacgaccggccccaccatcggggtcaacaccaagcacgacgagctctgcacgggcccgtgccccgtgaacgtgccccacgggaccggctggctgaccttcgccaaggagcgcaccagctcctggggctgcgaggagttcgggtgcctggccatcagcgacggctgcgtcttcgggtcctgccaggacatcatcaaggacgagatcacggtgtaccggaaggagaccgaggagaccaccgacgtggagctctgcctgaccttcgccgacaagacgtactgcaccaacctgaacgcgatcacccccatcatcaccgaccagttcgaggtccagttcaagacggtggaggcctacagcctcccgcgcatcatcgccgtgcggaaccacgagatcatggtcggccagatcaacgacatcggggtgtacagcaagggctgcggcaacgtgcagaaggtcaacaacaccaactacgggaacggcgtgcccaagttcgactacctgtgccacctggcctcccgcaaggaggtgatcgtccggaagtgcttcgacaacgactaccaggcctgcaagttcctccagacccccgcgagctaccgcctggaggaggagggcgggtccgtgaccgtgatcgactacaagaagatcctggggacgatcaagatgaaggccatcctcggcgacgtcaagtacaagaccttcgccgacaacgtggacctgaccgtggagggcgtctgcaccgggtgcatcaactgcttcgagaacatccactgcgagctgacgatccacagcaccgtggaggcctcctgccccgtggtcagctcctgcaccgtgttccacgaccggatcctcatcaccccgaacgagcacaagtacgccatcaaggtcatctgcaacgagaagcccggccccacgctgcccttcaagatctgcagcgcgaagaccgacgccgccatgaccctggccgacgcgaagccgatcctcgagctggcccccgtggaccagaccacgtacatcaaggagaaggacgagcgctgcaagacctggatgtgccgggtgcgcgacgaggggttccaggtcatcttcgagcccttcaagaacctgttcggctcctacatcgggatcttctacaccttcatcatcagcctcatggccatcttcatcgtgatctacatcgtgctgcccatctgcttcaagctgcgcgacaccctccggcagcacgaggacgcctacaagcgcgagatgaagatccggtga

SEQ ID NO: 12635 - RNA, 4323 nt, synthetic construct
  misc_feature 1..4323: note = derived and/or modified CDS sequence (opt1) from TAHV(89)__GQ386826.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccggcctgctgacccaccgcaagacctacaactgcctcgtgcagtacaagtccaagtggctgacgaacttcctgatcgggtacatcatcctcatgctgatcaaggacagcgtgctgatcgtccacgcggacggcaccgacttcgagaagtgctccggggaggccgacatcacctggaactgcaccggccccttcctcaacctgggcaactgcgagaagaagcagaagaaggagagctacaacaacatcgccacgcagctgaaggggctcgacgccatctccgtgctggacatcccgatgatcagcaagatccccgaggacatcgcgggcgccctgcggttcatcgaggagcagcgctcctaccacgtgcagctgaccgccgagtacgccatgctcacccggtactgcgactactacacccagttcaccgacaacagcgggtactcccagacgacctggcgcgtctacctgcggagccacgacttcgaggcctgcatcctgtaccccaaccagcacttctgccgctgcgtgaagcacggcgacaagtgctccagctccaactgggacttcgcgaacgagatgaagaactactacagcgggaagcagtccaagttcgacaaggacctcaacctggccctgatgagcctccaccacgccttccgcggcaccagctccttctacatcgccaagctgctgaaggagaagaagaacgaggacctcgtgacctacgccgagaagatcaagggcaagtaccccgggaacgcgctgctgaaggccatcatcgactacatcaagtacatgaagggcctcacggagatgaacaacttcaagcacgacgagatgtgggacgacttcatcttcggggtcccgcccaccaagagcccctccgtgcggcgcctggagagctcctacgacttcaagaccaacgtgaacagcaacccctcccacatctgcaagaacatcaagaccgtcgtgtgcctgagcccgaagtccggcgtgagctacgactccatcatcgcctgcggggagcccagccagccctccatctaccggaagcccgacagccaggtcttccagtccaacgccgaccagacgcacttctgcctcagcgacacccactgcctggagaactacgagaccgtgggcgaggagatcatcgacgccatcaagaagtccaagtgctgggagaccgagttcacggagtacatccagttcaagcagagcgacggcgtgcgcagctgccggatgaaggactccggggagtgcaccgtcaccaccaaccgctggccgatcatcctgtgcgacaacgacaagttctactacagcgagctccagaaggactacgacaaggaccaggacatcggccacttctgcctgagcccccggtgcaacacgatccgccaccccatcaaccggaagcacatcagcaactgcacctggcaggtcaaccacaacaacatcgacaagatcgaggtgcacgagctggaggacctcgagcagtacaagaaggcgatcacccagaagctgcagacctccctgaccctcttcaagtacagcaagaccaagaacctgccccacatcaagccgatgtacaagtacatcaccatcgaggggaccgagacggccgagggcatcgagtccgcctacatcgagagcgagatccccgccctggcgggcacctccatcgggttcaagatcaccagcaagtccggcaagcacctcctggacgtgatcgggtacgtcaagagcgcctcctacagcgccgtgtacaccaagctgtacacgaccggccccaccatcggggtgaacaccaagcacgacgagctctgcacgggcccgtgccccgtgaacgtgccccactccaccggctggctgaccttcgccaaggagcgcaccagctcctgggggtgcgaggagttcggctgcctggccatcagcgacgggtgcgtcttcggctcctgccaggacatcatcaaggacgagatcacggtgtaccggaaggagaccgaggagaccaccgacgtggagctctgcctgaccttcgcggacaagacgtactgcaccaacctgaacgccgtcacccccatcatcaccgaccagttcgaggtgcagttcaagacggtggaggcctacagcctcccgcgcatcatcgccgtccggaaccacgagatcatggtggggcagatcaacgacatcggcgtgtacagcaagggctgcgggaacgtccagaaggtgaacaacaccaactacggcaacggggtgcccaagttcgactacctgtgccacctggcctcccgcaaggaggtcatcgtgcggaagtgcttcgacaacgactaccaggcgtgcaagttcctccagacccccgccagctaccgcctggaggaggagggcgggtccgtgaccgtcatcgactacaagaagatcctgggcacgatcaagatgaaggccatcctcggcgacgtgaagtacaagaccttcgccgacaacgccgacctgaccgtggagggggtctgcaccggctgcatcaactgcttcgagaacatccactgcgagctgacgatccacagcaccgtggaggcgtcctgccccgtggtcagctcctgcaccgtgttccacgaccggatcctcatcaccccgaacgagcacaagtacgccatcaaggtgatctgcaacgagaagcccgggcccacgctgcccttcaagatctgcagcgccaagaccgacgccgcgatgaccctggccgacgccaagccgatcctcgagctggcccccgtcgaccagaccacgtacatcaaggagaagggcgagcgctgcaagacctggatgtgccgggtgcgcgacgaggggttccaggtcatcttcgagcccttcaagaacctgttcggctcctacatcggcatcttctacaccttcatcatcagcctcatggccatcttcatcgtgatctacatcgtgctgcccatctgcttcaagctgcgcgacaccctccggcagcacgaggacgcgtacaagcgcgagatgaagatccggtga

SEQ ID NO: 12636 - RNA, 4323 nt, synthetic construct
  misc_feature 1..4323: note = derived and/or modified CDS sequence (opt1) from TAHV(90)__GQ386827.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtggccggcgggcacatcaacgtgatcgaggtcggcgacgacctcaccctgcacaccgaggcctacgtgtgcaacgcggactgcacgatcggggtggacaaggagaccgcccaggtccggctgcagaccgacaccacgaaccacttcgagatcgccggcaccaccgtgaagtccggctggttcaagagcaccacgtacatcaccctcgaccagacctgcgagcacctgaaggtgtcctgcgggcccaagagcatccagttccacgcctgcttcaaccagcacatgtcctgcgtccgcttcctgcaccggaccatcctccccggcagcatcgcctccagcatctgccagaacgtggagatcatcatcctgacggtgctgaccctcctgatcttcatcctgctctccatcctgagcaagacctacatctgctacatcctgatgccgatcttcatccccctcgcgtacatctacggggtcatctacaacaagtcctgcaagaagtgcaagctgtgcggcctggtgtaccaccccttcaccgagtgcgggacgcactgcgtgtgcggcgcccgctacgagaccagcgaccggatgaagctccaccgcgcctccggcctgtgccccgggtacaagagcctgcgggccgcccgcgtcatgtgcaagtccaagggcccggcgagcatcctcagcatcatcaccgccgtgctgatcctgaccttcgtgacgcccatcaacgccatggtcgccggggacacccaggagaccttcaagctcgaggacctgcccgacgacatgctgtccatggccatgaaggtgaacatgtactacatcatgtgcatgatcaactacgcggtcacctggagcttcatcctctgcgccctgctgatcgccctcctgttcaagaagtaccagcaccggttcctgaacttctacgccatgtactgccacgagtgcgacatgtaccacgaccgctccggcctcaagtacaacggcgacttcacgaacaagtgccggcagtgcacgtgcgggcagtacgaggacgccgcgggcctgctgacccaccgcaagacctacaactgcctcgtgcagtacaagagcaagtggctgacgaacttcctgatcgggtacatcatcctcatgctgatcaaggactccgtgctgatcgtccacgccgacggcaccgacttcgagaagtgcagcggggaggccgacatcacctggaactgcaccggccccttcctcaacctgggcaactgcgagaagaagcagaagaaggagtcctacaacaacatcgccacgcagctgaaggggctcgacgcgatcagcgtgctggacatcccgatgatctccaagatccccgaggacatcgccggcgccctgcggttcatcgaggagcagcgcagctaccacgtgcagctgaccgccgagtacgccatgctcacccggtactgcgactactacacccagttcaccgacaactccgggtacagccagacgacctggcgcgtctacctgcggtcccacgacttcgaggcgtgcatcctgtaccccaaccagcacttctgccgctgcgtgaagcacggcgacaagtgcagctccagcaactgggacttcgccaacgagatgaagaactactactccgggaagcagagcaagttcgacaaggacctcaacctggccctgatgtccctccaccacgccttccgcggcaccagcagcttctacatcgccaagctgctgaaggagaagaagaacgaggacctcgtgacctacgcggagaagatcaagggcaagtaccccgggaacgccctgctgaaggccatcatcgactacatcaagtacatgaagggcctcacggagatgaacaacttcaagcacgacgagatgtgggacgacttcatcttcgaggtcccgcccaccaagtcccccagcgtgcggcgcctggagtccagctacgacttcaagaccgacgtgaactccaaccccagccacatctgcaagaacatcaagaccgtcgtgtgcctgtcccccaagagcggggtgtcctacgacagcatcatcgcctgcggcgagccgtcccagcccagcatctaccggaagcccgactcccaggtcttccagagcaacgccgaccagacgcacttctgcctctccgacacccactgcctggagaactacgagaccgtgggggaggagatcatcgacgcgatcaagaagtccaagtgctgggagaccgagttcacggagtacatccagttcaagcagagcgacggcgtgcgcagctgccggatgaaggacagcggcgagtgcaccgtcaccaccaaccgctggccgatcatcctgtgcgacaacaacaagttctactactccgagctccagaaggactacgacaaggaccaggacatcgggcacttctgcctgagcccccggtgcaacacgatccgccaccccatcaaccggaagcacatctccaactgcacctggcaggtcaaccacaacaacatcgacaagatcgaggtgcacgagctggaggacctcgagcagtacaagaaggccatcacccagaagctgcagaccagcctgaccctcttcaagtactccaagaccaagaacctgccccacatcaagccgatgtacaagtacatcaccatcgagggcaccgagacggccgaggggatcgagagcgcctacatcgagtccgagatccccgcgctggccggcaccagcatcggcttcaagatcacctccaagagcgggaagcacctcctggacgtgatcggctacgtgaagtccgccagctactccgccgtgtacaccaagctgtacacgaccgggcccaccatcggcgtcaacaccaagcacgacgagctctgcacggggccgtgccccgtgaacgtgccccacggcaccggctggctgaccttcgccaaggagcgcaccagctcctgggggtgcgaggagttcggctgcctggcgatcagcgacgggtgcgtcttcggctcctgccaggacatcatcaaggacgagatcacggtgtaccggaaggagaccgaggagaccaccgacgtggagctctgcctgaccttcgccgacaagacgtactgcaccaacctgaacgccgtcacccccatcatcaccgaccagttcgaggtgcagttcaagacggtggaggcctacagcctcccgcgcatcatcgccgtccggaaccacgagatcatggtggggcagatcaacgacatcggcgtgtactccaagggctgcgggaacgtccagaaggtgaacaacaccaactacggcaacggggtgcccaagttcgactacctgtgccacctggcgagccgcaaggaggtcatcgtgcggaagtgcttcgacaacgactaccaggcctgcaagttcctccagacccccgccagctaccgcctggaggaggagggcgggtccgtgaccgtcatcgactacaagaagatcctgggcacgatcaagatgaaggccatcctcggcgacgtgaagtacaagaccttcgccgacaacgtggacctgaccgtcgagggggtgtgcaccggctgcatcaactgcttcgagaacatccactgcgagctgacgatccacagcaccgtggaggcgtcctgccccgtcgtgagctcctgcaccgccttccacgaccggatcctcatcaccccgaacgagcacaagtacgccatcaaggtgatctgcaacgagaagcccgggcccacgctgcccttcaagatctgcagcgccaagaccgacgcggccatgaccctggccgacgccaagccgatcctcgagctggcccccgtcgaccagaccacgtacatcaaggagaaggacgagcgctgcaagacctggatgtgccgggtgcgcgacgagggcttccaggtcatcttcgagcccttcaagaacctgttcgggtcctacatcggcatcttctacaccttcatcatcagcctcatggcgatcttcatcgtgatctacatcgtgctgcccatctgcttcaagctgcgcgacaccctccggcagcacgaggacgcctacaagcgcgagatgaagatccggtga

SEQ ID NO: 12637 - RNA, 4323 nt, synthetic construct
  misc_feature 1..4323: note = derived and/or modified CDS sequence (opt1) from TAHV(94)__GQ386828.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggcgggcacatcaacgtgatcgaggtcggcgacgacctcaccctgcacaccgaggcctacgtgtgcaacgccgactgcacgatcggggtggacaaggagaccgcgcaggtccggctgcagaccgacaccacgaaccacttcgagatcgccggcaccaccgtgaagtccggctggttcaagtccaccacgtacatcaccctcgaccagacctgcgagcacctgaaggtgagctgcgggcccaagtccatccagttccacgcctgcttcaaccagcacatgagctgcgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcctacatctacggggtcatctacaacaagagctgcaagaagtgcaagctgtgcggcctggtgtaccaccccttcaccgagtgcgggacgcactgcgtgtgcggcgcgcgctacgagacctccgaccggatgaagctccaccgcgccagcggcctgtgccccgggtacaagtccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggtccttcatcctctgcgcgctgctgatcgccctcctgttcaagaagtaccagcaccggttcctgaacttctacgccatgtactgccacgagtgcgacatgtaccacgaccgcagcggcctcaagtacaacggcgacttcacgaacaagtgccggcagtgcacgtgcgggcagtacgaggacgccgccgcgctgctgacccaccgcaagacctacaactgcctcgtgcagtacaagtccaagtggctgacgaacttcctgatcgtgtacatcatcctcatgctgatcaaggacagcgtcctgatcgtgcacgccgacggcaccgacttcgagaagtgctccggggaggccgacatcacctggaactgcaccggccccttcctcaacctggggaactgcgagaagaagcagaagaaggagagctacaacaacatcgccacgcagctgaagggcctcgacgcgatctccgtgctggacatcccgatgatcagcaagatccccgaggacatcgccggcgccctgcggttcatcgaggagcagcgctcctaccacgtccagctgaccgccgagtacgccatgctcacccggtactgcgactactacacccagttcaccgacaacagcgggtactcccagacgacctggcgcgtgtacctgcggagccacgacttcgaggtgtgcatcctgtaccccaaccagcacttctgccgctgcgtcaagcacggcgacaagtgctccagctccaactgggacttcgcgaacgagatgaagaactactacagcgggaagcagtccaagttcgacaaggacctcaacctggccctgatgagcctccaccacgccttccgcggcaccagctccttctacatcgccaagctgctgaaggagaagaagaacgaggacctcgtgacctacgccgagaagatcaaggggaagtaccccggcaacgcgctgctgaaggccatcatcgactacgtgaagtacatgaaggacctcacggagatgaacaacttcaagcacgacgagatgtgggacgacttcatcttcgaggtcccgcccaccaagagcccctccgtgcggcgcctggagagctcctacgacttcaagaccaacgtgaacagcaacccctcccacatctgcaagaacatcaagaccgtcgtgtgcctgagcccgaagtccggcgtgagctacgactccatcatcgcctgcggggagcccagccagccctccatctaccggaagcccgacagccaggtcttccagtccaacgccgaccagacgcacttctgcctcagcgacacccactgcctggagaactacgagaccgtgggcgaggagatcatcgacgccatcaagaagtccaagtgctgggagaccgagttcacggagtacatccagttcaagcagagcgacggggtgcgcagctgccggatgaaggactccggcgagtgcaccgtcaccaccaaccgctggccgatcatcctgtgcgacaacgacaagttctactacagcgagctccagaaggactacgacaaggaccaggacatcgggcacttctgcctgagcccccggtgcaacacgatccgccaccccatcaaccggaagcacatcagcaactgcacctggcaggtctcccacaacaacatcgacaagatcgaggtgcacgagctggaggacctcgagcagtacaagaaggcgatcacccagaagctgcagaccagcctgaccctcttcaagtactccaagaccaagaacctgccccacatcaagccgatgtacaagtacatcaccatcgagggcaccgagacggccgagggcatcgagagcgcctacatcgagtccgagatccccgccctggcggggaccagcatcggcttcaagatcacctccaagagcgggaagcacctcctggacgtgatcggctacgtgaagtccgccagctactccgccgtgtacaccaagctgtacacgaccggccccaccatcggggtcaacaccaagcacgacgagctctgcacgggcccgtgccccgtgaacgtgccccacgggaccggctggctgaccttcgccaaggagcgcaccagctcctgggggtgcgaggagttcggctgcctggccatcagcgacggctgcgtcttcgggtcctgccaggacatcatcaaggacgagatcacggtgtaccggaaggagaccgaggagaccaccgacgtggagctctgcctgaccttcgcggacaagacgtactgcaccaacctgaacgccatcacccccatcatcaccgaccagttcgaggtccagttcaagacggtggaggcctacagcctcccgcgcatcatcgccgtgcggaaccacgagatcatggtcggccagatcaacgacatcggggtgtacagcaagggctgcgggaacgtgcagaaggtcaacaacaccaactacggcaacggcgtgcccaagttcgactacctgtgccacctggcctcccgcaaggaggtgatcgtccggaagtgcttcgacaacgactaccaggcgtgcaagttcctccagacccccgccagctaccgcctggaggaggagggcgggtccgtgaccgtgatcgactacaagaagatcctggggacgatcaagatgaaggccatcctcggcgacgtcaagtacaagaccttcgccgacaacgtggacctgaccgtggagggggtctgcaccggctgcgtgaactgcttcgagaacatccactgcgagagcacgatccactccaccgtggaggccagctgccccgtcatctccagctgcaccgtgttccacgaccggatcctgatcaccccgaacgagcacaagtacgcgatcaaggtcatctgcaacgagaagcccggccccacgctccccttcaagatctgctccgccaagaccgacgccgccatgaccctggcggacgccaagccgatcctggagctcgcccccgtggaccagaccacgtacatcaaggagaaggacgagcgctgcaagacctggatgtgccgggtgcgcgacgaggggttccaggtcatcttcgagcccttcaagaacctgttcggcagctacatcgggatcttctacaccttcatcatctccctgatggccatcttcatcgtgatctacatcgtgctccccatctgcttcaagctgcgcgacaccctgcggcagcacgaggacgcctacaagcgcgagatgaagatccggtga

SEQ ID NO: 12638 - RNA, 4323 nt, synthetic construct
  misc_feature 1..4323: note = derived and/or modified CDS sequence (opt1) from TAHV(XJ0625)__EU622819.2__GP
  source 1..4323: mol_type = other RNA
atgatgttcgtgctgttcttcatcgccctcagcaccgcctcccccgtctaccagcgctgcttccaggacggcgcgatcgtgaagcagaacccgagcaagcaggccgtgaccgaggtctgcctgaaggacgacgtgtccatgatcaagacggaggcccggtacttcaagaacgccaccgggacctacgccaacaacgtggcgatccgcaagtggctggtcagcgactggcacgactgccggcccaagaaggtggccggcgggcacatcaacgtgatcgaggtcggcgacgacctcaccctgcacacggaggcctacgtgtgcaacgccgactgcaccatcggggtggacaaggagaccgcgcaggtccgcctgcagaccgacacgaccaaccacttcgagatcgccggcaccaccgtgaagtccggctggttcaagagcacgacctacatcaccctcgaccagacctgcgagcacctgaaggtgtcctgcgggcccaagagcgtccagttccacgcctgcttcaaccagcacatgtcctgcgtgcggttcctgcaccgcacgatcctccccggcagcatcgcctccagcatctgccagaacgtggagatcatcatcctgaccgtcctgaccctcctgatcttcatcctgctctccatcctgagcaagacctacatctgctacctgctcatgccgatcttcatccccctggcctacgtgtacggggtgatctacaacaagtcctgcaagaagtgcaagctgtgcggcctcgtctaccaccccttcacggagtgcgggacccactgcgtgtgcggcgcgcggtacgagaccagcgaccgcatgaagctgcaccgggcctccggcctgtgccccgggtacaagagcctccgcgccgcccgggtgatgtgcaagtccaagggcccggccagcatcctgagcgtcatcaccgcggtgctgatcctcacgttcgtcacccccatcaacgccatggtggccggggacacccaggagaccttcaagctggaggacctgcccgacgacatgctctccatggccatgaagatccagatgtactacatcatgtgcatcgtgaactacatcgtcacgtggagcttcatcgtgtgcgccctgatcatcgcgctgatcttcaagaagtaccagcaccgcttcctcaacttctacgccatgtactgccacgagtgcgacatgtaccacgaccggtccggcctgaagtacaacggcgacttcaccaacaagtgccgccagtgcacgtgcgggcagtacgaggacgccgccggcctgctcacccaccggaagacctacaactgcctggtgcagtacaagagcaagtggctggtcaacttcctcatcatctacatcctgctgatgctcgtgaaggactccgtgctgatcgtccaggccgaggggaccgacttcgagaagtgcagcggcgagatcaacatcacctggaactgcaccgggcccttcctgaacctcggcaactgcgagaagaagcagaagaaggagccgtactccaacatcgcgacgcagctgaagggcctggacgccatcagcatcctcgacatccccatgatctcccgcatccccgaggacatcgccggggccctgcggttcatcgaggagcagaacagctaccacgtgcagctgaccgcggagtacgccatgctgacccgctactgcgactactacacccagttctccgacaacagcggctactcccagaagacctggcgggtgtacctccgcagccacgacttcgaggcctgcatcctgtaccccaaccagcacttctgccggtgcgtcaagcacggggacaagtgctccagctccaactgggacttcgccagcgagatgaagaactactacacgggcaagcagctgaagttcaacaaggacctcaacctggccctgatgtccttccaccacgcgttccgcgggaccagcagcttctacgtggccaagctcctgcgcgagaagaacaacgaggagctggtgaactacaccgagaagatcaaggacaagtacccgggcaacgccctcctgaaggccatcatcgactacatcaagtacatgaagaacctgtccgagatgaccaacttcaagcacgacgagatgtgggacgacttcgtcttcaacagcccgcccacgaagtcccccagcgtgcggcgctccgacagcgcctacgacttcaagaacaacatcaactccaaccccagccacatctgccagaacatcaagaccgtgatctgcctctcccccaagagcggcgtctcctacgacagcatcatcgcgtgcggggagccctcccagcccaccatctacaagaagccggagagccgggtgttccagtccaacgccgaccagacccacttctgcctggccgacacgcactgcctggagaactacgagaccgtgggcgaggagatcctcgacgccatcaagaagtccaagtgctgggagaccgacttcaccgagtacatccagttcaagcagagcgacggggtccgcagctgccggatgaaggacagcggcgagtgcacggtgaccacccaccgctggcccatcatcctgtgcgacaacaacaagttctactactccgagctgcagaaggactacgacaaggaccaggacatcgggcacttctgcctcagcccccggtgcaacaccatccgccaccccatcaaccagaagcacatctccaactgcacgtggcaggtcagccacaacaacatcgagaagatcgaggtgcacgagctggagaacctggagcagtacaagaaggccatcacccagaagctccagacctccctgaccctgttcaagtacagcaagacgaagaacctcccgcacatcaagcccatgtacaagtacatcaccatcgagggcaccgagaccgcggagggcatcgagtccgcctacatcgagagcgagatccccgccctggccgggacgtccatcggcttcaagatcaccagcaagtccgggaagcacctcctggacgtgatcggctacgtcaagagcgcgtcctacagcgccgtgtacaccaagctgtacaccacgggcccgaccatcggggtgaacaccaagcacgacgagctgtgcaccggcccctgccccgtgaacgtcccccacgggacgggctggctcaccttcgccaaggagcggacctccagctgggggtgcgaggagttcggctgcctggccatctccgacggctgcgtgttcgggagctgccaggacatcatcaaggaggagctggccgtgtaccgcaaggagaccgaggagacgaccgacgtcgagctctgcctgaccttcgcggacaagacctactgcaccaacctgaacgccatcacgccgatcatcaccgaccagttcgaggtgcagttcaagaccgtggagtcctacagcctcccccggatcatcgccgtccgcaaccacgagatcatggtgggccagatcaacgacatcggggtgtacagcaagggctgcgggaacgtccagaaggtgaacaacaccaactacggcaacggcgtgcccaagttcgactacctgtgccacctggcctcccggaaggaggtcatcgtgcgcaagtgcttcgacaacgactaccaggcctgcaagttcctccagacgcccgcgagctaccggctggaggaggagggcgggtccgtgaccgtcatcgactacaagaagatcctggggaccatcaagatgaaggccatcctcggcgacgtgaagtacaagaccttcgccgacaacgtggacctgacggtcgagggggtgtgcaccggctgcatcaactgcttcgagaacatccactgcgagctgaccatccacagcaccgtggaggcctcctgcccggtcacgagctcctgcaccgtgttccacgaccgcatcctcatcacccccaacgagcacaagtacgccatcaaggtcatctgcgcggagaagcccggccccagcctgcagttcaagatctgcaacgccaagaccgacgccgccatgacgctggcggacgccaagccgatcctcgagctggcccccgtggaccagaccacctacatcaaggagaaggacgtgcggtgcaagacctggatgtgccgcgtccgggacgaggggctccaggtgatcttcgagcccttcaagaacctgttcggctcctacatcgggatcttctacacgttcctgatcaccctgatcgccgtgttcgtcgtgatctacatcgtgctccccatctgcttcaagctgcgcgacaccctgcgccagcacgaggacgcctacaagcgggagatgaagatccgctga

SEQ ID NO: 12639 - RNA, 4323 nt, synthetic construct
  misc_feature 1..4323: note = derived and/or modified CDS sequence (opt1) from TAHV(XJ0708)__HM243138.1__GP
  source 1..4323: mol_type = other RNA
atgatcctggtgctcgtcttcgtggccctgagcgccgcgtcccccgtgtaccagcgctgcttccaggacggcgccatcgtcaagcagagcccgtccaagcaggccgtgaccgaggtgtgcctgaaggacgacgtcagcatgatcaagaccgaggcccggtacttcaagaacgccacggggacctacgcgaacaacgtggccatccgcaagtggctcgtgtccgactggcacgactgccggcccaagaagatcagcggcgggcacatcaacgtcatcgaggtgggcgacgacctgaccctgcacaccgaggcctacgtgtgcaacgccgactgcatcatcggggtcgacaaggagacggcccaggtgcgcctccagaccgacaccaccaaccacttcgagatcgcgggcacgaccgtgaagtccggctggttcaagagcaccacctacatcacgctggaccagacctgcgagcacctgaaggtctcctgcgggcccaagagcatccagttccacgcctgcttcaaccagcacatgtcctgcgtgcggttcctccaccgcaccatcctgcccggcagcatcgcctccagcatctgccagaacgtggagatcatcatcctgaccgtcctcacgctgctgatcttcatcctcctgtccatcctgagcaagacctacatctgctacatcctcatgccgatcttcatccccctggcctacgtgtacggggtgatctacaacaagtcctgcaagaagtgcaagctgtgcggcctcgtctaccaccccttcaccgagtgcgggacccactgcgtgtgcggcgcgcggtacgagacgagcgaccgcatgaagctgcaccgggcctccggcctgtgccccgggtacaagagcctccgcgccgcccgggtgatgtgcaagagcaagggcccggcctccatcctgagcatcatcaccgcggtcctgatcctcaccttcgtgacccccatcaacgccatgatcgccggggagacgcaggagaccttcaagctggaggacctgcccgacgacatgctctccatggccatgaagctgaacatgtactacctgatgtgcatcgtcaactacatcgtgacctggagcttcatcatctgcgccctcatcatcgcgctgatcttcaagaagtaccagcaccgcttcctgaacttctacgccatgtactgccacgagtgcgacatgtaccacgaccggtccggcctcaagtacaacggcgacttcaccaacaagtgccgccagtgcacgtgcgggcagtacgaggacgccgccggcctgctgacccaccggaagacctacaactgcctcgtgcagtacaagagcaagtggctggtcaacttcctgatcgtgtacatcctcctgatgctggtgaaggactccatcctcatcgtccaggccgaggggaccgacttcgacaagtgcagcggcgaggcggggatcatctggaactgcacgggccccttcctgaacctgggcaactgcgagaagaagcagaagaaggagtcctacaacaacatcgccacccagctcaaggggctgaacgccatcagcgtgctggacatcccgatgatctcccgcatccccgaggacatcgccggcgcgctgcggttcatcgaggaccagaacagctaccacgtgcagctcaccgccgagtacgccatgctgacccgctactgcgactactacacgcagttctccgacaacagcgggtactcccagaccacctggcgggtctacctgcgcagccacaacttcgaggcctgcatcctctactccaaccagcacttctgccggtgcgtgaagcacggcgacaagtgcagctccagcaactgggacttcgccaacgagatgaagaactactacagcgggaagcagtccaagttcaacaaggacctgaacctggcgctcatgagcctgcaccacgccttccgcggcacctccagcttctacatcgccaagctgctccgcgagaagaagaacgaggagctgatcaactacgtggaggagatcaagaagaagtaccccggcaacgccctgctcaaggccgtcatcgactacatcaagtacatgaagaacctgaccgagatggcgtccttcaagcacgacgagatgtgggacgagttcgtgtacgagagcccgcccacgcggtcccccagcgcccgccggtccgagagcgagtacgacttcaagaccaacgtgaactccaagcccacccacgtctgcaagaacatcaagaccgtggtgtgcctgagccccaagtccggggtcagctacgactccatcatcgcctgcggcgagccggggcagcccagcgtgtaccgcaagcccgagcagcaggtcttccagtccaacgccgaccagacgcacttctgcctcctggacacccactgcctggagaactacaccaccgtgaacgacgagatcctcgacgccatcaagaagtcccggtgctgggagacggagttcaccgagtacatccagttcaagcagggcgacggggtgcgcagctgccggatgaaggacagcggcgagtgcgcggtggccgccaaccgctggcccatcatcctgtgcgacaacaacaagttctactacagcgagctgcagaaggactacgacaaggaccaggacatcggccacttctgcctctccccgcggtgcaacaccatccgccaccccatcaaccagaagcacatcagcaactgcacctggcaggtctcccacaacaacatcgagaagatcgaggtgcacgagctggagaacctggagcagtacaagaaggccatcacgcagaagctccagaccagcctgaccctgttcaagtactccaagaccaagaacctcccccacatcaagcccatgtacaagtacatcacgatcgaggggaccgagaccgcggagggcatcgagagcgcctacatcgagtccgagatcccggccctggccgggaccagcatcggcttcaagatcacgtccaagagcggcaagcacctcctggacgtgatcgggtacgtcaagtccgccagctactccagcgtgtacacccggctgtacaccaccggccccacgatcgggatcaacacccgccacgacgagctgtgcaccggcccctgcccggtgaacgtcccccacaacaccgggtggctcacgttcgcgaaggagcggacctccagctggggctgcgaggagttcggctgcctggccatctccgacgggtgcgtgttcggcagctgccaggacatcatcaaggaggagctgaccgtgtaccgcaaggagaccgaggagacgaccgacgtcgagctctgcctgaccttcgccgacaagacctactgcacgaacctgaacgccatcacccccatcatcaccgaccagttcgaggtgcagttcaagaccgtggaggcctacagcctcccccggatcatcgcggtccgcaaccacgagatcctggtggggcagatcaacgacctgggcgtgtactccaaggggtgcggcaacgtccagaaggtgaacaagaccaactacggcaacggggtgccgaagttcgactacctctgccacctggccagccggaaggaggtcatcgtgcgcaagtgcttcgacaacgactaccaggcctgcaagttcctgcagacgcccgcctcctaccggctcgaggaggagggcgggaccgtgaccgtcatcgactacaagaagatcctgggcaccatcaagatgaaggccatcctgggggacgtgaagtacaagacgttcgcggacaacgtggacctcaccatcgagggcgtctgcaccggctgcatcaactgcttcgagaacatccactgcgagctgaccatccacagcacggtggaggcctcctgccccatcatcagctcctgcaccgtgttccacgaccgcatcctgatcacccccaacgagcacaagtacgccatcaaggtcatctgcaacgagaagccggggagctccctcagcttccgcgtgtgcaacaccaagacggacgccgcgatgaccctgaccgacgccaagcccatcctggagctcgcccccgtcgaccagaccgcctacatcaaggagaaggacgagcggtgcaagacgtggatgtgccgcgtgcgggacgagggcctccaggtgatcttcgagcccttcaagaacctgttcgggtcctacatcggcatcttctacaccttcatcctgagcctgatcgccatcttcatcatcatctacatcgtcctgccgatctgcttcaagctccgcgacaccctgcggcagcacgaggacgcgtacaagcgcgagatgaagatccggtga

SEQ ID NO: 12640 - RNA, 4323 nt, synthetic construct
  misc_feature 1..4323: note = derived and/or modified CDS sequence (opt1) from TAHV(XJ0710)__HM243141.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtacttcaagaacgccacggggacctacgcgaacaacgtggccatccgcaagtggctggtcagcgactggcacgactgccggcccaagaaggtggccggcgggcacatcaacgtgatcgaggtcggcgacgacctcaccctgcacaccgaggcctacgtgtgcaacgcggactgcacgatcggggtggacaaggagaccgcccaggtccgcctgcagaccgacaccacgaaccacttcgagatcgccggcaccaccgtgaagtccggctggttcaagagcaccacgtacatcaccctcgaccagacctgcgagcacctgaaggtgtcctgcgggcccaagagcgtccagttccacgcctgcttcaaccagcacatgtcctgcgtgcggttcctgcaccgcaccatcctccccggcagcatcgcctccagcatctgccagaacgtggagatcatcatcctgacggtcctgaccctcctgatcttcatcctgctctccatcctgagcaagacctacatctgctacctgctcatgccgatcttcatccccctggcgtacgtgtacggggtgatctacaacaagtcctgcaagaagtgcaagctgtgcggcctcgtctaccaccccttcaccgagtgcgggacgcactgcgtgtgcggcgcccggtacgagaccagcgaccgcatgaagctgcaccgggcctccggcctgtgccccgggtacaagagcctccgcgccgcccgggtgatgtgcaagtccaagggcccggcgagcatcctgagcatcatcaccgccgtcctgatcctcaccttcgtgacgcccatcaacgccatggtcgccggggacacccaggagaccttcaagctggaggacctgcccgacgacatgctctccatggccatgaagatccagatgtactacatcatgtgcatcgtgaactacatcgtgacctggagcttcatcgtctgcgcgctgatcatcgccctgatcttcaagaagtaccagcaccgcttcctcaacttctacgccatgtactgccacgagtgcgacatgtaccacgaccggtccggcctgaagtacaacggcgacttcacgaacaagtgccgccagtgcacgtgcgggcagtacgaggacgccgccggcctgctcacccaccggaagacctacaactgcctggtgcagtacaagagcaagtggctggtgaacttcctcatcatctacatcctgctgatgctcgtcaaggactccgtgctgatcgtgcaggcggaggggatcgacttcgagaagtgcagcggcgagatcaacatcacctggaactgcaccgggcccttcctgaacctcggcaactgcgagaagaagcagaagaaggagccgtactccaacatcgccacccagctgaagggcctggacgccatcagcatcctcgacatccccatgatctcccgcatccccgaggacatcgccggggcgctgcggttcatcgaggagcagaacagctaccacgtccagctgaccgccgagtacgccatgctgacgcgctactgcgactactacacccagttctccgacaacagcggctactcccagaccacctggcgggtgtacctccgcagccacgacttcgaggcctgcatcctgtaccccaaccagcacttctgccggtgcgtgaagcacggggacaagtgctccagctccaactgggacttcgccagcaagatgaagaactactacaccggcaagcagctgaagttcaacaaggacctcaacctggcgctgatgtccttccaccacgccttccgcgggacgagcagcttctacgtcgccaagctcctgcgcgagaagaacaacgacgagctggtgaactacaccgagaagatcaagaacaagtacccgggcaacgccctcctgaaggccatcatcgactacatcaagtacatgaagtccctgagcgagatgaccaacttcaagcacgacgagatgtgggacgacttcgtgttcaactccccgcccaccaagagcccctccgtccggcgcagcgactccgcgtacgacttcaagaacaacatcaacagcaacccctcccacatctgcaagaacatcaagacggtggtgtgcctcagccccaagtccggcgtcagctacgactccatcatcgcctgcggggagcccagccagcccaccatctacaagaagccggagtcccgggtgttccagagcaacgccgaccagacccacttctgcctggccgacacccactgcctggagaactacgagacggtgggcgaggagatcctcgacgccatcaagaagtccaagtgctgggagaccgacttcaccgagtacatccagttcaagcagagcgacggggtccgcagctgccggatgaaggactccggcgagtgcaccgtgacgaccaaccgctggcccatcatcctgtgcgacaacaacaagttctactacagcgagctgcagaaggactacgacaaggaccaggacatcgggcacttctgcctcagcccccggtgcaacaccatccgccaccccatcaaccagaagcacatctccaactgcacctggcaggtctcccacaacaacatcgagaagatcgaggtgcacgagctggagaacctggagcagtacaagaaggcgatcacgcagaagctccagaccagcctgaccctgttcaagtactccaagaccaagaacctcccgcacatcaagcccatgtacaagtacatcacgatcgagggcaccgagaccgccgagggcatcgagagcgcctacatcgagtccgagatccccgccctggcggggaccagcatcggcttcaagatcacgtccaagagcgggaagcacctcctggacgtgatcggctacgtgaagtccgccagctactccgccgtctacaccaagctgtacaccaccggcccgacgatcggggtgaacaccaagcacgacgagctgtgcaccggcccctgccccgtgaacgtcccccacgggaccggctggctcacgttcgccaaggagcggaccagctcctgggggtgcgaggagttcggctgcctggccatcagcgacggctgcgtgttcgggtcctgccaggacatcatcaaggaggagctggcggtgtaccgcaaggagaccgaggaggccaccgacgtcgagctctgcctgacgttcgccgacaagacctactgcaccaacctgaacgccatcaccccgatcatcaccgaccagttcgaggtgcagttcaagacggtggagagctacagcctcccccggatcatcgccgtccgcaaccacgagatcatggtgggccagatcaacgacatcggggtgtactccaagggctgcgggaacgtccagaaggtgaacaacaccaactacggcaacggcgtgcccaagttcgactacctgtgccacctggcgagccggaaggaggtcatcgtgcgcaagtgcttcgacaacgactaccaggcctgcaagttcctccagacccccgcctcctaccggctggaggaggagggcgggagcgtgaccgtcatcgactacaagaagatcctggggacgatcaagatgaaggccatcctcggcgacgtgaagtacaagaccttcgccgacaacgtggacctgaccgtcgagggggtgtgcaccggctgcatcaactgcttcgagaacatccactgcgagctgacgatccactccaccgtggaggcgagctgcccggtcacctccagctgcaccgtgttccacgaccgcatcctcatcacgcccaacgagcacaagtacgccatcaaggtcatctgcgccgagaagcccggcccctccctgcagttcaagatctgcaacgccaagaccgacgcggccatgaccctggccgacgccaagccgatcctcgagctggcccccgtggaccagaccacgtacatcaaggagaaggacgagcggtgcaagacctggatgtgccgcgtgcgggacgaggggctgcaggtcatcttcgagcccttcaagaacctcttcggcagctacatcgggatcttctacaccttcctgatcaccctgatcgcggtgttcatcgtgatctacatcgtcctccccatctgcttcaagctgcgcgacacgctgcgccagcacgaggacgcctacaagcgggagatgaagatccgctga

SEQ ID NO: 12641 - RNA, 4326 nt, synthetic construct
  misc_feature 1..4326: note = derived and/or modified CDS sequence (opt1) from TVTV__AF123491.1__GP
  source 1..4326: mol_type = other RNA
atgatcgtgttcgccctgctcaccatcgtcgccgcgagccccgtgtacaagcgctgcttccaggacggcgccatcgtgcggcaggagtactccaagaacgccgtcaccgaggtgtgcctgaaggacgacgtgagcatgatcaagacggaggccgagtacttcaagaactccaccggggtcttcagcaagaacatcgcctaccgcaagtggctggtgtccgactggaacgagtgccggccgcagaagtccgcgaacggccacatcaacgtgatcgaggtccagcccgacctctccctgcagaccaacagctacgtgtgcgccgcgacctgcgtgatctccatcgacaaggagacggcccaggtccgcctgcagaccgacaccaccaaccacttcgagatcagcgggacgaccgtgaagtccggctggttcaagagcaccacctacctcacgctggaccagacctgcgagcacctgaagatctcctgcgggagcaagtccgtgcagctccacgcctgcttcaaccagcacatgagctgcgtccggttcctgcaccgcaccatcctgcccggcaagcaccggaagtccatctgccagaacatcgagatcatcatcctcaccagcctgtccctgttcatcttcctcttcctgacgatcatcagcaagacctacatctgctacgtgctgatccccatcttcatcccgatcgcctacgtgtacggcttcatctacaacaagagctgcaagaagtgcaagctctgcgggctggtctaccaccccttcaccgagtgcggctcccactgcgtgtgcggggccaagtacgacaccagcgaccgcatgaagatgcaccggtccagcggcctgtgccccgggtacaagtccctccgcgccgcccggagcatgtgcaagtccaagggccccgcgccgatcctgagcctgctctccgccgtgctgatcctgacgttcgtcacccccatcaccgccatcagcctcaaggacgaggagaaggagacctacaagctgcccgagctgcccgacgacaaggtgaacctcgagacgaagatcgacctgtacttccagatgtgcctgatcaactacgccaccacctgggccctcatcttctgcgtgctgatcaccgcgtgcctgttcaagaagctccagcacaagttcctggactactacgccgtctactgccacgagtgcgacatgtaccacgagaagacgtccctgaagtacaacggcgacttcagcaacaagtgccgccagtgcacgtgcgagcagtacgaggacgccaccgggctcctgacccaccggaagtcctacaaccgcctggtgcagtacaaggccaagtggaccctcaacttcctgatcacctacgccatcctggtcatcatcaaggacagcgtgatgatcgtgggcgcgtccaacaccgacgtcaaggactgcctcgaccaggaggagatcacctggaactgcacggggccgttcctgaacatgggccggtgcacccgcccccagaagaaggagaactacggcaacatcgccacccagctgaaggggctcgacgtgctgagcgccctggacatgcccgccgtgggcaagatccccgaggacatcgccggggcgctgtcctacatcgagagcaagaagacctaccacgagcagctcaccctggagttcgccatgctgacgcggtactgcgacttctacaagcagtacgccgacaactccggctacagccagaccacctggcgcgcctacatccggagccacgacttcggggtctgcatcatgtacccgaaccagcacttctgccgctgcgtgaagatgggcgagaagtgcacctccagcaactgggacttcgcgaaccagatggccaactactacaacggcaagcagaaccggttcaacaaggacctcaacctggccctgtacacgatgcaccacgccttccgcgggtccaccagctacctcatctccaaggtgctgcacgagaagaagtacgaccagctgaccaacctcctgacccagctgaagacgaagtaccccggcaacgccctcctgaaggcgctgatcgggtaccagatctacctcaagagcctgtccgagatgagctccttcacccccgacgagctgtgggacgacctccagtacgtccccgccccgaccttcaagcccaacctgggccgcagcggggacaacgagtacaagttcgacaagtcccggatcgtggacccccagaccacgtgcaccagcctgaagggcgtgaactgcctcagcccccgcagccgggcctccgtcagcgacatcatcgcctgcggccaggccacccagccggcgctgttctacgtgcccaacgacaagatccaccagtccaacaccgaccagaaccagtactgcatcggggacagccactgcctgacgaagttcacccccatcaccgaggagctcctggccgccgtgaagaagtccaagtgccaggccttcgacctggacaacatcgtcaagaccagcacgagcaccggcgtgcgctcctgcctcgtgaagaagttcgggaactgcaacaccaccaaccaggtctggcccatcacgatctgcagcgacgaccagtactactacaccgacaccaagcagtcctacgacagctaccaggacatcggccacttctgcctgtccccgcggtgcagcaccatccgctaccccgtgaaccccaagcacctgtccgcctgcacgtggaccgaggagtacaccccggtggacaagatcagcgtcaccaacatcgaggagatcgagcagtacaagaaggcgctcctgcagaagctgcagacggggctcaacatcttcaagtaccggaagacctccaacctgccccacatcaagagcatgtacaagtacatcaccgtgcagggcaccggcacggccgagggggtggagaacgcctacatcgagtccgagatgcccgccctggcgggcagctccagcgggttcaaggtcctctccaaggagggcaaccacctgttcgacgtggtggcctacatcaagagcgcctcctacagcagcgtctacaacaagctgtactccaccggccccaccctcgggatcaacgtgaagcacgacgagaagtgcaccggcccgtgccccgccaacatcccccacaagaccgggtggctgacgttcgcccgcgagcggaccagcacctggggccgcgaggagtacgggtgcctggcgatctccgacggctgcgtgttcggcagctgccaggacatcatcaagcccgagatgaccgtctaccggaagcagacggacgagatcgtgaccgtggagctctgcctgaccttcgtcgacaagacctactgcacggagctgaacgccgtgaccccgatcatctccgacctcttcgaggtgcagttcaagaccgtcgagagctactccctgcccaagatcgtggccatcaagaaccaccagatcttcgtggggcagatcaacgtcatcggcaccaacagcaaggggtgcggcaacgtccaggtgttcaacgggacgaactacggctccggcacgccccgcttcgactacctgtgccacctcgccagccggcgcgaggtgatcatgcggaagtgcttcgacaacgactaccaggcctgcaagttcctgcagcagccctccagcttccgcctggaggaggagggggagaccgtgaccatcatcgactacaagaagatcctcggcaccatcaagatgaaggcgatcttcggggacgtgaagtaccggaccttctccgagaaggtcgacatcaacgccgagggcgtgtgcgccgggtgcatcaactgcttcgagcgcatcaactgcgagttcaccatccacagcaccgtggagacgtcctgcccgctggtcgccgactgccagctgttccacgaccggctcctgatcacccccaacgagcacaagtacgccatcaaggcgatctgcaaggacaagcccagcaacaccctgcgcttctccatctgcaacaccaaggtggaggccacggtgaccatcatcgacgccaagcccatcctcgagctggccccggtcgaccagaccgcgtacatcaaggagaaggacgagcgctgcaagacctggctgtgccgggtgaaggacgagggcgtcgccgtgctcctggagcccttcaagaacctgttcggcagctacatcgggatcttctacggcatcatcctcgtggtcctggccatcctggtgtgcatctacatcgtgctccccgtctgcttcaagatcaaggacacgctgaagaagcacgaggacgcctacaagcgcgagatgaagatccggtga

SEQ ID NO: 12642 - RNA, 4335 nt, synthetic construct
  misc_feature 1..4335: note = derived and/or modified CDS sequence (opt1) from TVTV(AR42)__KX891322.1__GP
  source 1..4335: mol_type = other RNA
atgcgcaacatgatcgtgttcgccctgctcaccatcgtcgccgcgagccccgtgtacaagcggtgcttccaggacggcgccatcgtgcgccaggagtactccaagaacgccgtcaccgaggtgtgcctgaaggacgacgtgagcatgatcaagacggaggccgagtacttcaagaactccaccggggtcttcagcaagaacatcgcctaccggaagtggctggtgtccgactggaacgagtgccgcccgcagaagtccgcgaacggccacatcaacgtgatcgaggtccagcccgacctctccctgcagaccaacagctacgtgtgcgccgcgacctgcgtgatctccatcgacaaggagacggcccaggtccggctgcagaccgacaccaccaaccacttcgagatcagcgggacgaccgtgaagtccggctggttcaagagcaccacctacctcacgctggaccagacctgcgagcacctgaagatctcctgcgggagcaagtccgtgcagctccacgcctgcttcaaccagcacatgagctgcgtccgcttcctgcaccggaccatcctgcccggcaacatcgccaactccatctgccagaacatcgagatcatcatcctcaccagcctgtccctgttcatcttcctcttcctgacgatcatcagcaagacctacatctgctacgtgctgatccccatcttcatcccgatcgcctacgtgtacggcttcatctacaacaagagctgcaagaagtgcaagctctgcgggctggtctaccaccccttcaccgagtgcggctcccactgcgtgtgcggggccaagtacgacaccagcgaccgcatgaagatgcaccggtccagcggcctgtgccccgggtacaagtccctccgcgccgcgcggagcatgtgcaagtccaagggccccgccagcatcctgtccctgctcagcgccgtgctgatcctgacgttcgtcaccccgatcaccgccatctccctcaaggacgaggagaaggagacctacaagctgagcgagctgcccgacgacatggtgaacctcgagaacaagatcgacctgtacttccagatgtgcctgatcaactacgccacgacctgggcgctcatcttctgcgccctgatcaccgcctgcctgttcaagaagctccagcacaagttcctggactactacgccgtgtactgccacgagtgcgacatgtaccacgagcgccggggcctgaagtacaacggggacttctccaacaagtgccgccagtgcacgtgcggccagtacgaggacgccaccgggctcctgacccaccgcaagagctacaactgcctggtccagtacaaggcgaagtggatgctcaacttcctgatcacctacgccatcctggtgatcatcaaggactccgtcatgatcgtgggcgccagcgacaccgacgtgaaggactgcctcgaccaggaggagatcacgtggaactgcaccggccccttcctgaacatggggtcctgcacccggccccagaagaaggagaactacggcaacatcgccacccagctgaaggggctcgacgtcctgagcgccctggacatgccggcggtgggcaagatccccgaggacatcgccggggccctgtcctacatcgagagcaagaagacgtaccacgagcagctcaccctggagttcgccatgctgacccggtactgcgacttctacaagcagtacgcggacaacagcggctactcccagaccacctggcgcgcctacatccggagccacgacttcggcgtgtgcatcatgtaccccaaccagcacttctgccgctgcgtcaagatgggggagaagtgcacgtccagcaactgggacttcgccaaccagatggccaactactacaacggcaagcagaaccggttcaacaaggacctcaacctggccctgtacaccatgcaccacgcgttccgcgggtccaccagctacctcatctccaaggtgctgcacgagaagaagtacgaccagctgaccaacctcctgacgcagctgaagaccaagtaccccggcaacgccctcctgaaggccctgatcgactaccagatctacctcaagagcctgtccgagatgagctccttcaccccggacgagctgtgggacgacctccagtacgtgcccgcccccaccttcaagcccaacctggggcgcagcgaggacaacgagtacaagttcgacaagtcccggatcgtcgacccgcagacgacctgcaccagcctgaagggcgtgaactgcctcagcccccgcagccgggcctccgtgagcgacatcatcgcgtgcggccaggccacccagcccgccctgttctacgtccccaacgacaagatccaccagagcaacacggaccagaaccagtactgcatcggggactcccactgcctgaccaagttcaccccgatcaccgaggagctcctggccgccgtgaagaagtccaagtgccaggcgttcgacctggacgacatcgtgaagacgtcccccagcaccggcgtccgctcctgcctcgtgaagaagttcgggaactgcaacaccaccaaccaggtgtggcccatcacgatctgcagcgacgaccagtactactacaccgacaccaagcagtcctacgacagcaaccaggacatcggccacttctgcctgagcccccggtgcagcaccatccgctacccggtcaaccccaagcacctgtccgcctgcacgtggaccgaggagtacacccccgtggacaagatcagcgtgaccaacatcgaggagatcgagcagtacaagaaggccctcctgcagaagctgcagacggggctcaacatcttcaagtacaagaagacctccaacctgccgcacatcaagcccatgtacaagtacatcaccgtccagggcaccgagacggccgagggcgtggagaacgcgtacatcgagagcgagatgcccgccctggccgggtccagctccggcttcaaggtgctcagcaaggaggggaaccacctgttcgacgtcgtggcctacatcaagtccgccagctacagctccgtgtacaacaagctgtacagcaccggccccaccctcggcatcaacgtcaagcacgacgagaagtgcaccgggccgtgccccgcgaacatcccccacaagacgggctggctgaccttcgcccgggagcgcacctccacctgggggtgcgaggagtacggctgcctggccatcagcgacgggtgcgtgttcggctcctgccaggacatcatcaagcccgagatgaccgtgtaccggaagcagacggacgagatcgtcaccgtggagctctgcctgaccttcgtggacaagacctactgcacggagctgaacgccgtcaccccgatcatcagcgacctcttcgaggtgcagttcaagaccgtggagtcctacagcctgcccaagatcgtcgccatcaagaaccaccagatcttcgtgggccagatcaacgacatcgggacctactccaagggctgcgggaacgtgcaggtcttcaacggcacgaactacgggagcggcacgccccgcttcgactacctgtgccacctcgcgtcccggaaggaggtgatcatgcgcaagtgcttcgacaacgactaccaggcctgcaagttcctgcagcagcccagctccttccggctggaggaggagggcgagaccgtgaccatcatcgactacaagaagatcctcgggaccatcaagatgaaggccatcttcggcgacgtcaagtacaagaccttcagcgagaaggtggacatcaacgccgagggggtgtgcgccggctgcatcaactgcttcgagtccatcaactgcgagttcaccatccacagcaccgtcgagacgtcctgcccgctggtggcggactgccagctgttccacgaccgcctcctgatcacccccaacgagcacaagtacgccatcaaggccatctgcaaggacaagcccagcaacaccctgcggttctccatctgcaacaccaaggtggaggccacggtcaccatcatcgacgcgaagcccatcctcgagctggccccggtggaccagaccgcctacatcaaggagaaggacgagcgctgcaagacctggctgtgccgggtgaaggacgagggggtcgccgtgctcctggagcccttcaagaacctgttcggcagctacatcggcatcttctacgggatcatcctcgtcgtgctggccatcctggtgtgcatctacatcgtcctccccgtgtgcttcaagatccgcgacacgctgaagaagcacgaggacgcgtacaagcgggagatgaagatccgctga

SEQ ID NO: 12643 - RNA, 4335 nt, synthetic construct
  misc_feature 1..4335: note = derived and/or modified CDS sequence (opt1) from TVTV(Eklund)__KR149248.1__GP
  source 1..4335: mol_type = other RNA
atgcgcaacatgatcgtgttcgccctgctcaccatcgtcgccgcgagccccgtgtacaagcggtgcttccaggacggcgccatcgtgcgccaggagtactccaagaacgccgtcaccgaggtgtgcctgaaggacgacgtgagcatgatcaagacggaggccgagtacttcaagaactccaccggggtcttcagcaagaacatcgcctaccggaagtggctggtgtccgactggaacgagtgccgcccgcagaagtccgcgaacggccacatcaacgtgatcgaggtccagcccgacctcagcctgcagaccaacagctacgtgtgcgccgcgacctgcgtgatctccatcgacaaggagacggcccaggtccggctgcagaccgacaccaccaaccacttcgagatcagcgggacgaccgtgaagtccggctggttcaagagcaccacctacctcacgctggaccagacctgcgagcacctgaagatctcctgcgggagcaagtccgtgcagctccacgcctgcttcaaccagcacatgagctgcgtccgcttcctgcaccggaccatcctgcccggcaacatcgccaactccatctgccagaacatcgagatcatcatcctcaccagcctgtccctgttcatcttcctcttcctgacgatcatcagcaagacctacatctgctacgtgctgatccccatcttcatcccgatcgcctacgtgtacggcttcatctacaacaagagctgcaagaagtgcaagctctgcgggctggtctaccaccccttcaccgagtgcggctcccactgcgtgtgcggggccaagtacgacaccagcgaccgcatgaagatgcaccggtccagcggcctgtgccccgggtacaagtccctccgcgccgcgcggagcatgtgcaagtccaagggccccgccagcatcctgtccctgctcagcgccgtgctgatcctgacgttcgtcaccccgatcaccgccatctccctcaaggacgaggagaaggagacctacaagctgagcgagctgcccgacgacatggtgaacctcgagacgaagatcgacctgtacttccagatgtgcctgatcaactacgccaccacctgggcgctcatcttctgcgccctgatcaccgcctgcctgttcaagaagctccagcacaagttcctggactactacgccgtgtactgccacgagtgcgacatgtaccacgagcgccggggcctgaagtacaacggggacttctccaacaagtgccgccagtgcacgtgcggccagtacgaggacgccaccgggctcctgacccaccgcaagagctacaactgcctggtccagtacaaggcgaagtggatgctcaacttcctgatcacctacgccatcctggtgatcatcaaggactccgtcatgatcgtgggcgccagcaacacggacgtgaaggactgcctcgaccaggaggagatcacctggaactgcaccggccccttcctgaacatggggcggtgcacccggccccagaagaaggagaactacggcaacatcgccacgcagctgaaggggctcgacgtcctgtccgccctggacatgccggcggtgggcaagatccccgaggacatcgccggggccctgagctacatcgagtccaagaagacctaccacgagcagctcaccctggagttcgccatgctgacccgctactgcgacttctacaagcagtacgcggacaacagcggctacagccagaccacgtggcgggcctacatccgctcccacgacttcggcgtgtgcatcatgtaccccaaccagcacttctgccggtgcgtcaagatgggggagaagtgcaccagctccaactgggacttcgccaaccagatggccaactactacaacggcaagcagaaccgcttcaacaaggacctcaacctggccctgtacaccatgcaccacgcgttccgcgggagcacctcctacctcatcagcaaggtgctgcacgagaagaagtacgaccagctgacgaacctcctgacccagctgaagaccaagtaccccggcaacgccctcctgaaggccctgatcgactaccagatctacctcaagtccctgagcgagatgtccagcttcaccccggacgagctgtgggacgacctccagtacgtgcccgcccccacgttcaagcccaacctggggcggtccgaggacaacgagtacaagttcgacaagagccgcatcgtcgacccgcagacgacctgcacctccctgaagggcgtgaactgcctcagcccccggtcccgcgccagcgtgtccgacatcatcgcgtgcggccaggccacccagcccgccctgttctacgtccccaacgacaagatccaccagagcaacaccgaccagaaccagtactgcatcggggacagccactgcctgaccaagttcaccccgatcacggaggagctcctggccgccgtgaagaagtccaagtgccaggcgttcgacctggacaacatcgtgaagaccagcccctccaccggcgtccggagctgcctcgtgaagaagttcgggaactgcaacaccacgaaccaggtgtggcccatcaccatctgctccgacgaccagtactactacaccgacaccaagcagagctacgactcctaccaggacatcggccacttctgcctgagcccccgctgctccacgatccggtacccggtcaaccccaagcacctgagcgcctgcacctggaccgaggagtacacccccgtggacaagatctccgtgacgaacatcgaggagatcgagcagtacaagaaggccctcctgcagaagctgcagaccgggctcaacatcttcaagtaccgcaagaccagcaacctgccgcacatcaagcccatgtacaagtacatcaccgtccagggcacggagaccgccgagggcgtggagaacgcgtacatcgagtccgagatgcccgccctggccgggagctccagcggcttcaaggtgctctccaaggaggggaaccacctgttcgacgtcgtggcctacatcaagagcgcctcctacagcagcgtgtacaacaagctgtactccaccggccccaccctcggcatcaacgtcaagcacgacgagaagtgcacggggccgtgccccgcgaacatcccccacaagaccggctggctgaccttcgcccgggagcgcaccagcacctgggggtgcgaggagtacggctgcctggccatctccgacgggtgcgtgttcggcagctgccaggacatcatcaagcccgagatgacggtgtaccggaagcagaccgacgagatcgtcaccgtggagctctgcctgaccttcgtggacaagacgtactgcaccgagctgaacgccgtcaccccgatcatctccgacctcttcgaggtgcagttcaagaccgtggagagctactccctgcccaagatcgtcgccatcaagaaccaccagatcttcgtgggccagatcaacgacatcgggacgtacagcaagggctgcgggaacgtgcaggtcttcaacggcaccaactacgggtccggcacgccccgcttcgactacctgtgccacctcgcgagccggaaggaggtgatcatgcgcaagtgcttcgacaacgactaccaggcctgcaagttcctgcagcagccctccagcttccggctggaggaggagggcgagaccgtgaccatcatcgactacaagaagatcctcgggaccatcaagatgaaggccatcttcggcgacgtcaagtacaagaccttctccgagaaggtggacatcaacgccgagggggtgtgcgccggctgcatcaactgcttcgagagcatcaactgcgagttcaccatccactccacggtcgagaccagctgcccgctggtggcggactgccagctgttccacgaccgcctcctgatcacccccaacgagcacaagtacgccatcaaggccatctgcaaggacaagccctccaacaccctgcggttcagcatctgcaacacgaaggtggaggccaccgtcaccatcatcgacgcgaagcccatcctcgagctggccccggtggaccagaccgcctacatcaaggagaaggacgagcgctgcaagacgtggctgtgccgggtgaaggacgagggggtcgccgtgctcctggagcccttcaagaacctgttcggctcctacatcggcatcttctacgggatcatcctcgtcgtgctggccatcctggtgtgcatctacatcgtcctccccgtgtgcttcaagatcaaggacaccctgaagaagcacgaggacgcgtacaagcgcgagatgaagatccgctga

SEQ ID NO: 12644 - RNA, 4335 nt, synthetic construct
  misc_feature 1..4335: note = derived and/or modified CDS sequence (opt1) from JCV(3324-04)__HM007357.1__GP
  source 1..4335: mol_type = other RNA
atggaggtgctgaacctcatctggctgctgaccctctgcctggccagccccgtcttccagcgctgcttccaggacggcgccatcgtgaagcagaacccgtccaaggaggcggtgaccgaggtctgcctgaaggacgacgtgagcatgatcaagacggaggccaagtacgtgaagaacaccaccgggaccttcgccaacaacatcgccatgcggaagtggctcgtcgccgactggcacgactgccgcccccagaagtccagcggcgggcacatcaacgtgatcgaggtgggcgacgacctgtccctgcacacggagagctacatctgctccgcggactgcgtcatcaccgtggacaaggagaccgcccagatccggctccagaccgacaacacgaaccacttcgaggtggccgggaccaccgtcaagagcggctggttcaagtccaccacgtacatcaccctggaccagacctgcgagcacctgaaggtgagctgcggccccaagtccatccagttccacgcctgcttcaaccagcacatgagctgcgtgcgcttcctccaccggaccatcctgcccgggtccatcgcgaacagcatctgccagaacatcgagatcatcatcctggtcacgctctccctggtgatcttcatcttcctgaccatcgtgagcaagacctacatctgctacctcctgatgccgatcttcatccccatcgccttcatctacggctggatctacaacaagtcctgcaagaagtgcaagctgtgcgggctcgtctaccaccccttcaccgagtgcggcacgcactgcgtgtgcggggcccgctacgagaccagcgaccggatgaagctgcaccgcgcctccggcctgtgccccggctacaagagcctccgggccgcgcgcgtgatgtgcaagagcaaggggccggcctccgtcctgagcatcatgaccgccgtgctgatcctcaccttcgtgacgcccatctccgccatggtcatcggcgagagctccgagatctacaccctggaggacctgcccgacgacatggtgcagatggccgagcggatcaacatctactaccagatcatcatcatcaactacgggatcacctgggcgttcctcctgctgggcctcctgctggcctacttcttccgcaagtaccagcaccggttcctcgacttctacgccatgtactgcgaggagtgcgacatgtaccacgagaaggccggcctgacccactggggcgacttcacgaacaagtgccgccagtgcacgtgcgggcagtacgaggacatcaccgggctgatggtccacaagaagtcctacaactgcctcgtgaagtacaaggccaagtggatccgggacatcctgatcacctacctggtgatcatcctcgtcaaggactccctgctgttcgtgggcgcgaccgggaccgacttcgcgacctgcatcgacgagaagaccgtgacgtggaactgcaccggccccttcctcaacctgggccgctgcgacaagagccagaagaagaccaactacgccgacatcgccaaccagctgaaggggctcggcgtcatctccgtgctggacatcccgatgatcaagaagatgcccgacgagatcagcgggtccctgaagtacatcgacaacctggagacctaccacgagcagctcaccgccgagtacgccttcctgacgcggtactgcgactactacacccagtacaccgacaacagcggctactcccagaccgtgtggcgcacgtacctgcggagccacgacttcggggcctgcgtcgtgtaccccaaccagcacttctgccgctgcgtgaagtacggcgacaagtgcaactccgccaagtgggacttcgccaacgagatgaagaccttctacaccggccagaaggcgaagttcaacaaggacctcaacctggccctgctcgtcctgcacaaggccttccgggggaccggcacggcctacatcgccgaggcgatggcccgcaaggacaacgggagcatggcccacttcgccctggaggtgcgcaagaagttccccaccaacgccctcctggcggccctgatcgactacatcgtgtacctccagtccctggccgagatcagcaccttcgagctggacgaggactgggaggacttcaagtacaagccggagcccaccgagtccacgatccaggcccggagccaccgcgacgaccagtacaacttcaagaacgccgcgagcggctccaacgtcaaggtgtgcaagaacatccagaaggtgctctgcatcagcccccggtcccgcgccaagttcgagaacatcatcgcctgcggggagcacgccaaccccagcgtctacatgatgccgaacgtgtccatctaccagagctccagcgagcggtcccactactgcatcgcggacagccactgcctggaggagtacgaggtggtcgagaccgagctgctcaacgccctgaagaagtccaagtgctgggtgaaggagatggacgacgtgatcctgcacaagcagagcgacggcctccgctcctgccggatgaaggacaccggcaactgcaacgtccaggagaacgactggaacatcgtgctgtgcgagaacgggaactactactacagcgagatccacaaggactacgacaaggaccaggacgtgggccacttctgcctgagcccccgctgcaacaccatccggtaccccatcagcaagcgccacatccggtcctgcaactggcagatcagccacagcacgatcgacaagatcgccgtccaggagctcgccgacatcgagcagtacaagaaggccatctcccagaagctgcagaccagcctgtccatcttcaagtacatcaagaccaagaacctcccccacatcaagccggcgtacaagtacatcaccgtggagggggtggagacggtcgagggcatcgagaacgccttcatcgagagcgagatccccgccctggccggcaccgccatcgggttcaagatcaactcccgcgagggcaactacctgatggacgtgatcgggtacgtcaagagcgcgtcctacagcgccacctacaccaagctctacacgaccggccccaccatcgggatcaacacccggcacgacgagaagtgcacgggcccctgcccggccgtgatcgaccacaaggacggctggctgaccttctccaaggagcgcaccagcacctgggggtgcgaggagttcggctgcctggccgtgtccgacgggtgcgtgttcggcagctgccaggacatcatcaaggacgagctcgccgtctaccggaagacgaccgaggagctgaccaccgtggagctgtgcctcacgttctccgacaagacctactgcaccaacctgaacgcgatcacccccatcatcaccgacaagttcgaggtgcagttcaagacggtcgaggcctacaccctgccccgcatcatcgccgtgaagaaccacgagatcaaggtggggcagatcaacgacctcggcgtctacagcaagggctgcgggaacgtgcagaaggtgaacggcaccaactacgggaacggcgccccgcggttcgactacctgtgccacctggcgtcccgcaaggaggtcatcctccggaagtgcttcgacaacgactaccaggcctgcaagttcctgcagagcccctccagctaccgcctggaggagcaccaggggaccgtgacggtgatcgactacaagaagatcctcggcaccatcaagatgaaggccatcctgggcgacgtcaagtacaagaacttccagtccaacatcgagatcaacgccgaggggacctgcgccggctgcatcaactgcttcgagaacatccactgcgagttcaccatccacacgaccgtggagaccagctgccccatcgtgaccgactgcgtcagcttccacgaccgcatcctgatcacgcccgacgagcacaagtacgcgctcaaggtggtctgccaggacaagccgaaggtgtccctgaagttcaagatctgcaacaccaacatcgacgccagcatgaccatcgtggactccaagcccatcctggagctcgcccccgtcgaccagaccgcctacatccgggagaaggacgagcgctgcaagacgtggatgtgccgggtgcgcgacgaggggttccaggtgatcctggagcccttcaagaacctgttcggcagctacatcgggatcttctacaccggcatcctctccatcatctgcctgctgatcgtcatctacatcatcctcccgatctgcttcaagctgcgggacaccctgcgccagcacgaggacgcctacaagaaggagatgaagatccggtga

SEQ ID NO: 12645 - RNA, 4335 nt, synthetic construct
  misc_feature 1..4335: note = derived and/or modified CDS sequence (opt1) from JCV(61V2235)__U88058.1__GP
  source 1..4335: mol_type = other RNA
atggaggtgctgaacctcatctggctgctggccctctgcagcgcctcccccgtcttccagcgctgcttccaggacggcgcgatcgtgaagcagaacccgagcaaggaggccgtgaccgaggtctgcctgaaggacgacgtgtccatgatcaagaccgaggccaagtacgtgaagaacacgaccgggaccttcgccaacaacatcgccatgcggaagtggctggtcgcggactggcacgactgccgcccccagaagtcctccggcgggcacatcaacgtgatcgaggtgggcgacgacctcagcctgcacaccgagtcctacatctgcagcgccgactgcgtcatcacggtggacaaggagaccgcccagatccggctgcagaccgacaacaccaaccacttcgaggtggccgggacgaccgtcaagtccggctggttcaagagcaccacctacatcacgctcgaccagacctgcgagcacctgaaggtgtcctgcggccccaagagcatccagttccacgcgtgcttcaaccagcacatgtcctgcgtgcgcttcctgcaccggaccatcctccccgggagcatcgccaactccatctgccagaacatcgagatcatcatcctggtcaccctgagcctcgtgatcttcatcttcctgtccatcgtgagcaagacgtacgtctgctacctgctcatgccgatcttcacccccatcgccttcatctacggctgggtgtacaacaagtcctgcaagaagtgcaagctgtgcgggctggtgtaccaccccttcaccgagtgcggcacccactgcgtctgcggggcccgctacgagaacagcgaccggatgaagctccaccgcgccagcggcctgtgccccggctacaagtccctgcgggcggcccgcgtgatgtgcaagagcaaggggccggcctccatcctcagcatcatgacggccatcctgatcctgaccttcgtgacccccatctccgccatggtcatcggcgagagctccgagctctacaccctggacgacctgcccaacgacatggtgcagatggcggagcgggtcaacatctactaccagatcacgatcatcaactacggggtgacctgggccttcttctgcctcggcctgatcctggcctacttcttcaagaagtaccagcacaagttcctcgacttctacgccatgtactgcgaggagtgcgacatgtaccacgagaagtccggcctgacccactggggcgacttcaccaacaagtgccgccagtgcacgtgcgggcagttcgaggacgtggccgggctgatgatccacaagaagtcctacaactgcctcgtcaagtacaaggcgaagtggatccgggacatcctgatcatctacctggccatgatcctcatcaaggacagcctgctgttcgtgggcgccagcgggaccgacttcgccgcctgcatcgacgagaaggtggtcacctggaactgcaccggccccttcctcaacctgggccgctgcgacaagagccagaagaaggcgtcctacgccgggatcgccgaccagctgaagggcctcggggtgatcagcgtgctggacatcccgatgatcaagaacatgcccgacgagatctccggcagcctgaagtacatcgactccctcgagacgtaccacgagcagctgaccgccgagtacgcgttcctgacccggtactgcgactactacacccagtacacggacaagagcgggtactcccagaccgtctggcgcacctacctgcggagccacgacttcggcgcctgcgtggtgtaccccaaccagcacttctgccgctgcgtcaagtacggcgacaagtgcaacagcgccaagtgggacttcgccaacgagatgaagaccttctacaccgggcagaaggtgaagttcaacaaggacctcaacctggccctgctcgtgctgcacaaggcgttccggggcacggggaccgcctacgtcgccgaggccatggcccgcgaggacaacggctccatggcgcacttcgccctggagatccggaagaagttccccaccaacgccctcctggccgccctgatcgactacatcgtgtacctccagagcctgggggagatcgcgaccttcgagctggacgaggactgggaggacttcaagtacaagccggagcccacggagtccacgccccaggtgcgcagccaccgcaacgaccagtacaacttcaagaacgccgagtccaacagcgacaccaaggtctgcaagaacgtgcagaaggtgctctgcatcagcccccggagcaaggccaagttcgagaacatcatcgcctgcggcgagcacgcgaacccgtccgtctacatgatgcccaacgtgagcatctaccagtccaacagcgagcgctcccactactgcatcgccggcagccactgcctggagaagtacgaggtggtcgagaccgagctgctcaacgccctgaagaagtccaagtgctgggccaaggagatggacgacatcatcctgcacaagcagagcgacgggctccggtcctgccgcatcaaggacaccggcaactgcaacgtgcaggagaacgactggaccatcgtgctgtgcgagaacgggaactactactacagcgaggtccacaaggactacgacaaggaccaggacgtgggccacttctgcctgagcccccggtgcaccaccatccgctaccccatctccaagcggcacatcaagaagtgcgagtggcagatcagccactccacgatcgacaagatcagcgtgcaggagctcgccgacatcgagcagtacaagaaggcgatctcccagaagctgcagaccagcctgtccatcttcaagtacgtccgcaccaagaacctcccgcacatcaagcccgcctacaagtacatcaccgtggagggcgtggagacgatcgaggggatcgagaacgccttcatcgagagcgagatccccgccctggccggcaccgcgatcgggttcaagatcaactcccgggagggcaactacctgatggacgtcatcgggtacgtcaagagcgcctcctacagcgccgtgtacaccaagctctacaccacgggccccaccatcggcatcaacaccaagcacgacgagaagtgcaccgggccgtgccccgccatcatcgaccacaaggacggctggctgacgttctccaaggagcgcaccagcacctgggggtgcgaggagttcggctgcctggccgtgtccgacgggtgcgtgttcggcagctgccaggacatcatcaaggacgagctcgcggtgtaccggaagaccacggaggagctgaccaccgtcgagctgtgcctcaccttctccgacaagacgtactgcaccaacctgaacgccatcacccccatcatcaccgacaagttcgaggtgcagttcaagacggtggagagctacaccctgccgcgcgtcatcgccatcaagaaccacgagatcaaggtgggccagatcaacgacctcggggtgtactccaagggctgcgggaacgtccagaaggtgaacggcaccaactacgggaacggcagcccccggttcgactacctgtgccacctggccagccgcaaggaggtgatcctccggaagtgcttcgacaacgactaccaggcgtgcaagttcctgcagtcccccagctcctaccgcctggaggagcaccagggcaccgtcaccgtgatcgactacaagaagatcctcgggacgatcaagatgaaggccatcctgggcgacgtgaagtacaagaactaccagaacaacatcgagatcagcgccgaggggacctgcgccggctgcatcgactgcttcgagaacatccactgcgagttcaccatccacaccacggtcgaggcctcctgccccatcaccaccgagtgcgtgagcttccacgaccggatcctgatcaccccggacgagcacaagtacgcgctcaagatcgtctgccacgacaagcccaaggtgtccctgaagttcaagatctgcaacacgcacgtggacgccgccatgaccatcgtcgacagcaagcccatcctggagctcgcccccgtggaccagaccacctacatccgcgagaaggacgagcggtgcaagacgtggatgtgccgcgtgcgcgacgaggggttccaggtcatcctggagccgttcaagaacctgttcggctcctacatcggcatcttctacaccgggatcctcagcatcatctgcctgctgatcgtggtgtacatcatcctccccatctgcttcaagctgcgggacaccctgcgccagcacgaggacgcctacaagaaggagatgaagatccggtga

SEQ ID NO: 12646 - RNA, 4335 nt, synthetic construct
  misc_feature 1..4335: note = derived and/or modified CDS sequence (opt1) from JCV(61V2235)__HM007351.1__GP
  source 1..4335: mol_type = other RNA
atggaggtgctgaacctcatctggctgctggccctctgcagcgcctcccccgtcttccagcgctgcttccaggacggcgcgatcgtgaagcagaacccgagcaaggaggccgtgaccgaggtctgcctgaaggacgacgtgtccatgatcaagaccgaggccaagtacgtgaagaacacgaccgggaccttcgccaacaacatcgccatgcggaagtggctggtcgcggactggcacgactgccgcccccagaagtcctccggcgggcacatcaacgtgatcgaggtgggcgacgacctcagcctgcacaccgagtcctacatctgcagcgccgactgcgtcatcacggtggacaaggagaccgcccagatccggctgcagaccgacaacaccaaccacttcgaggtggccgggacgaccgtcaagtccggctggttcaagagcaccacctacatcacgctcgaccagacctgcgagcacctgaaggtgtcctgcggccccaagagcatccagttccacgcgtgcttcaaccagcacatgtcctgcgtgcgcttcctgcaccggaccatcctccccgggagcatcgccaactccatctgccagaacatcgagatcatcatcctggtcaccctgagcctcgtgatcttcatcttcctgtccatcgtgagcaagacgtacgtctgctacctgctcatgccgatcttcatccccatcgccttcatctacggctgggtgtacaacaagtcctgcaagaagtgcaagctgtgcgggctggtgtaccaccccttcaccgagtgcggcacccactgcgtctgcggggcccgctacgagaccagcgaccggatgaagctccaccgcgccagcggcctgtgccccggctacaagtccctgcgggcggcccgcgtgatgtgcaagagcaaggggccggcctccatcctcagcatcatgacggccatcctgatcctgaccttcgtgacccccatctccgccatggtcatcggcgagagctccgaggtgtacaccctcgacgacctgcccaacgacatggtccagatggcggagcgggtgaacatctactaccagatcatcatcatcaactacggggtgacgtgggccttcctgctcctgggcctgatcctcgcctacttcttcaagaagtaccagcacaagttcctggacttctacgccatgtactgcgaggagtgcgacatgtaccacgagaagtccggcctgacccactggggcgacttcaccaacaagtgccgccagtgcacgtgcgggcagttcgaggacgtcgccgggctcatgatccacaagaagtcctacaactgcctggtgaagtacaaggcgaagtggatccgggacatcctgatcatctacctcgccatgatcctgatcaaggacagcctcctgttcgtgggcgccagcgggaccgacttcgccgcctgcatcgacgagaaggtcgtgacctggaactgcaccggccccttcctgaacctgggccgctgcgacaagagccagaagaaggcgtcctacgccgggatcgccgaccagctcaagggcctgggggtgatcagcgtcctggacatcccgatgatcaagaacatgcccgacgagatctccggcagcctcaagtacatcgactccctggagacctaccacgagcagctgacggccgagtacgcgttcctgacccggtactgcgactactacacccagtacaccgacaacagcgggtactcccagacggtgtggcgcacctacctccggagccacgacttcggcgcctgcgtggtctaccccaaccagcacttctgccgctgcgtgaagtacggcgacaagtgcaacagcgccaagtgggacttcgccaacgagatgaagaccttctacaccgggcagaaggtgaagttcaacaaggacctgaacctggccctcctggtcctgcacaaggcgttccggggcaccgggacggcctacgtggccgaggccatggcccgcaaggacaacggctccatggcgcacttcgccctcgagatccggaagaagttccccaccaacgccctgctggccgccctcatcgactacatcgtgtacctgcagagcctgggggagatcgcgaccttcgagctcgacgaggactgggaggacttcaagtacaagccggagcccaccgagtccacgccccaggtccgcagccaccgcaacgaccagtacaacttcaagaacgccgagtccaacagcgacaccaaggtgtgcaagaacgtgcagaaggtcctgtgcatcagcccccggagcaaggccaagttcgagaacatcatcgcctgcggcgagcacgcgaacccgtccgtgtacatgatgcccaacgtgagcatctaccagtccaacagcgagcgctcccactactgcatcgccgacagccactgcctggagaagtacgaggtcgtggagaccgagctcctgaacgccctgaagaagtccaagtgctgggccaaggagatggacgacatcatcctccacaagcagagcgacggcctgcggtcctgccgcatcaaggacaccgggaactgcaacgtgcaggagaacgactggacgatcgtcctgtgcgagaacggcaactactactacagcgaggtgcacaaggactacgacaaggaccaggacgtggggcacttctgcctcagcccccggtgcaccaccatccgctaccccatctccaagcggcacatcaagaagtgcgagtggcagatcagccactccaccatcgacaagatcagcgtccaggagctggccgacatcgagcagtacaagaaggcgatctcccagaagctgcagacgagcctctccatcttcaagtacgtgcgcaccaagaacctgccgcacatcaagcccgcctacaagtacatcaccgtggagggcgtcgagaccatcgagggcatcgagaacgccttcatcgagagcgagatccccgccctggccgggacggcgatcggcttcaagatcaactcccgggaggggaactacctcatggacgtgatcggctacgtcaagagcgcctcctacagcgccgtgtacaccaagctgtacaccaccgggcccacgatcggcatcaacaccaagcacgacgagaagtgcaccggcccgtgccccgccatcatcgaccacaaggacgggtggctgaccttctccaaggagcgcacgagcacctggggctgcgaggagttcgggtgcctcgccgtgtccgacggctgcgtgttcgggagctgccaggacatcatcaaggacgagctggcggtctaccggaagaccaccgaggagctgacgaccgtggagctctgcctgaccttctccgacaagacctactgcacgaacctgaacgccatcacccccatcatcaccgacaagttcgaggtgcagttcaagaccgtcgagagctacacgctcccgcgcgtgatcgccatcaagaaccacgagatcaaggtgggccagatcaacgacctgggcgtctactccaaggggtgcggcaacgtgcagaaggtgaacgggaccaactacggcaacgggagcccccggttcgactacctgtgccacctcgccagccgcaaggaggtcatcctgcggaagtgcttcgacaacgactaccaggcgtgcaagttcctgcagtcccccagctcctaccgcctcgaggagcaccagggcaccgtgaccgtgatcgactacaagaagatcctgggcaccatcaagatgaaggccatcctgggggacgtcaagtacaagaactaccagaacaacatcgagatcaacgccgagggcacgtgcgccgggtgcatcgactgcttcgagaacatccactgcgagttcaccatccacaccaccgtggaggccagctgccccatcacgaccgagtgcgtctccttccacgaccggatcctcatcaccccggacgagcacaagtacgcgctgaagatcgtgtgccacgacaagcccaaggtgagcctgaagttcaagatctgcaacaccaacgtcgacgccgccatgacgatcgtggactccaagcccatcctcgagctggcccccgtggaccagaccacctacatccgcgagaaggacgagcggtgcaagacctggatgtgccgcgtccgcgacgagggcttccaggtgatcctggagccgttcaagaacctcttcgggagctacatcggcatcttctacacgggcatcctgtccatcatctgcctgctcatcgtggtctacatcatcctgcccatctgcttcaagctgcgggacaccctccgccagcacgaggacgcctacaagaaggagatgaagatccggtga

SEQ ID NO: 12647 - RNA, 4335 nt, synthetic construct
  misc_feature 1..4335: note = derived and/or modified CDS sequence (opt1) from JCV(61V2235)__KX817316.1__GP
  source 1..4335: mol_type = other RNA
atggaggtgctgaacctcatctggctgctggccctctgcagcgcctcccccgtcttccagcgctgcttccaggacggcgcgatcgtgaagcagaacccgagcaaggaggccgtgaccgaggtctgcctgaaggacgacgtgtccatgatcaagaccgaggccaagtacgtgaagaacacgaccgggaccttcgccaacaacatcgccatgcggaagtggctggtcgcggactggcacgactgccgcccccagaagtcctccggcgggcacatcaacgtgatcgaggtgggcgacgacctcagcctgcacaccgagtcctacatctgcagcgccgactgcgtcatcacggtggacaaggagaccgcccagatccggctgcagaccgacaacaccaaccacttcgaggtggccgggacgaccgtcaagtccggctggttcaagagcaccacctacatcacgctcgaccagacctgcgagcacctgaaggtgtcctgcggccccaagagcatccagttccacgcgtgcttcaaccagcacatgtcctgcgtgcgcttcctgcaccggaccatcctccccgggagcatcgccaactccatctgccagaacatcgagatcatcatcctggtcaccctgagcctcgtgatcttcatcttcctgtccatcgtgagcaagacgtacgtctgctacctgctcatgccgatcttcatccccatcgccttcatctacggctgggtgtacaacaagtcctgcaagaagtgcaagctgtgcgggctggtgtaccaccccttcaccgagtgcggcacccactgcgtctgcggggcccgctacgagaccagcgaccggatgaagctccaccgcgccagcggcctgtgccccggctacaagtccctgcgggcggcccgcgtgatgtgcaagagcaaggggccggcctccatcctcagcatcatgacggccatcctgatcctgaccttcgtgacccccatctccgccatggtcatcggcgagagctccgaggtgtacaccctcgacgacctgcccaacgacatggtccagatggcggagcgggtgaacatctactaccagatcatcatcatcaactacggggtgacgtgggccttcctgctcctgggcctgatcctcgcctacttcttcaagaagtaccagcacaagttcctggacttctacgccatgtactgcgaggagtgcgacatgtaccacgagaagtccggcctgacccactggggcgacttcaccaacaagtgccgccagtgcacgtgcgggcagttcgaggacgtcgccgggctcatgatccacaagaagtcctacaactgcctggtgaagtacaaggcgaagtggatccgggacatcctgatcatctacctcgccatgatcctgatcaaggacagcctcctgttcgtgggcgccagcgggaccgacttcgccgcctgcatcgacgagaaggtcgtgacctggaactgcaccggccccttcctgaacctgggccgctgcgacaagagccacaagaaggcgtcctacgccgggatcgccgaccagctcaagggcctgggggtgatcagcgtcctggacatcccgatgatcaagaacatgcccgacgagatctccggcagcctcaagtacatcgactccctggagacctaccacgagcagctgacggccgagtacgcgttcctgacccggtactgcgactactacacccagtacaccgacaacagcgggtactcccagacggtgtggcgcacctacctccggagccacgacttcggcgcctgcgtggtctaccccaaccagcacttctgccgctgcgtgaagtacggcgacaagtgcaacagcgccaagtgggacttcgccaacgagatgaagaccttctacaccgggcagaaggtgaagttcaacaaggacctgaacctggccctcctggtcctgcacaaggcgttccggggcaccgggacggcctacgtggccgaggccatggcccgcaaggacaacggctccatggcgcacttcgccctcgagatccggaagaagttccccaccaacgccctgctggccgccctcatcgactacatcgtgtacctgcagagcctgggggagatcgcgaccttcgagctcgacgaggactgggagggcttcaagtacaagccggagcccaccgagtccacgccccaggtccgcagccaccgcaacgaccagtacaacttcaagaacgccgagtccaacagcgacaccaaggtgtgcaagaacgtgcagaaggtcctgtgcatcagcccccggagcaaggccaagttcaagaacatcatcgcctgcggcgagcacgcgaacccgtccgtgtacatgatgcccaacgtgagcatctaccagtccaacagcgagcgctcccactactgcatcgccgacagccactgcctggagaagtacgaggtcgtggagaccgagctcctgaacgccctgaagaagtccaagtgctgggccaaggagatggacgacatcatcctccacaagcagagcgacgggctgcggtcctgccgcatcaaggacaccggcaactgcaacgtgcaggagaacgactggacgatcgtcctgtgcgagaacgggaactactactacagcgaggtgcacaaggactacgacaaggaccaggacgtgggccacttctgcctcagcccccggtgcaccaccatccgctaccccatctccaagcggcacatcaagaagtgcgagtggcagatcagccactccaccatcgacaagatcagcgtccaggagctggccgacatcgagcagtacaagaaggcgatctcccagaagctgcagacgagcctctccatcttcaagtacgtgcgcaccaagaacctgccgcacatcaagcccgcctacaagtacatcaccgtggagggcgtcgagaccatcgaggggatcgagaacgccttcatcgagagcgagatccccgccctggccggcacggcgatcgggttcaagatcaactcccgggagggcaactacctcatggacgtgatcgggtacgtcaagagcgcctcctacagcgccgtgtacaccaagctgtacaccaccggccccacgatcggcatcaacaccaagcacgacgagaagtgcaccgggccgtgccccgccatcatcgaccacaaggacggctggctgaccttctccaaggagcgcacgagcacctgggggtgcgaggagttcggctgcctcgccgtgtccgacgggtgcgtgttcggcagctgccaggacatcatcaaggacgagctggcggtctaccggaagaccaccgaggagctgacgaccgtggagctctgcctgaccttctccgacaagacctactgcacgaacctgaacgccatcacccccatcatcaccgacaagttcgaggtgcagttcaagaccgtcgagagctacacgctcccgcgcgtgatcgccatcaagaaccacgagatcaaggtgggccagatcaacgacctgggggtctactccaagggctgcgggaacgtgcagaaggtgaacggcaccaactacgggaacggcagcccccggttcgactacctgtgccacctcgccagccgcaaggaggtcatcctgcggaagtgcttcgacaacgactaccaggcgtgcaagttcctgcagtcccccagctcctaccgcctcgaggagcaccagggcaccgtgaccgtgatcgactacaagaagatcctggggaccatcaagatgaaggccatcctgggcgacgtcaagtacaagaactaccagaacaacatcgagatcaacgccgaggggacgtgcgccggctgcatcgactgcttcgagaacatccactgcgagttcaccatccacaccaccgtggaggccagctgccccatcacgaccgagtgcgtctccttccacgaccggatcctcatcaccccggacgagcacaagtacgcgctgaagatcgtgtgccacgacaagcccaaggtgagcctgaagttcaagatctgcaacaccaacgtcgacgccgccatgacgatcgtggactccaagcccatcctcgagctggcccccgtggaccagaccacctacatccgcgagaaggacgagcggtgcaagacctggatgtgccgcgtccgcgacgaggggttccaggtgatcctggagccgttcaagaacctcttcggcagctacatcggcatcttctacacggggatcctgtccatcatctgcctgctcatcgtggtctacatcatcctgcccatctgcttcaagctgcgggacaccctccgccagcacgaggacgcctacaagaaggagatgaagatccggtga

SEQ ID NO: 12648 - RNA, 4335 nt, synthetic construct
  misc_feature 1..4335: note = derived and/or modified CDS sequence (opt1) from JCV(3573-03)__HM007354.1__GP
  source 1..4335: mol_type = other RNA
atggaggtgctgagcctcatctggctgctgaccctctgctccgccagccccgtcttccagcgctgcttccaggacggcgccatcgtgaagcagaacccgtccaaggaggcggtgaccgaggtctgcctgaaggacgacgtgagcatgatcaagacggaggccaagtacgtgaagaacaccaccgggaccttcgccaacaacatcgccatgcggaagtggctggtcgccgactggcacgactgccgcccccagaagtccagcggcgggcacatcaacgtgatcgaggtgggcgacgacctctccctgcacacggagagctacatctgctccgcggactgcgtcatcaccgtggacaaggagaccgcccagatccggctgcagaccgacaacacgaaccacttcgaggtggccgggaccaccgtcaagagcggctggttcaagtccaccacgtacatcaccctcgaccagacctgcgagcacctgaaggtgagctgcggccccaagtccatccagttccacgcctgcttcaaccagcacatgagctgcgtgcgcttcctgcaccggaccatcctcccctccagcatcgcgaactccatctgccagaacatcgagatcatcatcctggtcacgctgagcctcaccatcttcatcttcctgaccatcgtgtccaagacctacatctgctacctgctcatgccggtgttcatccccatcgccttcgtctacgggtggatctacaacaagagctgcaagaagtgcaagctgtgcggcctggtgtaccaccccttcacggagtgcgggacccactgcgtgtgcggcgcccgctacgagaccagcgaccggatgaagctccaccgcgcctccgggctgtgccccggctacaagagcctgcgggccgcgcgcgtcatgtgcaagtccaagggcccggccagcatcctctccatcatgaccgccgtgctgatcctgacgttcgtgacccccatcagcgccatgatgatcggggagtccagcgaggtctacaccctcgacgacctgcccgacgacatggtgcagatggccgagcgggtcaacatctactaccagatcatcatcatcaactacggcgtgacctgggcgttcctgctcctggggctggtgctcgcctacttcttcaagaagtaccagcacaagttcctggacttctacgccatgtactgcaacgagtgcgacatgtaccacgagaaggccggcctgacgcactggggcgacttcaccaaccgctgccggcagtgcacgtgcgggcagtacgaggacgtcaccggcctcatcgtgcacaagaagtcctacaactgcctggtgaagtacaaggccaagtggatccgcgacatcctgatcacctacctcatcatcatcctggtcaaggacagcctcctgttcgtgggggcgaccggcaccgacttcgccgcctgcatcgacgagaagaccgtgacgtggaactgcaccgggcccttcctgaacctgggccggtgcgacaagtcccagaagaagaccagctacaacgacatcgccaaccagctcaagggcctgggggtcatctccgtgctggacatcccgatgatcaagcgcatgcccgacgagatcagcggctccctcaagtacatcgacaacctggagacctaccacgagcagctgaccgccgagtacgcgttcctgacgcggtactgcgactactacacccagtacaccgacaacagcgggtactcccagaccgtgtggcgcacgtacctccggagccacgacttcggcgcctgcgtcgtgtaccccaaccagcacttctgccgctgcgtgaagtacggggacaagtgcaactccgccaagtgggacttcgccaacgagatgaagaccttctacaccggccagaagatcaagttcaacaaggacctgaacctggcgctcctggtcctgcacaaggccttccggggcaccgggacggcctacatcgccgaggccatggcgcgcaaggacaacggcagcatggcccacttcgccctcgaggtgcgcaagaagttccccaccaacgccctgctggccgcgctcatcgactacatcgtgtacctgcagagcctggccgagatctccaccttcgagctcgacgaggactgggaggacttcaagtacaagccggagcccaccgagagcccctcccaggcccggagccaccgctccgaccagtacaacttcaagaacgccgagagcaactccaacgtcaaggtgtgcaagaacatccagaaggtgctgtgcatcagcccccggtcccgcgccaagttcgagaacatcatcgcgtgcggggagcacgccaacccgagcgtctacatgatgcccaacgtgtccatctaccagagcaactccgagcggagccactactgcatcgccgactcccactgcctggaggactacgagatcgtggagacggagctcctgagcgccctgaagaagtccaagtgctgggcgaaggagatggacgacatcgtcctccacaagcagagcgacggcctgcgcagctgccggatgaaggacaccgggaactgcgacgtgcaggagaacgactggaccatcgtgctgtgcgagaacggcaactactactactccgagatccacaaggactacgacaaggaccaggacgtcggccacttctgcctcagcccccgctgctccaccatccggtaccccatcaacaagcgccacatcaagcggtgcaactggcagatcagccactccacgatcgacaagatcagcgtgcaggagctggccgacatcgagcagtacaagaaggccatctcccagaagctgcagaccagcctctccatcttcaagtacgtgaagaccaagaacctgccgcacatcaagcccgcctacaagtacatcaccgtcgaggggatcgagacggtggagggcatcgagaacgccttcatcgagagcgagatccccgcgctggccgggaccgccatcggcttcaagatcaactcccgcgagggcaactacctcatggacgtgatcgggtacgtcaagagcgcctcctacagcgccacctacaccaagctgtacacgaccggccccaccatcgggatcaacacccggcacgacgagaagtgcacgggcccgtgccccgcggtgatcgaccacaaggacgggtggctgaccttctccaaggagcgcaccagcacctggggctgcgaggagttcggctgcctcgccgtgtccgacgggtgcgtcttcggcagctgccaggacatcatcaaggacgagctggccgtgtaccggaagacgaccgaggagctgaccaccgtggagctctgcctgacgttctccgacaagacctactgcaccaacctgaacgccatcacccccatcatcaccgacaagttcgaggtccagttcaagacggtggagagctacaccctcccgcgcgtgatcgccgtcaagaaccacgagatcaaggtggggcagatcaacgacctgggcgtgtacagcaaggggtgcggcaacgtccagaaggtgaacggcaccaactacgggaacggcatgcccaagttcgactacctgtgccacctcgcgtcccggaaggaggtgatcctgcgcaagtgcttcgacaacgactaccaggcctgcaagttcctgcagagcccctccagctaccggctcgaggagcaccaggggaccgtcacgatcatcgactacaagaagatcctgggcaccatcaagatgaaggccatcctgggggacgtgaagtacaagaactaccagtccaacatcgagatcaacgccgaggggacctgcgcgggctgcatcaactgcttcgagaacatccactgcgagttcaccatccacacgaccgtggaggccagctgccccatcgtcaccgactgcgtgtccttccacgaccgcatcctcatcaccccggacgagcacaagtacgccctgaaggtcgtgtgccaggacaagcccaaggtgagcctgaagttcaagatctgcaacacgaacatcgacgcctccatgaccatcgtcgacagcaagcccatcctcgagctggcccccgtggaccagaccgcgtacatcaaggagaaggacgagcgctgcaagacctggatgtgccgggtgcgcgacgagggcttccaggtcatcctggagccgttcaagaacctcttcggctcctacatcgggatcttctacacgggcatcctgagcgtgatctgcctgctcatcgtgatctacatcatcctgcccatctgcttcaagctgcgggacaccctccgccagcacgaggacgcctacaagaaggagatgaagatccggtga

SEQ ID NO: 12649 - RNA, 4335 nt, synthetic construct
  misc_feature 1..4335: note = derived and/or modified CDS sequence (opt1) from KEYV(KEYV/Ochlerotatus atlanticus/USA/KEYVLK01/2005)__KT630289.1__GP
  source 1..4335: mol_type = other RNA
atgatgatctggatcctgctcaccgtggtcaccgtgacgatcgccaaccccgtgtaccagcgctgcttccaggacggcgccatcgtcaagcagaacccgagcaaggaggcggtgaccgaggtgtgcctgaaggacgacgtctccatgatcaagaccgaggccaagtacgtgaagaacctgaccgggacgttcagcaacaacgtggccatgcggaagtggctcgtcgccgactggcacgactgccgcccccagaagcgggccggcgggcacatcaacgtgatcgaggtgggcgacgacctgtccctgcacaccgagagctacatctgctccgcggactgcgtcatcagcgtggacaaggagaccgcccagatccgcctccagaccgacacgaccaaccacttcgaggtggccgggaccaccgtcaagtccggctggttcaagagcacgacctacatcaccctggaccagacctgcgagcacctgaaggtgtcctgcggccccaagagcatccagttccacgcctgcttcaaccagcacatgtcctgcgtgcggttcctccaccgcacgatcctgcccgggagcatcgcgaactccatctgccagaacatcgagatcatcatcctggtcaccctcaccctgctgatcttcatcctcctgagcatcctgtccaagacctacatctgctacatcctcatgccgatcttcatccccatcgcctacatctacggctgggtgtacaacaagagctgcaagaagtgcaagctgtgcgggctggtgtaccaccccttcacggagtgcggcacccactgcgtctgcggggcccggtacgagacctccgaccgcatgaagctccaccgggccagcggcctgtgccccggctacaagtccctgcgcgccgcgcgggtgatgtgcaagagcaaggggccggccagcatcctctccatcctgaccgccgtgctgatcctcacgttcatcacccccatgaacgccatggtcctgggcagctccgaggaggtgtacaagctggaggacctccccgacgacatgctgaacatggccgagaagatcgacatctactacctgagcatcgtcctcaactactccaccacctgggggctgctgatcctcctgctgatcgtgagctgcctcttcaagaagtaccagcacgtgttcctgaactactacgcgatgtactgccacgagtgcgacatgtaccacgagaagaagaacctggtctacaacggcgacttctccaacaagtgccgccagtgcacgtgcggccagtacgaggacgccaccgggctcatcgtgcaccagaagtcctacaactgcctgatcaagtacaaggccaagtggttcatcaacatcctgatcatctacaccatcctcgtgctgctgaaggactccgtcctcatggccgccgcggagggccccgacttcaacacgtgcatcgagcagcggagcatctccctgaactgcaccgggccgttcatcaacctgggcgggtgcgagaagccccagaagcgcgccagctaccagtccatcgccgagcagctgaaggccatcaacgccatcagcatcctcgacatgcccatgatctccaagatccccgacgacatcagcggcgcgctgcggcacatcgagaacctgaagacctaccacgagcagctcaccgccgagttcgccatgctgacccgctactgcgactactacacgcagttctccgacaacagcggctactcccagaccagctggcggacctacctgcgcagccacgacttcgaggtgtgcatcgcctacccgaaccagcacttctgccggtgcgtgaagaacggggagaagtgcacctccgcgaactgggacttcgccaacgagatgaagaactactacaccggcaagcagatccgcttcgacaaggacctcaacctggccctgacgaccctccacaccgccttccgggggaccagcacgtactacatgtccgacatcctggccgagaccaaggcgaacagcctgcgcgactacgccctcgccctgaagtccaagtaccccggcaacgccctgctcaaggccatcctggacttcatcatgtacctgcagagcctcaacgaggcgaccaagttcaagctgtccagcgactgggaggacttcaagtacaactccgagctggaggcccgcgccctcatgccccgggcccgcagctccggggactacaacttcagcaacgccgagtccaccaacaaggtcaagatctgcaagaacatccagcgggtgatgtgcctgagcccccgctccaaggcgacggtggaggacatcatcgcctgcggcgagcacgagcacccgagcgtctacatggtgcccaacaccaccatctaccagtccaacatcgagcggagccactactgcatcgccgacagccactgcctggaggagtacgagctcgtgcagaacgagctgctgaccgccctcaagaagtccacgtgctggaccggcgagctggagaacgtcatcccccacaagcagagcgacgggatccgctcctgccggaccaagaacaccggccgctgcaacgtgaagggggaggactggacggtgatcctgtgcgagaacgacaagtactactacagcgagctcaacaaggactacgacaaggaccaggacatcggccacgtctgcctgagcccccggtgcaacagcatccgctacccgatcagcccccggcacatcaccaactgcaagtgggagaaccccgcggggaccatctcccgcatcgagacccactccctggccgacatcgagcagtacaagaaggccatcagccagaagctccagaactccctgacgatcttcaagtacgagaagaccaagaacctgccccacatcaagccgatctacaagtacatcaccatcgagggcaccgagacggtggagggcgtggagaacgccttcatcgaggccgagatccccgcgctcgccgggaccagcatcggcttcaaggtcaactcccgggacggggaccacctgatggacatcatcgcctacatcaaggtggccagctactccagcacctacaccaagctgtacacgaccggccccaccatcggcatcaacaccaagcacgacgagaagtgcacggggaactgcccggcccgcctcgagcacaaggtgggctggctgaccttcgcgaaggagcggacctccacctgggggtgcgaggagttcggctgcctggccgtcagcgacgggtgcgtgttcggctcctgccaggacatcatcaaggaggagctcagcgtgtaccgcaaggacacggaggaggtcagcaacgtggagctgtgcctgaccttcgccgacaagacctactgcacctccctcaacgccatcacccccatcatcacggagaagttcgaggtgcagttcaagaccgtcgagagctactccctgccccggatcgtgggcatccgcaaccacgagatccggatcgggcagatcaacgacctgggcagctactccaaggggtgcggcaacgtgcagcgcgtcaacgggaccaactacggcagcggccagcccaagttcgactacctctgccacctggcctcccgcaaggaggtgatcgtgcggaagtgcttcgacaacgactaccaggcgtgcaagttcctgcagaccccgagctcctaccgcctcgaggagcacgaggggacggtcaccatcatcgactacaagaagatcctgggcaccatcaagatgaaggccatcctgggggacgtgcggtacaagaactacgccagcgccatcgacatcaacgcggagggcgtgtgcgccgggtgcatcaactgcttcgagaacatccactgcgagttcaccatccacacgaccatcgaggcctcctgccccatcgagagcgactgcgtctccttccacgaccgcatcctcgtgacccccaacgagcacaagtacgccctgaagctgatctgcgaggacaagcccggcagcaccctcaagttcaagatctgcaacacgaagatcgacgccgcgatgaccctggtggacgccaagccgatcctggagctcgcccccgtcgaccagaccgcctacatccgggagaaggacgagcgctgcaagacctggatgtgccgggtgcgcgacgagggcatcaaggtgctgctggagcccttcaagaacctcttcgggtcctacatcggcatcgtctacagcatcatcctgatcatcatcgccgcgatcatcatcatctacatcatcctgcccatctgcttcaagctccgggacacgctgaagaagcacgaggacgcctaccgcaaggagatgaagatccggtga

SEQ ID NO: 12650 - RNA, 4332 nt, synthetic construct
  misc_feature 1..4332: note = derived and/or modified CDS sequence (opt1) from KEYV(KEYV/Ochlerotatus atlanticus/USA/KEYVLK01/2005)__KT630289.1__GP
  source 1..4332: mol_type = other RNA
atgatctggatcctgctcaccgtggtcaccgtgacgatcgccaaccccgtgtaccagcgctgcttccaggacggcgccatcgtcaagcagaacccgagcaaggaggcggtgaccgaggtgtgcctgaaggacgacgtctccatgatcaagaccgaggccaagtacgtgaagaacctgaccgggacgttcagcaacaacgtggccatgcggaagtggctcgtcgccgactggcacgactgccgcccccagaagcgggccggcgggcacatcaacgtgatcgaggtgggcgacgacctgtccctgcacaccgagagctacatctgctccgcggactgcgtcatcagcgtggacaaggagaccgcccagatccgcctccagaccgacacgaccaaccacttcgaggtggccgggaccaccgtcaagtccggctggttcaagagcacgacctacatcaccctggaccagacctgcgagcacctgaaggtgtcctgcggccccaagagcatccagttccacgcctgcttcaaccagcacatgtcctgcgtgcggttcctccaccgcacgatcctgcccgggagcatcgcgaactccatctgccagaacatcgagatcatcatcctggtcaccctcaccctgctgatcttcatcctcctgagcatcctgtccaagacctacatctgctacatcctcatgccgatcttcatccccatcgcctacatctacggctgggtgtacaacaagagctgcaagaagtgcaagctgtgcgggctggtgtaccaccccttcacggagtgcggcacccactgcgtctgcggggcccggtacgagacctccgaccgcatgaagctccaccgggccagcggcctgtgccccggctacaagtccctgcgcgccgcgcgggtgatgtgcaagagcaaggggccggccagcatcctctccatcctgaccgccgtgctgatcctcacgttcatcacccccatgaacgccatggtcctgggcagctccgaggaggtgtacaagctggaggacctccccgacgacatgctgaacatggccgagaagatcgacatctactacctgagcatcgtcctcaactactccaccacctgggggctgctgatcctcctgctgatcgtgagctgcctcttcaagaagtaccagcacgtgttcctgaactactacgcgatgtactgccacgagtgcgacatgtaccacgagaagaagaacctggtctacaacggcgacttctccaacaagtgccgccagtgcacgtgcggccagtacgaggacgccaccgggctcatcgtgcaccagaagtcctacaactgcctgatcaagtacaaggccaagtggttcatcaacatcctgatcatctacaccatcctcgtgctgctgaaggactccgtcctcatggccgccgcggagggccccgacttcaacacgtgcatcgagcagcggagcatctccctgaactgcaccgggccgttcatcaacctgggcgggtgcgagaagccccagaagcgcgccagctaccagtccatcgccgagcagctgaaggccatcaacgccatcagcatcctcgacatgcccatgatctccaagatccccgacgacatcagcggcgcgctgcggcacatcgagaacctgaagacctaccacgagcagctcaccgccgagttcgccatgctgacccgctactgcgactactacacgcagttctccgacaacagcggctactcccagaccagctggcggacctacctgcgcagccacgacttcgaggtgtgcatcgcctacccgaaccagcacttctgccggtgcgtgaagaacggggagaagtgcacctccgcgaactgggacttcgccaacgagatgaagaactactacaccggcaagcagatccgcttcgacaaggacctcaacctggccctgacgaccctccacaccgccttccgggggaccagcacgtactacatgtccgacatcctggccgagaccaaggcgaacagcctgcgcgactacgccctcgccctgaagtccaagtaccccggcaacgccctgctcaaggccatcctggacttcatcatgtacctgcagagcctcaacgaggcgaccaagttcaagctgtccagcgactgggaggacttcaagtacaactccgagctggaggcccgcgccctcatgccccgggcccgcagctccggggactacaacttcagcaacgccgagtccaccaacaaggtcaagatctgcaagaacatccagcgggtgatgtgcctgagcccccgctccaaggcgacggtggaggacatcatcgcctgcggcgagcacgagcacccgagcgtctacatggtgcccaacaccaccatctaccagtccaacatcgagcggagccactactgcatcgccgacagccactgcctggaggagtacgagctcgtgcagaacgagctgctgaccgccctcaagaagtccacgtgctggaccggcgagctggagaacgtcatcccccacaagcagagcgacgggatccgctcctgccggaccaagaacaccggccgctgcaacgtgaagggggaggactggacggtgatcctgtgcgagaacgacaagtactactacagcgagctcaacaaggactacgacaaggaccaggacatcggccacgtctgcctgagcccccggtgcaacagcatccgctacccgatcagcccccggcacatcaccaactgcaagtgggagaaccccgcggggaccatctcccgcatcgagacccactccctggccgacatcgagcagtacaagaaggccatcagccagaagctccagaactccctgacgatcttcaagtacgagaagaccaagaacctgccccacatcaagccgatctacaagtacatcaccatcgagggcaccgagacggtggagggcgtggagaacgccttcatcgaggccgagatccccgcgctcgccgggaccagcatcggcttcaaggtcaactcccgggacggggaccacctgatggacatcatcgcctacatcaaggtggccagctactccagcacctacaccaagctgtacacgaccggccccaccatcggcatcaacaccaagcacgacgagaagtgcacggggaactgcccggcccgcctcgagcacaaggtgggctggctgaccttcgcgaaggagcggacctccacctgggggtgcgaggagttcggctgcctggccgtcagcgacgggtgcgtgttcggctcctgccaggacatcatcaaggaggagctcagcgtgtaccgcaaggacacggaggaggtcagcaacgtggagctgtgcctgaccttcgccgacaagacctactgcacctccctcaacgccatcacccccatcatcacggagaagttcgaggtgcagttcaagaccgtcgagagctactccctgccccggatcgtgggcatccgcaaccacgagatccggatcgggcagatcaacgacctgggcagctactccaaggggtgcggcaacgtgcagcgcgtcaacgggaccaactacggcagcggccagcccaagttcgactacctctgccacctggcctcccgcaaggaggtgatcgtgcggaagtgcttcgacaacgactaccaggcgtgcaagttcctgcagaccccgagctcctaccgcctcgaggagcacgaggggacggtcaccatcatcgactacaagaagatcctgggcaccatcaagatgaaggccatcctgggggacgtgcggtacaagaactacgccagcgccatcgacatcaacgcggagggcgtgtgcgccgggtgcatcaactgcttcgagaacatccactgcgagttcaccatccacacgaccatcgaggcctcctgccccatcgagagcgactgcgtctccttccacgaccgcatcctcgtgacccccaacgagcacaagtacgccctgaagctgatctgcgaggacaagcccggcagcaccctcaagttcaagatctgcaacacgaagatcgacgccgcgatgaccctggtggacgccaagccgatcctggagctcgcccccgtcgaccagaccgcctacatccgggagaaggacgagcgctgcaagacctggatgtgccgggtgcgcgacgagggcatcaaggtgctgctggagcccttcaagaacctcttcgggtcctacatcggcatcgtctacagcatcatcctgatcatcatcgccgcgatcatcatcatctacatcatcctgcccatctgcttcaagctccgggacacgctgaagaagcacgaggacgcctaccgcaaggagatgaagatccggtga

SEQ ID NO: 12651 - RNA, 4332 nt, synthetic construct
  misc_feature 1..4332: note = derived and/or modified CDS sequence (opt1) from KEYV(KEYV/Ochlerotatus atlanticus/USA/KEYVLK02/2005)__KT630292.1__GP
  source 1..4332: mol_type = other RNA
atgatctggatcctgctcaccgtggtcaccgccacgatcgccaaccccgtgtaccagcgctgcttccaggacggcgcgatcgtgaagcagaacccgagcaaggaggccgtcaccgaggtgtgcctgaaggacgacgtgtccatgatcaagaccgaggccaagtacgtcaagaacctgaccgggacgttcagcaacaacgtggccatgcggaagtggctcgtggccgactggcacgactgccgcccccagaagcgggcgggcgggcacatcaacgtcatcgaggtgggcgacgacctgtccctgcacaccgagagctacatctgctccgccgactgcgtgatcagcgtcgacaaggagaccgcccagatccgcctccagaccgacacgaccaaccacttcgaggtggccgggaccaccgtgaagtccggctggttcaagagcacgacctacatcaccctggaccagacctgcgagcacctgaaggtctcctgcggccccaagagcatccagttccacgcgtgcttcaaccagcacatgtcctgcgtgcggttcctccaccgcacgatcctgcccgggagcatcgccaactccatctgccagaacatcgagatcatcatcctggtgaccctcaccctgctgatcttcatcctcctgagcatcctgtccaagacctacatctgctacatcctcatgccgatcttcatccccatcgcctacatctacggctgggtctacaacaagagctgcaagaagtgcaagctgtgcgggctggtgtaccaccccttcacggagtgcggcacccactgcgtgtgcggggcccggtacgagacctccgaccgcatgaagctccaccgggccagcggcctgtgccccggctacaagtccctgcgcgcggcccgggtcatgtgcaagagcaaggggccggccagcatcctctccatcctgaccgccgtgctgatcctcacgttcatcacccccatgaacgccatggtgctgggcagctccgaggaggtctacaagctggaggacctccccgacgacatgctgaacatggcggagaagatcgacatctactacctgagcatcgtgctcaactactccaccacctgggggctgctgatcctcctgctgatcgtcagctgcctcttcaagaagtaccagcacgtgttcctgaactactacgccatgtactgccacgagtgcgacatgtaccacgagaagaagaacctggtgtacaacggcgacttctccaacaagtgccgccagtgcacgtgcggccagtacgaggacgccaccgggctcatcgtccaccagaagtcctacaactgcctgatcaagtacaaggccaagtggttcatcaacatcctgatcatctacaccatcctcgtgctgctgaaggactccgtgctcatggccgcggccgagggccccgacttcaacacgtgcatcgagcagcggagcatctccctgaactgcaccgggccgttcatcaacctgggcgggtgcgagaagccccagaagcgcgccagctaccagtccatcgccgagcagctgaaggccatcaacgcgatcagcatcctcgacatgcccatgatctccaagatccccgacgacatcagcggcgccctgcggcacatcgagaacctgaagacctaccacgagcagctcaccgccgagttcgccatgctgacccgctactgcgactactacacgcagttctccgacaacagcggctactcccagaccagctggcggacctacctgcgcagccacgacttcgaggtctgcatcgcgtacccgaaccagcacttctgccggtgcgtgaagaacggggagaagtgcacctccgccaactgggacttcgccaacgagatgaagaactactacaccggcaagcagatccgcttcgacaaggacctcaacctggccctgacgaccctccacaccgccttccgggggaccagcacgtactacatgtccgacatcctggcggagaccaaggccaacagcctgcgcgactacgccctcgccctgaagtccaagtaccccggcaacgccctgctcaaggcgatcctggacttcatcatgtacctgcagagcctcaacgaggccaccaagttcaagctgtccagcgactgggaggacttcaagtacaactccgagcccgaggcccgcgccctgatgccccgggcccgcagctccggggactacaacttcagcaacgcggagtccaccaacaaggccaaggtgtgcaagaacatccagcgggtcatgtgcctcagcccgcgctccaaggccacggtggaggacatcatcgcctgcggcgagcacgagcaccccagcgtgtacatggtccccaacaccaccgtgtaccagtccaacatcgagcggagccactactgcatcgcggacagccactgcctggaggagtacgagctggtgcagaacgagctcctgaccgccctgaagaagtccacgtgctggaccggcgagctcgagaacgtcatcccccacaagcagagcgacgggacccgctcctgccggaccaagaacacgggccgctgcaacgtgaagggggaggactggaccgtgatcctgtgcgagaacgacaagtactactacagcgagctgaacaaggactacgacaaggaccaggacatcggccacgtctgcctctccccgcggtgcaacagcatccgctaccccatcagcccccggcacatcaccaactgcaagtgggagaaccccgccgggaccatcagccgcatcgagacgcactccctggccgacatcgagcagtacaagaaggccatcagccagaagctgcagaactccctcaccatcttcaagtacgagaagaccaagaacctgccgcacatcaagcccatctacaagtacatcaccatcgagggcacggagaccgtggagggcgtggagaacgcgttcatcgaggccgagatccccgccctggccgggaccagcatcggcttcaaggtcaactcccgggacggggaccacctcatggacatcatcgcctacatcaaggtggcgagctactccagcacctacacgaagctgtacaccaccggcccgaccatcggcatcaacacgaagcacgacgagaagtgcaccgggaactgccccgcccgcctggagcacaaggtgggctggctcaccttcgccaaggagcggacctccacgtgggggtgcgaggagttcggctgcctggccgtcagcgacgggtgcgtgttcggctcctgccaggacatcatcaaggaggagctgagcgtgtaccgcaaggacaccgaggaggtcaccaacgtggagctctgcctgaccttcgccgacaagacctactgcacgagcctgaacgcgatcacccccatcatcaccgagaagttcgaggtgcagttcaagaccgtcgagtcctacagcctcccccggatcgtgggcatccgcaaccacgagatccggatcgggcagatcaacgacctgggctcctacagcaaggggtgcggcaacgtgcagcgcgtcaacgacacgaactacgggtccggccagccgaagttcgactacctgtgccacctcgccagccgcaaggaggtgatcgtgcggaagtgcttcgacaacgactaccaggcctgcaagttcctgcagaccccctccagctaccgcctggaggagcacgagggcaccgtcaccatcatcgactacaagaagatcctcgggacgatcaagatgaaggccatcctgggcgacgtgcggtacaagaactacgcgtccgccatcgacatcaacgccgagggggtgtgcgccggctgcatcaactgcttcgagaacatccactgcgagttcaccatccacaccaccatcgaggccagctgccccatcgagtccgactgcgtcagcttccacgaccgcatgctggtgacgcccaacgagcacaagtacgcgctcaagctgatctgcgaggacaagccggggtccaccctgaagttcaagatctgcaacaccaagatcgacgccgccatgaccctcgtggacgccaagcccatcctggagctggcccccgtcgaccagacggcgtacatccgggagaaggacgagcgctgcaagacctggatgtgccgggtgcgcgacgagggcatcaaggtgctcctggagcccttcaagaacctgttcggcagctacatcgggatcgtctactccatcatcctcatcatcatcgccgccatcatcatcatctacgtgatcctgccgatctgcttcaagctgcgggacaccctcaagaagcacgaggacgcctaccgcaaggagatgaagatccggtga

SEQ ID NO: 12652 - RNA, 4332 nt, synthetic construct
  misc_feature 1..4332: note = derived and/or modified CDS sequence (opt1) from KEYV(C14031-33)__AF123489.1__GP
  source 1..4332: mol_type = other RNA
atgatctggatcctgctcaccgtggtcaccgtgacgatcgccaaccccgtgtaccagcgctgcttccaggacggcgccatcgtcaagcagaacccgagcaaggaggcggtgaccgaggtgtgcctgaaggacgacgtctccatgatcaagaccgaggccaagtacgtgaagaacctgaccgggacgttcagcaacaacgtggccatgcggaagtggctcgtcgccgactggcacgactgccgcccccagaagcgggccggcgggcacatcaacgtgatcgaggtgggcgacgacctgtccctgcacaccgagagctacatctgctccgcggactgcgtcatcagcgtggacaaggagaccgcccagatccgcctccagaccgacacgaccaaccacttcgaggtggccgggaccaccgtcaagtccggctggttcaagagcacgacctacatcaccctggaccagacctgcgagcggctgaaggtgtcctgcggccccaagagcatccagttccacgcctgcttcaaccagcacatgtcctgcgtgcgcttcctccaccggacgatcctgctggggagcatcgcgaactccatctgccagaacatcgagatcatcatcctcgtcaccctgaccctgctcatcttcatcctgctgagcatcctctccaagacctacatctgctacatcctgatgcccatcagcatcccgatcgcctacatctacggctgggtgtacaacaagtcctgcaagaagtgcaagctgtgcgggctcgtgtaccaccccttcacggagtgcggcacccactgcgtctgcggggcccgctacgagaccagcgaccggatgaagctgcaccgcgcctccggcctgtgccccggctacaagagcctccgggccgcgcgcgtgatgtgcaagagcaaggggcccgcctccatcctgagcatcctgaccgccgtgctcatcctgacgttcatcaccccgatgaacgccatggtcctgggctccagcgaggaggtgtacaagctcgaggacctgcccgacgacatgctgaacatggccgagaagatcgacatctactacctctccatcgtcctgaactacagcaccacctgggggctgctcatcctgctgctcatcgtgtcctgcctgttcaagaagtaccacctggtgttcctcaactactacgcgctgtactgccacgagtgcgacatgtaccacgagaagaagaacctggtctacaacggcgacttcagcaacaagtgcctccagtgcacgtgcggccagtacgaggacgccaccgggctgatcgtgcaccagaagtcctacaactgcctgatcaactacaaggccaagtggttcatcaacatcctcatcatctacaccatcctggtgctgctgaaggacagcgtcctcatggccgccgcggagcggcccgacttcaacacgtgcatcgagcagcgctccatcagcctgaactgcaccggccccttcatcaacctcgggggctgcaagaagccgcagaagcgggcctcctaccagagcatcgccgagcagctgaaggccatcaacgccatctccatcctggacatgcccatgatcagcaagatccccgacgacatctccggggcgctgcgccacatcgagaacctcaagacctaccacgagcagctgaccgccgagttcgccatgctgacccggtactgcgactactacacgcagttcagcgacaactccggctacagccagaccagctggcgcacctacctccggtcccacgacttcgaggtgtgcatcgcctaccccaaccagcacttctgccgctgcgtgaagaacggcgagaagtgcaccagcgcgaactgggacttcgccaacgagatgaagaactactacaccgggaagcagatccggttcgacaaggacctgaacctggccctcacgaccctgcacaccgccttccgcggcacctccacgtactacatgagcgacatcctggccgagaccaaggcgaactccctccgcgactacgccctggccctgaagtccaagtacccggggaacgccctcctgaaggccatcctggacttcatcatgtacctccagcccctgaacgaggcgaccaagttcaagctgtccagcgactgggaggacttcaagtacaactccgagcccgaggcccgggccctcatgccccgcgcccggagctccggcgactacaacttcagcaacgccgagtccaccaacaaggtcaaggtgtgcaagaacatccagcgcgtgatgtgcctgagcccgcggtccaaggcgacggtcgaggacatcatcgcctgcggggagcacgagcaccccagcgtgtacatggtgcccaacaccaccatctaccagtccaacatcgagcgcagccactactgcatcgccgacagccactgcctggaggagtacgagctcgtccagaacgagctgctgaccgccctcaagaagtccacgtgctggaccggcgagctggagaacgtgatcccccacaagcagagcgacggcatccggtcctgccgcaccaagaacaccgggcggtgcaacgtgaagggcgaggactggacggtcatcctgtgcgagaacgacaagtactactacagcgagctcaacaaggactacgacaaggaccaggacatcgggcacgtgtgcctgtccccgcgctgcaacagcatccggtaccccatcagcccccgccacatcaccaactgcaagtgggagaaccccgcgggcaccatcagccggatcgagacccactccctggccgacatcgagcagtacaagaaggccatcagccagaagctccagaactccctgacgatcttcaagtacgagaagaccaagaacctgccgcacatcaagcccatctacaagtacatcaccatcgaggggaccgagacggtggagggcgtcgagaacgccttcatcgaggccgagatccccgcgctcgccggcaccagcatcgggttcaaggtgaactcccgcgacggcgaccacctgatggacatcatcgcctacatcaaggtggccagctactccagcacctacaccaagctgtacacgaccgggccgaccatcggcatcaacaccaagcacgacgagaagtgcacgggcaactgccccgcccggctcgagcacaaggtcgggtggctgaccttcgcgaaggagcgcacctccacctggggctgcgaggagttcgggtgcctggccgtgagcgacggctgcgtgttcgggtcctgccaggacatcatcaaggaggagctcagcgtctaccggaaggacacggaggaggtgaccaacgtggagctgtgcctgaccttcgccgacaagacctactgcaccagcctcaacgccatcacgcccatcatcaccgagaagttcgaggtccagttcaagaccgtggagtcctacagcctgccccgcatcgtgggcatccggaaccacgagatccgcatcggccagatcaacgacctggggtcctacagcaagggctgcgggaacgtccagcgcgtgaacggcaccaactacgggtccggccagccgaagttcgactacctctgccacctggccagccggaaggaggtgatcgtccgcaagtgcttcgacaacgactaccaggcgtgcaagttcctgcagacgccctccagctaccggctcgaggagcacgagggcaccgtgaccatcatcgactacaagaagatcctggggaccatcaagatgaaggccatcctgggcgacgtgcgctacaagaactacgcctccgccatcgacatcaacgcggagggggtctgcgccggctgcatcaactgcttcgagaacatccactgcgagttcacgatccacaccaccatcgaggccagctgccccatcgagtccgactgcgtgagcttccacgaccggatgctcgtgacccccaacgagcacaagtacgccctgaagctgatctgcgaggacaagccggggtccgccctcaagttcaagatctgcaacacgaagatcgacgcggccatgaccctggtcgacgccaagcccatcctggagctcgcccccgtggaccagaccgcctacatccgcgagaaggacgagcggtgcaagacctggatgtgccgcgtgcgggacgagggcatcaaggtcctgctggagcccttcaagaacctcttcggcagctacatcgggatcgtgtactccatcatcctgatcatcatcgcggccatcatcatcatctacatcatcctgccgatctgcttcaagctccgcgacacgctgaagaagcacgaggacgcctaccggaaggagatgaagatccgctga

SEQ ID NO: 12653 - RNA, 4326 nt, synthetic construct
  misc_feature 1..4326: note = derived and/or modified CDS sequence (opt1) from LACV(Human/78)__NC_004109.1__GP
  source 1..4326: mol_type = other RNA
atgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacgtacaactgcctggtgcagtacaaggcgaagtggatgatgaacttcctcatcatctacatcttcctgatcctgatcaaggactccgccatcgtcgtgcaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtga

SEQ ID NO: 12654 - RNA, 4326 nt, synthetic construct
  misc_feature 1..4326: note = derived and/or modified CDS sequence (opt1) from LACV__KP271111.1__GP
  source 1..4326: mol_type = other RNA
atgatccgcatcctggtgctcatcgccgtcaccgccgcgagccccgtgtaccagcggtgcttccaggacggcgccatcgtgaagcagaacccgtccaaggaggccgtcaccgaggtgtgcctgaaggacgacgtgagcatgatcaagacggaggcccgctacgtccggaacgccaccggggtgttctccaacaacgtggcgatccgcaagtggctggtcagcgactggcacgactgccggcccaagaagatcatcggcgggcacatcaacgtgatcgaggtgggcgacgacctctccctgcacaccgagagctacgtctgctccgccgactgcagcatcggggtggacaaggagaccgcccaggtgcgcctgcagacggacaccaccaaccacttcgagatcgccggcaccacggtcaagtccggctggttcaagagcaccacctacatcaccctcgaccagacgtgcgagcacctgaaggtgtcctgcgggcccaagagcgtgcagttccacgcgtgcttcaaccagcacatgtcctgcgtccggttcctgcaccgcaccatcctccccggcagcatcgccaactccatctgccagaacatcgagatcatcatcctggtgaccctgaccctcctgatcttcatcctgctcagcatcctgtccaagacgtacatctgctacctgctcatgccgatcttcatccccatcgcctacatgtacgggatcatctacaacaagagctgcaagaagtgcaagctgtgcggcctggtgtaccaccccttcaccgagtgcgggacccactgcgtctgcggcgcccggtacgacacctccgaccgcatgaagctccaccgggccagcggcctgtgccccgggtacaagagcctgcgcgcggcccgggtgatgtgcaagtccaagggcccggccagcatcctctccatcatcacggccgtgctggtcctgaccttcgtgacccccatcaacagcatggtcctcggggagtccaaggagaccttcgagctggaggagctgcccgacgacatgctcgagatggccagccgcatcaactcctactacttcacgtgcatcctgaactacgcggtgagctggggcctggtgatcatcggcctcctgaccgggctcctgttcaagaagtaccagcaccggttcctgaacgtctacgccatgtactgcgaggagtgcgacatgtaccacgacaagtccggcctgaagcgccacggggacttcaccaacaagtgccggcagtgcacgtgcggccagtacgaggacgccgccgggctcatggcccaccgcaagacctacaactgcctggtgcagtacaaggcgaagtggatgatgaacttcctgatcatctacatcttcctcatcctgatcaaggacagcgccatcgtggtccaggccgccggcaccgacttcacgacctgcctggagaccgagtccatcaactggaactgcaccggccccttcctcaacctggggaactgccagaagcagcagaagaaggagccgtacaccaacatcgccacccagctgaagggcctcaaggcgatcagcgtgctggacatccccatcatcacggggatccccgacgacatcgccggcgccctgcggtacatcgaggagcgcgaggacttccacgtgcagctgaccatcgagtacgccatgctctccaagtactgcgactactacacccagttcagcgacaactccgggtacagccagaccacctggcgggtctacctgcgctcccacgacttcgaggcgtgcatcctgtaccccaaccagcacttctgccgctgcgtgaagaacggcgagaagtgcagctccagcaactgggacttcgccaacgagatgaaggactactacagcggcaagcagacgaagttcgacaaggacctcaacctggccctgaccgccctccaccacgccttccgggggacctccagcgcgtacatcgccaccatgctgtccaagaagtccaacgacgacctgatcgcctacacgaacaagatcaaggccaagttcccgggcaacgccctcctgaaggcgatcatcgactacatcgcctacatgaagtccctgcccgggatggccaacttcaagtacgacgagttctgggacgagctcctgtacaagcccaaccccgccaaggccagcaacctggcgcgcggcaaggagagcagctacaacttcaagctcgccatctccagcaagtccatcaagacctgcaagaacgtgaaggacgtcgcctgcctgagcccgcggtccggggccatctacgcgagcatcatcgcctgcggcgagcccaacggcccctccgtgtaccgcaagcccagcgggggcgtgttccagtccagcaccgaccggagcatctactgcctgctcgactcccactgcctggaggagttcgaggccatcaaccaggaggagctggacgccgtcaagaagtccaagtgctgggagatcgagtacagcgacgtgaagccgctccaggagggggacggcaccaagagctgccgcatgaaggactccggcaactgcaacgtggccacgaaccggtggcccgtcatccagtgcgagaacgacaagttctactacagcgagctgcagaaggactacgacaagacccaggacatcgggcactactgcctgtcccccggctgcaccaccgtgcgctaccccatcaacccgaagcacatcagcaactgcaactggcaggtctcccggagctccatcgcgaagatcgacgtgcacaacatcgaggacatcgagcagtacaagaaggccatcacgcagaagctccagaccagcctgtccctgttcaagtacgccaagaccaagaacctcccccacatcaagcccatctacaagtacatcaccatcgaggggacggagaccgccgagggcatcgagagcgcctacatcgagtccgaggtgccggcgctggccgggaccagcatcggcttcaagatcaactccaaggagggcaagcacctcctggacgtgatcgcctacgtcaagagcgcctcctacagcagcgtgtacgccaagctgtactccaccgggcccacgagcggcatcaacaccaagcacgacgagctgtgcaccgggccctgccccgcgaacatcaaccaccaggtgggctggctcaccttcgccaaggagcgcacgtccagctgggggtgcgaggagttcggctgcctggccgtctccgacggctgcgtgttcgggagctgccaggacatcatcaaggaggagctgtccgtgtaccggaaggagaccgaggaggtcaccgacgtggagctctgcctgaccttcagcgacaagacgtactgcaccaacctgaacccggtgacccccatcatcaccgacctcttcgaggtccagttcaagacggtggagacctactccctgccccgcatcgtggccgtccagaaccacgagatcaagatcggccagatcaacgacctgggggtgtacagcaagggctgcgggaacgtgcagaagatcaacggcaccgtctacggcaacggggtgccccggttcgactacctctgccacctggcgtcccgcaaggaggtgatcgtccggaagtgcttcgacaacgactaccaggcctgcaagttcctgcagagcccggcctcctaccgcctcgaggaggacagcggcaccgtgacgatcatcgactacaagaagatcctggggaccatcaagatgaaggccatcctgggcgacgtgaagtacaagaccttcgccgactccgtcgacatcaccgcggaggggagctgcaccggctgcatcaactgcttcgagaacatccactgcgagctcacgctgcacaccaccatcgaggcctcctgccccatcaagagctcctgcaccgtgttccacgaccggatcctggtgacgcccaacgagcacaagtacgccctcaagatggtctgcaccgagaagcccggcaacaccctgaccatcaaggtgtgcaacacgaagatcgaggccagcatggccctggtggacgcgaagccgatcatcgagctcgcccccgtcgaccagaccgcctacatccgcgagaaggacgagcggtgcaagacctggatgtgccgcgtgcgcgacgaggggctgcaggtcatcctggagcccttcaagaacctcttcggcagctacatcgggatcttctacaccttcatcatctccatcgtggccctgctggtgatcgtctacgtgctcctgcccatctgcttcaagctgcgggacacgctccgcaagcacgaggacgcctacaagcgggagatgaagatccgctga

SEQ ID NO: 12655 - RNA, 4326 nt, synthetic construct
  misc_feature 1..4326: note = derived and/or modified CDS sequence (opt1) from LACV__M87664.1__GP
  source 1..4326: mol_type = other RNA
atgatctgcatcctggtgctcatcaccgtcgccaccgccagccccgtgctgcagcgctgcttccaggacggcgcgatcgtgaagcagaacccgtccaaggaggccttcacggaggtctgcctgaaggacgacgtgagcatgatcaagaccgaggcccggtacgtgcgcaacgccaccggggtcttctccaacaacgtggccatccggaagtggctcgtgagcgcgtggcacgactgccgccccaagaagatcgtcggcgggcacatcaacgtgatcgaggtgggcgacgacctgtccctgcacaccgagagctacgtctgctccgccgactgcacgatcggggtggacaaggagaccgcccaggtgcggctccagaccgacaccacgaaccacttcgagatcgccggcaccaccgtcaagagcggctggttccgctccaccacgtacatcaccctggaccagacctgcgagcacctgaaggtgagctgcgggcccaagtccgtgcagttccacgcgtgcttcaaccagcacatgagctgcgtccggttcctccaccgcaccatcctgccccggtccatcgccaacagcatctgccagaacatcgagatcatcatcctggtgacgctcaccctgctgatcttcatcctcctgtccatcctgagcaagacctacatctgctacctcctgatgccgatcttcatccccatcgcctacatctacggcaccatctacaacaagtcctgcaagaagtgcaagctgtgcgggctcgcccaccaccccttcacggagtgcggcacccactgcgtgtgcggggcccgctacgacaccagcgaccggatgaagctgcaccgcgcgtccggcctgtgccccggctacaagagcctccgggccgcccgcgtcatgtgcaagagcaaggggccggcctccatcctgagcatcatcaccgccgtgctggtgctcacgttcgtcacccccatcaactccatggtgctgggcgagagcaaggagaccttcgagctggaggacctccccgacgacatgctggagatggcgtcccggatcaacagctactacccgacctgcatcctgaactacgccgtctcctgggggctcgtgatcatcggcctgctgatcggcctcctgttcaagaagtaccagcaccgcttcctgaacgtgtacgccatgtactgcgaggagtgcgacatgtaccacgacaagagcggggtcaagcggcacggcgacttcacgaacaagtgccgccagtgcacgtgcgggcagtacgaggacgccgccggcctcatggcgcaccggaagacctacaactgcctggtgcagtacaaggccaagtggatgatgaacttcctgatcatctacatcttcctcatcctgatcaaggactccgccatcgtggtccaggccgccgggaccgacttcacgacctgcctggagaccgagagcatcaactggaactgcaccggccccttcctcaacctgggcaactgccagaagcagcagaagaaggagccctacaccaacatcgcgacccagctgaaggggctcaaggccatctccgtgctggacatccccatcatcaccggcatccccgacgacatcgccggggccctgcgctacatcgaggagaaggaggacttccacgtgcagctgaccatcgagtacgcgatgctcagcaagtactgcgactactacacccagttctccgacaacagcggctactcccagacgacctggcgggtctacctgcgcagccacgacttcgaggcctgcatcctgtacccgaaccagcacttctgccgctgcgtgaagaacggggagaagtgctccagctccaaccgggacttcgccaacgagatgaaggactactacagcggcaagcagaccaagttcgacaaggacctcaacctggccctgaccgccctccacagccaggtgatgcactgctccagcgcgtacatcgccacgatgctgtccaagaagtccaacgacgacctgatcgcctacaccaacaagatcaagaccaagttccccggcaacgccctcctgaaggccatcatcgactacatcgcgtacatgaagtccctgcccgggatggccaacttcaagtacgacgagttctgggacgagctcctgtacaagcccaacccggccaaggccagcaacctggcccgcggcaaggagagcagctacaacttcaagctcgcgatctccagcaagtccatcaagacctgcaagaacgtcaaggacgtggcctgcctgagcccccggtccggggccatctacgccagcatcatcgcgtgcggcgagcccaacgggccctccgtgtaccgcaagccgagcggcggcgtcttccagtccagcacggaccggagcatctactgcctgctcgactcccactgcctggaggagttcgaggccatcagccaggaggagctggacgccgtgaagaagtccaagtgctgggagatcgagtaccccgacgtgaagctcatccaggagggggacggcaccaagagctgccgcatgaaggactccgggaactgcaacgtcgccaccaaccggtggcccgtgacccagtgcgagaacgacaagttctactacagcgacctgcagaaggactacgacaagacgcaggacatcggccactactgcctgtcccccggctgcaccaccgtgcgctacccgatcaaccccaagcacatcagcaactgcaactggcaggtctcccggagctccatcgccgagatcgacgtgcacaacatcgaggacatcgagcagtacaagaaggcgatcacccagaagctccagacgagcctgtccctgttcaagtacgccaagaccaagaacctcccccacatcaagccgatctacaagtacatcaccatgaaggggaccgagacggccgagggcatcgagagcgcctacatcgagtccgaggtgcccgccctggcggggaccagcatcggcttcaagatcaactccaaggaggggaagcacctcctggacgtcatcgcctacgtcaagagcgcctcctacagcagcgtgtacaccaagctgtactccaccggccccacgagcggcatcaacaccaagcacgacgagctgtgcaccgggccctgcccggccaacatcaaccaccaggtgggctggctcaccttcgcccgcgagcggacgtccagctgggggtgcgaggagttcggctgcctggcggtgtccgacgggtgcgtgttcggcagctgccaggacatcatcaaggaggagctgtccgtctaccgcaaggagaccgaggaggtgaccaacgtggagctctgcctgaccttcagcgacaagacgtactgcaccaacctgaaccccgtcacccccatcatcaccgacctcttcgaggtgcagttcaagacggtggagacctactccctgccccggatcgtcgccgtgcagaaccacgagatcaagatcggccagatcaacgacctgggggtgtacagcaagggctgcgggaacgtccagaaggtgaacggcaccatctacgggaacggcgtgccgcgcttcgactacctctgccacctggcctcccggaaggaggtcatcgtgcgcaagtgcttcgacaacgactaccaggcctgcaagttcctgcagagccccgcgtcctaccggctcgaggaggacagcggcaccgtgaccatcatcgactacaagaagatcctggggacgatcaagatgaaggccatcctgggcgacgtcaagtacaagaccttcgccgactccgtggacatcaccgccgaggggagctgcaccggctgcatcaactgcttcgagaacatccactgcgagctcacgctgcacaccaccatcgaggcctcctgccccatcaagagctcctgcaccgtgttccacgaccgcatcctggtcacgcccaacgagcacaagtacgcgctcaagatggtgtgcaccgagaagccggggaacaccctgaccatcaaggtgtgcaacacgaagatcgaggccagcatggccctggtcgacgccaagcccatcatcgagctcgcccccgtggaccagaccgcgtacatccgggagaaggacgagcgctgcaagacctggatgtgccgcgtccgggacgagggcctccaggtgatcctggagcccttcaagaacctgttcggcagctacatcgggatcttctacaccttcatcatctccatcgtggccctgctggtcatcatctacgtgctcctgccgatctgcttcaagctgcgcgacacgctccggaagcacgaggacgcctacaagcgcgagatgaagatccggtga

SEQ ID NO: 12656 - RNA, 4326 nt, synthetic construct
  misc_feature 1..4326: note = derived and/or modified CDS sequence (opt1) from LACV__KP271105.1__GP
  source 1..4326: mol_type = other RNA
atgatccgcatcctggtgctcatcgccgtcaccgccgcgagccccgtgtaccagcggtgcttccaggacggcgccatcgtgaagcagaacccgtccaaggaggccgtcaccgaggtgtgcctgaaggacgacgtgagcatgatcaagacggaggcccgctacgtccggaacgccaccggggtgttctccaacaacgtggcgatccgcaagtggctggtcagcgactggcacgactgccggcccaagaagatcatcggcgggcacatcaacgtgatcgaggtgggcgacgacctctccctgcacaccgagagctacgtctgctccgccgactgcagcatcggggtggacaaggagaccgcccaggtgcgcctgcagacggacaccaccaaccacttcgagatcgccggcaccacggtcaagtccggctggttcaagagcaccacctacatcaccctcgaccagacgtgcgagcacctgaaggtgtcctgcgggcccaagagcgtgcagttccacgcgtgcttcaaccagcacatgtcctgcgtccggttcctgcaccgcaccatcctccccggcagcatcgccaactccatctgccagaacatcgagatcatcatcctggtgaccctgaccctcctgatcttcatcctgctcagcatcctgtccaagacgtacatctgctacctgctcatgccgatcttcatccccatcgcctacatgtacgggatcatctacaacaagagctgcaagaagtgcaagctgtgcggcctggtgtaccaccccttcaccgagtgcgggacccactgcgtctgcggcgcccggtacgacacctccgaccgcatgaagctccaccgggccagcggcctgtgccccgggtacaagagcctgcgcgcggcccgggtgatgtgcaagtccaagggcccggccagcatcctctccatcatcacggccgtgctggtcctgaccttcgtgacccccatcaacagcatggtcctcggggagtccaaggagaccttcgagctggaggagctgcccgacgacatgctcgagatggccagccgcatcaactcctactacttcacgtgcatcctgaactacgcggtgagctggggcctggtgatcatcggcctcctgaccgggctcctgttcaagaagtaccagcaccggttcctgaacgtctacgccatgtactgcgaggagtgcgacatgtaccacgacaagtccggcctgaagcgccacggggacttcaccaacaagtgccggcagtgcacgtgcggccagtacgaggacgccgccgggctcatggcccaccgcaagacctacaactgcctggtgcagtacaaggcgaagtggatgatgaacttcctgatcatctacatcttcctcatcctgatcaaggacagcgccatcgtggtccaggccgccggcaccgacttcacgacctgcctggagaccgagtccatcaactggaactgcaccggccccttcctcaacctggggaactgccagaagcagcagaagaaggagccgtacaccaacatcgccacccagctgaagggcctcaaggcgatcagcgtgctggacatccccatcatcacggggatccccgacgacatcgccggcgccctgcggtacatcgaggagcgcgaggacttccacgtgcagctgaccatcgagtacgccatgctctccaagtactgcgactactacacccagttcagcgacaactccgggtacagccagaccacctggcgggtctacctgcgctcccacgacttcgaggcgtgcatcctgtaccccaaccagcacttctgccgctgcgtgaagaacggcgagaagtgcagctccagcaactgggacttcgccaacgagatgaaggactactacagcggcaagcagacgaagttcgacaaggacctcaacctggccctgaccgccctccaccacgccttccgggggacctccagcgcgtacatcgccaccatgctgtccaagaagtccaacgacgacctgatcgcctacacgaacaagatcaaggccaagttcccgggcaacgccctcctgaaggcgatcatcgactacatcgcctacatgaagtccctgcccgggatggccaacttcaagtacgacgagttctgggacgagctcctgtacaagcccaaccccgccaaggccagcaacctggcgcgcggcaaggagagcagctacaacttcaagctcgccatctccagcaagtccatcaagacctgcaagaacgtgaaggacgtcgcctgcctgagcccgcggtccggggccatctacgcgagcatcatcgcctgcggcgagccctccggccccagcgtgtaccgcaagccctccgggggcgtgttccagagcagcaccgaccggtccatctactgcctgctcgacagccactgcctggaggagttcgaggccatcaaccaggaggagctggacgccgtcaagaagtccaagtgctgggagatcgagtacagcgacgtgaagccgctccaggagggggacggcaccaagtcctgcaagatgaaggacagcggcaactgcaacgtggccacgaaccgctggcccgtcatccagtgcgagaacgacaagttctactactccgagctgcagaaggactacgacaagacccaggacatcgggcactactgcctgagccccggctgcaccaccgtgcggtaccccatcaacccgaagcacatctccaactgcaactggcaggtcagccgctccagcatcgcgaagatcgacgtgcacaacatcgaggacatcgagcagtacaagaaggccatcacgcagaagctccagacctccctgagcctgttcaagtacgccaagaccaagaacctcccccacatcaagcccatctacaagtacatcaccatcgaggggacggagaccgccgagggcatcgagtccgcctacatcgagagcgaggtgccggcgctggccgggacctccatcggcttcaagatcaacagcaaggagggcaagcacctcctggacgtgatcgcctacgtcaagtccgccagctacagctccgtgtacgccaagctgtacagcaccgggcccacgtccggcatcaacaccaagcacgacgagctgtgcaccgggccctgccccgcgaacatcaaccaccaggtgggctggctcaccttcgccaaggagcggacgagctcctgggggtgcgaggagttcggctgcctggccgtcagcgacggctgcgtgttcgggtcctgccaggacatcatcaaggaggagctgagcgtgtaccgcaaggagaccgaggaggtcaccgacgtggagctctgcctgaccttctccgacaagacgtactgcaccaacctgaacccggtgacccccatcatcaccgacctcttcgaggtccagttcaagacggtggagacctacagcctgccccggatcgtggccgtccagaaccacgagatcaagatcggccagatcaacgacctgggggtgtactccaagggctgcgggaacgtgcagaaggtcaacggcaccgtgtacggcaacggggtgccccgcttcgactacctctgccacctggcgagccggaaggaggtcatcgtgcgcaagtgcttcgacaacgactaccaggcctgcaagttcctgcagtccccggccagctaccggctcgaggaggactccggcaccgtgacgatcatcgactacaagaagatcctggggaccatcaagatgaaggccatcctgggcgacgtcaagtacaagaccttcgccgacagcgtggacatcaccgcggaggggtcctgcaccggctgcatcaactgcttcgagaacatccactgcgagctcacgctgcacaccaccatcgaggccagctgccccatcaagtccagctgcaccgtgttccacgaccgcatcctggtcacgcccaacgagcacaagtacgccctcaagatggtgtgcaccgagaagcccggcaacaccctgaccatcaaggtgtgcaacacgaagatcgaggccagcatggccctggtcgacgcgaagccgatcatcgagctcgcccccgtggaccagaccgcctacatccgggagaaggacgagcgctgcaagacctggatgtgccgggtccgcgacgaggggctccaggtgatcctggagcccttcaagaacctgttcggctcctacatcgggatcttctacaccttcatcatcagcatcgtggccctgctggtcatcgtgtacgtgctcctgcccatctgcttcaagctgcgcgacacgctccggaagcacgaggacgcctacaagcgcgagatgaagatccggtga

SEQ ID NO: 12657 - RNA, 4326 nt, synthetic construct
  misc_feature 1..4326: note = derived and/or modified CDS sequence (opt1) from LACV(74-32813)__D10370.1__GP
  source 1..4326: mol_type = other RNA
atgatccgcatgctggtgctcatcgtcgtgaccgccgccagccccgtgtaccagcggtgcttccaggacggcgcgatcgtcaagcagaacccgtccaaggaggccgtgaccgaggtgtgcctgaaggacgacgtcagcatgatcaagacggaggcccgctacgtgaagaacgccaccggggtgttctccaacaacgtcgccatccggaagtggctggtgagcgactggcacgactgccgccccaagaagatcgtgggcgggcacatcaacgtcatcgaggtgggcgacgacctctccctgcacaccgagagctacgtgtgctccgcggactgcaccatcggggtcgacaaggagacggcccaggtgcggctgcagaccgacaccaccaaccacttcgagatcgccggcacgaccgtcaagagcggctggttcaagtccaccacctacatcacgctcgaccagacctgcgagcacctgaaggtgagctgcgcccccaagtccgtgcagttccacgcgtgcttcaaccagcacatgagctgcgtgcgcttcctgcaccggaccatcctccccgggtccatcgccaacagcatctgccagaacatcgagatcatcatcctggtcaccctgacgctcctgatcttcatcctgctctccatcctgagcaagacctacatctgctacctgctcatgccgatcttcatccccatcgcctacatgtacggcgtgatctacaacaagtcctgcaagaagtgcaagctgtgcgggctggtgtaccaccccttcaccgagtgcggcacccactgcgtctgcggggcccgctacgacacgagcgaccggatgaagctccaccgcgcctccggcctgtgccccggctacaagagcctgcgggcggcccgcgtgatgtgcaagagcaaggggccggcctccatcctcagcatcatcaccgccgtcctggtgctgaccttcgtgacccccatcaactccatggtcctcggcgagagcaaggagacgttcgagctggaggagctgcccgacgacatgctcgagatggccctgcggatcaactcctactacttcacgtgcatcctgaactacgcggtgagctgggggctcatcatcgccggcctgctggtgggcctcatcttcaagaagtaccagcaccgcttcctgaacatctacgccatgtactgcgaggagtgcaacatgtaccacgacaagtccgggctgaagcggcacggcgacttcaccaacaagtgccgccagtgcacgtgcgggcagtacgaggacgccaccggcctcatcacccaccggaagacctacaactgcctggtccagtacaaggccaagtggatgatgaacttcctgatcatctacatcttcctcatcctgatcaaggacagcgcgatcgtggggcaggccaccggcaccgacttcacgacctgcctggagaccgagtccatcaactggaactgcaccggccccttcctcaacctggggaactgccagaagcagcagaagaaggagccgtacaccaacatcgccacccagctgaagggcctcaaggccatcagcgtgctggacatccccatcatcacctccatccccgacgacatcgccggggcgctgcgctacatcgaggagaaggaggacttccacgtccagctgaccacggagtacgccatgctcagcaagtactgcgactactacacccagttctccgacaacagcggctactcccagaccacctggcgggtgtacctgcgcagccacgacttcgaggcctgcatcctgtaccccaaccagcacttctgcaagtgcgtgaagaacggggagaagtgctccagctccaactgggacttcgccaacggcatgaagaactactacagcggcaagcaggcgaagttcgacaaggacctcaacctggccctgacggccctccaccacgccttccgggggaccagctccgcctacatcgcggccatgctgagcaagaagtccaacgacgacctgatcgcctacaccaacaagatcaaggccaagttcccgggcaacgccctcctgaaggcgatcatcgactacatcgcctacatgaaggggctgcccgagatggccaacttcaagtacgacgagttctgggacgagctcctgtacaagcccaaccccgccaaggccagcaacctggcgcgcggcaaggagtccagctacaacttcaagctcgccatctccagcaagtccatcaagacctgcaagaacgtcaaggacgtggcctgcctgagcccgcgctccggggccatctacagctccatcatcgcgtgcggcgagcccaacggccccagcgtgtaccggaagccctccgggggcgtcttccagagctccacggaccgcagcatctactgcctgctcgacagccactgcctggaggagttcgaggccatctcccaggaggagctggacgccgtgaagaagtccaagtgctgggagatcgagtacccggacgtgcggcccctccaggagagcgacggggccaagagctgccgcatgaaggactccggcaactgcaacgtcgccaccaaccggtggcccgtgatgcagtgcgagaacgacaagttctactacagcgagctgcagaaggactacgacaagacccaggacatcggccactactgcctgtcccccgggtgcaccacgatccgctacccgatcaaccccaagcacatcagcaactgcaactggcaggtctcccggagctccatcgcgaagatcgacgtgcacaacgtggaggacatcgagcagtacaagaaggccatcacccagaagctccagaccagcctgtccctgttcaagtacgccaagaccaagaacctcccccacatccgcccgatctacaagtacatcacgatgaaggagaccgagaccgccgagggcatcgagagcgcctacatcgagtccgaggtgcccgcgctggccgggaccagcgtcggcttcaagatcaactccaaggaggggaagcacctcctggacgtgatcgcctacgtcaagagcgcctcctacagcagcgtgtacgccaagctgtactccacgggccccaccagcggcatcaacaccaagcacgacgagctgtgcaccgggccctgcccggcgaacatcaaccaccaggtgggctggctcacgttcgcccgggagcgcacctccagctgggggtgcgaggagttcggctgcctggccgtgtccgacgggtgcgtcttcggcagctgccaggacatcatcaaggaggagctgtccgtgtaccggaaggagaccgaggaggtgaccaacgtcgagctctgcctgacgttcagcgacaagacctactgcaccaacctgaaccccgtgacccccatcatcacggacctcttcgaggtgcagttcaagaccgtcgagacctactccctgccccgcatcgtggccgtgcagaaccacgagatcaagatcggccagatcaacgacctgggggtctacagcaagggctgcgggaacgtgcagaaggtgaacggcaccgtctacgggaacggcgtgccgcggttcgactacctctgccacctggcgtcccgcaaggaggtgatcgtccggaagtgcttcgacaacgactaccaggcctgcaagttcctgcagagccccgcctcctaccgcctcgaggaggacagcggcacggtgaccatcatcgactacaagaagatcctggggaccatcaagatgaaggccatcctgggcgacgtgaagtacaagaccttcgccgactccgtcgacatcaccgcggaggggagctgcgccggctgcatcaactgcttccagaacatccactgcgagctcacgctgcacaccaccatcgaggcctcctgccccatcaagagctcctgcaccgtgttccacgaccggatcctggtgacgcccaacgagcacaagtacgccctcaagatcgtctgcaccgagaagccggggaacaccctgaccatcaaggtgtgcaacacgcgcatcgaggccagcatggcgctggtcgacgccaagcccatcatcgagctcgcccccgtggaccagaccgcctacatccgggagaaggacgagcgctgcaagacctggatgtgccgcgtgcgggacgagggcctgcaggtcatcctggagcccttcaagaacctcttcggcagctacatcgggatcttctacaccttcatcatctccatcatcgccctgctggtgatcatctacgtgctcctgccgatctgcttcaagctgcgcgacacgctccggaagcacgacgacgcgtacaagcgcgagatgaagatccggtga

SEQ ID NO: 12658 - RNA, 4326 nt, synthetic construct
  misc_feature 1..4326: note = derived and/or modified CDS sequence (opt1) from LACV(Craig County/VA/2009)__KP226848.1__GP
  source 1..4326: mol_type = other RNA
atgatccgcatcctggtgctcatcgccgtcaccgccgcgagccccgtgtaccagcggtgcttccaggacggcgccatcgtgaagcagaacccgtccaaggaggccgtcaccgaggtgtgcctgaaggacgacgtgagcatgatcaagacggaggcccgctacgtccggaacgccaccggggtgttctccaacaacgtggcgatccgcaagtggctggtcagcgactggcacgactgccggcccaagaagatcatcggcgggcacatcaacgtgatcgaggtgggcgacgacctctccctgcacaccgagagctacgtctgctccgccgactgcaccatcggggtggacaaggagacggcccaggtgcgcctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtccggttcctgcaccgcaccatcctccccggctccatcgccaacagcatctgccagaacatcgagatcatcatcctggtgaccctgacgctcctgatcttcatcctgctctccatcctgagcaagacctacatctgctacctgctcatgccggtgttcatccccatcgcctgcatctacgggatcatctacaacaagtcctgcaagaagtgcaagctgtgcggcctggtctaccaccccttcaccgagtgcgggacccactgcgtgtgcggcgcccggtacgacacgagcgaccgcatgaagctccaccgggcctccggcctgtgccccgggtacaagagcctgcgcgcggcccgggtgatgtgcaagagcaagggcccggcctccatcctcagcatcatcaccgccgtcctggtgctgaccttcgtcacccccatcaactccatggtgctcggggagagcaaggagacgttcgagctggaggagctgcccgacgacatgctcgagatggcctcccgcatcaacagctactacttcacgtgcatcctgaactacgcggtgtcctggggcctggtcatcatcggcctcctgatcgggctgctgttcaagaagtaccagcaccggttcctgaacatctacgccatgtactgcgaggagtgcgacatgtaccacgacaagagcggcctgaagcgccacggggacttcaccaacaagtgccggcagtgcacgtgcggccagtacgaggacgccgccgggctcatggcccaccgcaagacctacaactgcctggtgcagtacaaggcgaagtggatcatgaacttcctgatcatctacatcttcctcatcctgatcaaggactccgccatcgtggtccaggccgccggcaccgacttcacgacctgcctggagaccgagagcatcaactggaactgcaccggccccttcctcaacctggggaactgccagaagcagcagaagaaggagccgtacaccaacatcgccacccagctgaagggcctcaaggcgatctccgtgctggacatccccatcatcacggggatccccgacgacatcgccggcgccctgcggtacatcgaggagcgcgaggacttccacgtgcagctgaccatcgagtacgccatgctcagcaagtactgcgactactacacccagttctccgacaacagcgggtactcccagaccacctggcgggtctacctgcgcagccacgacttcgaggcgtgcatcctgtaccccaaccagcacttctgccgctgcgtgaagaacggcgagaagtgctccagctccaactgggacttcgccaacggcatgaaggactactacagcgggaagcaggccaagttcgacaaggacctcaacctggccctgacggccctccaccacgcgttccggggcaccagctccgcctacatcgccaccatgctgagcaagaagtccaacgacgacctgatcacctacacgaacaagatcaagaccaagttcccggggaacgccctcctgaaggccatcatcgactacatcgcgtacatgaagtccctgcccggcatggccaacttcaagtacgacgagttctgggacgagctcctgtacaagcccaaccccgccaaggccagcaacctggcccgcgggaaggagagctcctacaacttcaagctcgcgatcagctccaagagcatcaagacctgcaagaacgtgaaggacgtcgcctgcctgtccccgcggagcggcgccatctacgcctccatcatcgcgtgcggcgagcccaacgggcccagcgtgtaccgcaagccctccggcggggtgttccagagctccaccgaccggagcatctactgcctgctcgacagccactgcctggaggagttcgaggccatctcccaggaggagctggacgccgtcaagaagtccaagtgctgggagatcgagtacccggacgtgaagcccctccaggagagcgacggcaccaagagctgccgcatgaaggactccggcaactgcaacgtggccaccaaccggtggcccatcatccagtgcgagaacgacaagttctactacagcgagctgcagaaggactacgacaagacccaggacatcgggcactactgcctgtcccccggctgcaccacggtccgctacccgatcaaccccaagcacatcagcaactgcaactggcaggtctcccggagctccatcgccaagatcgacgtgcacaacatcgaggacatcgagcagtacaagaaggcgatcacccagaagctccagaccagcctgtccctgttcaagtacgccaagaccaagaacctcccccacatcaagccgatctacaagtacatcacgatcgaggggaccgagaccgccgagggcatcgagagcgcctacatcgagtccgaggtgcccgccctggcgggggccagcatcggcttcaagatcaactccaaggagggcaagcacctcctcgacgtgatcgcctacgtcaagagcgcctcctacagcagcgtgtacgccaagctgtactccaccgggcccacgagcggcatcaacaccaagcacgacgagctgtgcaccgggccctgcccggcgaacatcaaccaccaggtgggctggctcaccttcgcccgcgagcggacgtccagctgggggtgcgaggagttcggctgcctggccgtgtccgacggctgcgtcttcgggagctgccaggacatcatcaaggaggagctgtccgtgtaccgcaaggagaccgaggaggtgaccgacgtcgagctctgcctgaccttcagcgacaagacgtactgcaccaacctgaaccccgtgacccccatcatcaccgacctcttcgaggtgcagttcaagacggtcgagacctactccctgccccggatcgtggccgtgcagaaccacgagatcaagatcggccagatcaacgacctgggggtctacagcaagggctgcgggaacgtgcagaaggtgaacggcaccgtctacggcaacggggtgccgcgcttcgactacctctgccacctggcgtcccggaaggaggtgatcgtccgcaagtgcttcgacaacgactaccaggcctgcaagttcctgcagagccccgcctcctaccggctcgaggaggacagcggcaccgtgacgatcatcgactacaagaagatcctggggaccatcaagatgaaggccatcctgggcgacgtgaagtacaagaccttcgccgactccgtcgacatcaccgcggaggggagctgcaccggctgcatcaactgcttcgagaacatccactgcgagctcacgctgcacaccaccatcgaggcctcctgccccatcaagagctcctgcaccgtgttccacgaccgcatcctggtgacgcccaacgagcacaagtacgccctcaagatggtctgcaccgagaagccgggcaacaccctgaccatcaaggtgtgcaacacgaagatcgaggccagcatggccctggtggacgcgaagcccatcatcgagctcgcccccgtcgaccagaccgcctacatccgggagaaggacgagcgctgcaagacctggatgtgccgcgtgcgggacgaggggctgcaggtcatcctggagcccttcaagaacctcttcggcagctacatcgggatcttctacaccttcatcatctccatcgtggccatcctggtgatcatctacgtcctgctcccgatctgcttcaagctgcgcgacacgctgcggaagcacgaggacgcctacaagcgcgagatgaagatccggtga

SEQ ID NO: 12659 - RNA, 4326 nt, synthetic construct
  misc_feature 1..4326: note = derived and/or modified CDS sequence (opt1) from LACV(Dallas/TX/2009)__GU591165.1__GP
  source 1..4326: mol_type = other RNA
atgatccgcatcctggtgctcatcgtcgtgaccgccgccagccccgtgtaccagcggtgcttccaggacggcgcgatcgtcaagcagaacccgtccaaggaggccgtgaccgaggtgtgcctgaaggacgacgtcagcatgatcaagacggaggcccgctacgtgaagaacgccaccggggtgttctccaacaacgtcgccatccggaagtggctggtgagcgactggcacgactgccgccccaagaagatcgtgggcgggcacatcaacgtcatcgaggtgggcgacgacctctccctgcacaccgagagctacgtgtgctccgcggactgcaccatcggggtcgacaaggagacggcccaggtgcggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcctgcttcaaccagcacatgagctgcgtgcgcttcctgcaccggaccatcctccccggctccatcgcgaacagcatctgccagaacatcgagatcatcatcctggtcaccctgacgctcctgatcttcatcctgctctccatcctgagcaagacctacatctgctacctgctcatgccgatcttcatccccatggcctacatgtacggggtgatctacaacaagtcctgcaagaagtgcaagctgtgcggcctggtgtaccaccccttcaccgagtgcgggacccactgcgtctgcggcgcccgctacgacacgagcgaccggatgaagctccaccgcgcctccggcctgtgccccgggtacaagagcctgcgggccgcgcgcgtgatgtgcaagagcaagggcccggcctccatcctcagcatcatcaccgccgtcctggtgctgaccttcgtgacccccatcaactccatggtcctcggggagagcaaggagacgttcgagctggaggagctgcccgacgacatgctcgagatggccctgcggatcaactcctactacttcacgtgcatcctgaactacgccgtgagctggggcctcatcatcgcgggcctgctggtggggctcatcttcaagaagtaccagcaccgcttcctgaacatctacgccatgtactgcgaggagtgcgacatgtaccacgacaagtccggcctgaagcggcacggggacttcaccagcaagtgccgccagtgcacgtgcggccagtacgaggacgccaccgggctcatcacccaccggaagacctacaactgcctggtccagtacaaggccaagtggatgatgaacttcctgatcatctacatcttcctcatcctgatcaaggactccgccatcgtggtgcaggcgaccggcaccgacttcacgacctgcctggagaccgagagcatcaactggaactgcaccggccccttcctcaacctggggaactgccagaagcagcagaagaaggagccgtacaccaacatcgccacccagctgaagggcctcaaggccatctccgtcctggacatccccatcatcaccgggatccccgacgacatcgccggcgccctgcgctacatcgaggagaaggaggacttccacgtgcagctgaccacggagtacgcgatgctcagcaagtactgcgactactacacccagttctccgacaacagcgggtactcccagaccacctggcgggtgtacctgcgcagccacgacttcgaggcctgcatcctgtaccccaaccagcacttctgccggtgcgtcaagaacggcgagaagtgctccagctccaactgggacttcgccaacgagatgaagaactactacagcggcaagcaggccaagttcgacaaggacctcaacctggcgctgacggccctccaccacgccttccgcgggaccagctccgcctacatcgccaccatgctgagcaagaagtccaacgacgacctggtggcgtacaccaacaagatcaaggccaagttcccgggcaacgccctcctgaaggccatcatcgactacatcgcctacatgaaggggctgcccgacatggcgaacttcaagtacgacgagttctgggacgagctcctgtacaagcccaaccccgccaaggccagcaacctggcccgcggcaaggagtccagctacaacttcaagctcgccgtgtccagcaagtccatccggacgtgcaagaacgtcaaggacgtggcgtgcctgagcccgcgctccggggccatctacagctccatcatcgcctgcggcgagcccaacggccccagcgtgtaccggaagccctccgggggcgtcttccagagctccaccgaccgcagcatctactgcctgctcgacagccactgcctggaggagttcgaggccatctcccaggaggagctggacgcggtgaagaagtccaagtgctgggagatcgagtacccggacatccggcccctccaggagagcgacgggagcaagtcctgccgcatgaaggacagcggcaactgcaacgtggccaccaaccggtggcccgtcatgcagtgcgagaacgacaagttctactactccgagctgcagaaggactacgacaagacccaggacatcggccactactgcctgagccccgggtgcacgaccatccgctacccgatcaaccccaagcacatctccaactgcaactggcaggtcagccggtccagcatcgccaagatcgacgtgcacaacgtggaggacatcgagcagtacaagaaggccatcacccagaagctccagacctccctgagcctgttcaagtacgccaagacgaagaacctcccccacatcaagccgatctacaagtacatcaccatcgagggcaccgagaccgcggaggggatcgagtccgcctacatcgagagcgaggtgcccgccctggccggcacgtccatcgggttcaagatcaacagcaaggagggcaagcacctcctggacgtgatcgcctacgtcaagtccgcgagctacagctccgtgtacgccaagctgtacagcaccggccccacctccgggatcaacaccaagcacgacgagctgtgcacgggcccctgcccggccaacatcaaccaccaggtggggtggctcaccttcgcccgcgagcggaccagctcctggggctgcgaggagttcgggtgcctggccgtcagcgacggctgcgtgttcggctcctgccaggacatcatcaaggaggagctgagcgtgtaccgcaaggacaccgaggaggtcacgaacgtggagctctgcctgaccttctccgacaagacctactgcaccaacctgaaccccgtgacgcccatcatcaccgacctcttcgaggtccagttcaagaccgtggagacctacagcctgccccggatcgtggcggtccagaaccacgagatcaagatcgggcagatcaacgacctgggcgtgtactccaaggggtgcggcaacgtgcagaaggtcaacgggacggtgtacggcaacggcgtgccgcgcttcgactacctctgccacctggccagccggaaggaggtcatcgtgcgcaagtgcttcgacaacgactaccaggcctgcaagttcctgcagtcccccgccagctaccggctcgaggaggactccgggaccgtgaccatcatcgactacaagaagatcctgggcaccatcaagatgaaggcgatcctgggggacgtcaagtacaagaccttcgccgacagcgtggacatcacggccgagggctcctgcgccgggtgcatcaactgcttcgagaacatccactgcgagctcaccctgcacaccaccatcgaggccagctgccccatcaagtccagctgcacggtgttccacgaccgcatcctggtcacccccaacgagcacaagtacgcgctcaagatggtgtgcaccgagaagccgggcaacaccctgacgatcaaggtctgcaacacccggatcgaggtgagcatggccctggtggacgccaagcccatcatcgagctcgcccccgtcgaccagaccgcctacatccgcgagaaggacgagcgctgcaagacctggatgtgccgggtgcgcgacgagggcctccaggtgatcctggagcccttcaagaacctgttcgggtcctacatcggcatcttctacacgttcatcatcagcatcatcgcgctgctggtcatcatctacgtgctcctgccgatctgcttcaagctgcgggacaccctccgcaagcacgacgacgcctacaagcgggagatgaagatccgctga

SEQ ID NO: 12660 - RNA, 4326 nt, synthetic construct
  misc_feature 1..4326: note = derived and/or modified CDS sequence (opt1) from LACV(Fort Bend County/TX/2009)__GU591168.1__GP
  source 1..4326: mol_type = other RNA
atgatccgcatgctggtgctcatcgtcgtgaccgccgccagccccgtgtaccagcggtgcttccaggacggcgcgatcgtcaagcagaacccgtccaaggaggccgtgaccgaggtgtgcctgaaggacgacgtcagcatgatcaagacggaggcccgctacgtgaagaacgccaccggggtgttctccaacaacgtcgccatccggaagtggctggtgagcgactggcacgactgccgccccaagaagatcgtgggcgggcacatcaacgtcatcgaggtgggcgacgacctctccctgcacaccgagagctacgtgtgctccgcggactgcaccatcggggtcgacaaggagacggcccaggtgcggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcctgcttcaaccagcacatgagctgcgtgcgcttcctgcaccggaccatcctccccggctccatcgcgaacagcatctgccagaacatcgagatcatcatcctggtcaccctgacgctcctgatcttcatcctgctctccatcctgagccgcacctacatctgctacctgctcatgccgatcttcatccccatcgcctacatgtacggggtgatctacaacaagtcctgcaagaagtgcaagctgtgcggcctggtgtaccaccccttcaccgagtgcgggacccactgcgtctgcggcgcccggtacgacacgagcgaccgcatgaagctccaccgggcctccggcctgtgccccgggtacaagagcctgcgcgccgcgcgggtgatgtgcaagagcaagggcccggcctccatcctcagcatcatcaccgccgtcctggtgctgaccttcgtgacccccatcaactccatggtcctcggggagagcaaggagacgttcgagctggaggagctgcccgacgacatgctcgagatggccctgcgcatcaactcctactacttcacgtgcatcctgaactacgccgtgagctggggcctcatcatcgcgggcctgctggtggggctcatcttcaagaagtaccagcaccggttcctgaacatctacgccatgtactgcgaggagtgcgacatgtaccacgacaagtccggcctgaagcgccacggggacttcaccaacaagtgccggcagtgcacgtgcggccagtacgaggacgccgccgggctcatggcccaccgcaagacctacaactgcctggtccagtacaaggcgaagtggatgatgaacttcctgatcatctacatcttcctcatcctgatcaaggacagcgccatcgtggtgcaggccaccggcaccgacttcacgacctgcctggagaccgagtccatcaactggaactgcaccggccccttcctcaacctggggaactgccagaagcagcagaagaaggagccgtacaccaacatcgccacccagctgaagggcctcaaggccatcagcgtcctggacatccccatcatcaccgggatccccgacgacatcgcgggcgccctgcggtacatcgaggagaaggaggacttccacatccagctgaccaccgagtacgccatgctctccaagtactgcgactactacacccagttcagcgacaactccgggtacagccagacgacctggcgcgtgtacctgcggtcccacgacttcgaggcctgcatcctgtaccccaaccagcacttctgccgctgcgtgaagaacggcgagaagtgcagctccagcaactgggacttcgcgaacgagatgaagaactactactccggcaagcaggccaagttcgacaaggacctcaacctggccctgaccgccctccaccacgccttccgcgggaccagcagcgcgtacatcgccacgatgctgtccaagaagtccaacgacgacctgatcgcctacaccaacaagatcaaggccaagttcccgggcaacgccctcctgaaggcgatcatcgactacatcgcctacatgaaggggctgcccgacatggccaacttcaagtacgacgagttctgggacgagctcctgtacaagcccaaccccgccaaggccagcaacctggcgcggggcaaggagagctcctacaacttcaagctcgccatcagctccaagagcatcaagacctgcaagaacgtcaaggacgtggcctgcctgtccccgcgcagcggggccatctactccagcatcatcgcgtgcggcgagcccaacggcccctccgtgtaccggaagcccagcgggggcgtcttccagtccagcaccgaccgctccatctactgcctgctcgacagccactgcctggaggagttcgaggccatcagccaggaggagctggacgccgtgaagaagtccaagtgctgggagatcgagtacccggacgtgcggcccctccaggagagcgacggggccaagtcctgccgcatgaaggacagcggcaactgcaacgtcgccacgaaccggtggcccgtgatgcagtgcgagaacgacaagttctactactccgagctgcagaaggactacgacaagacccaggacatcggccactactgcctgagccccgggtgcaccaccatccgctacccgatcaaccccaagcacatctccaactgcaactggcaggtcagccggtccagcatcgcgaagatcgacgtgcacaacgtggaggacatcgagcagtacaagaaggccatcacgcagaagctccagacctccctgagcctgttcaagtacgccaagaccaagaacctcccccacatcaagccgatctacaagtacatcaccatcgagggcacggagaccgccgaggggatcgagtccgcctacatcgagagcgaggtgcccgcgctggccggcacctccatcgggttcaagatcaacagcaaggagggcaagcacctcctggacgtcatcgcctacgtgaagtccgccagctactccagcgtgtacgccaagctgtacagcaccggccccacgtccgggatcaacaccaagcacgacgagctgtgcaccggcccctgcccggcgaacatcaaccaccaggtcgggtggctcaccttcgcccgcgagcggacgagctcctggggctgcgaggagttcgggtgcctggccgtgagcgacggctgcgtgttcggctcctgccaggacatcatcaaggaggagctgagcgtctaccgcaaggagaccgaggaggtgaccaacgtggagctctgcctgaccttctccgacaagacgtactgcaccagcctgaaccccgtcacccccatcatcaccgacctcttcgaggtgcagttcaagacggtggagacctactccctgccccggatcgtcgccgtgcagaaccacgagatcaagatcgggcagatcaacgacctgggcgtgtacagcaaggggtgcggcaacgtccagaaggtgaacgggaccgtgtacggcaacggcgtcccgcgcttcgactacctctgccacctggcgtcccggaaggaggtgatcgtgcgcaagtgcttcgacaacgactaccaggcctgcaagttcctgcagagccccgcctcctaccggctcgaggaggacagcgggaccgtcacgatcatcgactacaagaagatcctgggcaccatcaagatgaaggccatcctgggggacgtgaagtacaagaccttcgccgactccgtggacatcaccgcggagggcagctgcgccgggtgcatcaactgcttcgagaacatccactgcgagctcaccctgcacacgaccatcgaggcctcctgccccatcaagagctcctgcaccgtcttccacgaccgcatcctggtgacccccaacgagcacaagtacgccctcaagatggtgtgcacggagaagccgggcaacaccctgaccatcaaggtctgcaacacccggatcgaggccagcatggcgctggtggacgccaagcccatcatcgagctcgcccccgtcgaccagacggcctacatccgcgagaaggacgagcgctgcaagacctggatgtgccgggtgcgcgacgagggcctccaggtgatcctggagcccttcaagaacctgttcgggagctacatcggcatcttctacaccttcatcatctccatcatcgccctgctggtcatcatctacgtgctcctgccgatctgcttcaagctgcgggacaccctccgcaagcacgacgacgcgtacaagcgggagatgaagatccgctga

SEQ ID NO: 12661 - RNA, 4326 nt, synthetic construct
  misc_feature 1..4326: note = derived and/or modified CDS sequence (opt1) from LACV(LAC22988-89)__U18980.1__GP
  source 1..4326: mol_type = other RNA
atgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacctacaactgcctggtgcagtacaaggcgaagtggatgatgaacttcctcatcatctacatcttcctgatcctgatcaaggactccgccatcgtcgtgcaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacaacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagatctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccacgaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacccagaagctgcagacgagcctgtccctcttcaagtacgccaagaccaagaacctgccccacatcaagcccatctacaagtacatcaccatcgagggcaccgagacggccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcaccggccccacgagcgggatcaacaccaagcacgacgagctctgcaccggcccctgccccgccaacatcaaccaccaggtggggtggctgaccttcgcgcgcgagcggacgtccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgaccttcagcgacaagacgtactgcaccaacctcaacccggtgacccccatcatcaccgacctgttcgaggtgcagttcaagacggtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggaccgtcacgatcatcgactacaagaagatcctgggcaccatcaagatgaaggccatcctcggggacgtgaagtacaagaccttcgccgactccgtggacatcaccgccgagggcagctgcaccggctgcatcaactgcttcgagaacatccactgcgagctgacgctgcacaccaccatcgaggcgtcctgccccatcaagagctcctgcaccgtcttccacgaccgcatcctcgtgacgcccaacgagcacaagtacgccctgaagatggtgtgcaccgagaagcccgggaacaccctgaccatcaaggtctgcaacacgaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacaccttcatcatcagcatcgtggtgctgctcgtcatcatctacgtgctgctgcccatctgcttcaagctccgcgacacgctgcggaagcacgaggacgcctacaagcgcgagatgaagatccggtga

SEQ ID NO: 12662 - RNA, 4326 nt, synthetic construct
  misc_feature 1..4326: note = derived and/or modified CDS sequence (opt1) from LACV(LAC30928-31)__U18979.1__GP
  source 1..4326: mol_type = other RNA
atgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggaccatctacaacaagtcctgcaagaagtgcaagctgtgcggcctggtctaccaccccttcaccgagtgcgggacgcactgcgtgtgcggcgcccgctacgacaccagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacgcccatcaactccatggtgctcggggagagcaaggagaccttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacctacaactgcctggtgcagtacaaggcgaagtggatgatgaacttcctcatcatctacatcttcctgatcctgatcaaggactccgccatcgtcgtgcaggccgccggcaccgacttcaccacgtgcctcgagaccgagagcatcaactggaactgcaccggccccttcctgaacctggggaactgccagaagcagcagaagaaggagccgtacaccaacatcgccacgcagctcaagggcctgaaggcgatctccgtgctggacgtccccatcatcaccgggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacgtggcgggtgtacctgcgcagccacgacttcgaggcgtgcatcctctaccccaaccagcacttctgccggtgcgtcaagaacggcgagaagtgctccagctccaaccgcgacttcgccaacgagatgaaggactactacagcggcaagcagaccaagttcgacaaggacctgaacctggccctcaccgccctgcaccacgccttccgcgggaccagctccgcgtacatcgccacgatgctgagcaagaagtccaacgacgacctcatcgcctacaccaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccggggcaaggagagctcctacaacttcaagctggcgatcagctccaagagcatcaagatctgcaagaacgtgaaggacgtggcctgcctgtccccgcgcagcggggccatctacgcctccatcatcgcgtgcggcgagcccaacggccccagcgtctaccggaagccctccgggggcgtgttccagagctccaccgacccgagcatctactgcctcctggacagccactgcctggaggagttcgaggccatcgggcaggaggagctcgacgccgtgaagaagtccaagtgctgggagatcgagtaccccgacgtcaagctgatccaggagggcgacggcaccaagagctgccgcatgaaggactccgggaactgcaacgtggccacgaaccggtggcccgtgatccagtgcgagaacgacaagttctactacagcgagctgcagaaggactacgacaagacccaggacatcggccactactgcctctcccccgggtgcaccacggtccgctacccgatcaaccccaagcacatcagcaactgcaactggcaggtctcccggagctccatcgccaagatcgacgtgcacaacatcgaggacatcgagcagtacaagaaggcgatcacccagaagctgcagaccagcctgtccctcttcaagtacgccaagaccaagaacctgccccacatcaagccgatctacaagtacatcacgatcgagggcaccgagaccgccgaggggatcgagagcgcctacatcgagtccgaggtgcccgccctggcgggcaccagcatcggcttcaagatcaactccaaggaggggaagcacctcctggacgtgatcgcctacgtcaagagcgcctcctacagctccgtgtacacgaagctgtacagcaccggccccaccagcgggatcaacaccaagcacgacgagctctgcacgggcccctgcccggccaacatcaaccaccaggtggggtggctgaccttcgcccgcgagcggacctccagctggggctgcgaggagttcggctgcctggcggtgtccgacgggtgcgtcttcggcagctgccaggacatcatcaaggaggagctctccgtgtaccgcaaggagaccgaggaggtgacggacgtcgagctgtgcctgaccttcagcgacaagacctactgcaccaacctcaaccccgtgacgcccatcatcaccgacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcacgatctacgggaacggcgtcccgcgcttcgactacctgtgccacctggcctcccggaaggaggtgatcgtgcgcaagtgcttcgacaacgactaccaggcctgcaagttcctccagagccccgcgtcctaccggctggaggaggacagcgggaccgtcaccatcatcgactacaagaagatcctgggcaccatcaagatgaaggccatcctcggggacgtgaagtacaagaccttcgccgactccgtggacatcacggccgagggcagctgcaccggctgcatcaactgcttcgagaacatccactgcgagctgaccctgcacaccacgatcgaggcctcctgccccatcaagagctcctgcaccgtcttccacgaccgcatcctcgtgacccccaacgagcacaagtacgcgctgaagatggtgtgcaccgagaagccggggaacacgctgaccatcaaggtctgcaacaccaagatcgaggccagcatggccctcgtggacgccaagcccatcatcgagctggcccccgtcgaccagaccgcgtacatccgggagaaggacgagcgctgcaagacgtggatgtgccgggtgcgcgacgagggcctccaggtgatcctggagcccttcaagaacctgttcgggtcctacatcggcatcttctacaccttcatcatcagcatcgtcgccctgctcgtgatcatctacgtgctgctgccgatctgcttcaagctccgcgacaccctgcggaagcacgaggacgcctacaagcgcgagatgaagatccggtga

SEQ ID NO: 12663 - RNA, 4326 nt, synthetic construct
  misc_feature 1..4326: note = derived and/or modified CDS sequence (opt1) from LACV(LAC76-40)__U70206.1__GP
  source 1..4326: mol_type = other RNA
atgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacgtacaactgcctggtgcagtacaaggcgaagtggatgatgaacttcctcatcatctacatcttcctgatcctgatcaaggactccgccatcgtcgtgcaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaaggacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaagacccaggacatcggccactactgcctctcccccgggtgcaccacggtccgctaccccatcaacccgaagcacatcagcaactgcaactggcaggtctcccggagctccatcgccaagatcgacgtgcacaacatcgaggacatcgagcagtacaagaaggcgatcacccagaagctgcagaccagcctgtccctcttcaagtacgccaagaccaagaacctgccccacatcaagcccatctacaagtacatcacgatcgagggcaccgagaccgccgaggggatcgagagcgcctacatcgagtccgaggtgccggccctggcgggcaccagcatcggcttcaagatcaactccaaggaggggaagcacctcctggacgtgatcgcctacgtcaagagcgcctcctacagctccgtgtacgccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaagatcgaggccagcatggccctcgtggacgccaagccgatcatcgagctggcgcccgtcgaccagaccgcctacatccgggagaaggacgagcgctgcaagacctggatgtgccgggtgcgcgacgagggcctccaggtgatcctggagcccttcaagaacctgttcgggtcctacatcggcatcttctacacgttcatcatcagcatcgtcgccctgctcgtgatcatctacgtgctgctgcccatctgcttcaagctccgcgacaccctgcggaagcacgaggacgcctacaagcgcgagatgaagatccggtga

SEQ ID NO: 12664 - RNA, 4326 nt, synthetic construct
  misc_feature 1..4326: note = derived and/or modified CDS sequence (opt1) from LACV(LAC79-283)__U70207.1__GP
  source 1..4326: mol_type = other RNA
atgatccgcatcctggtgctcatcgccgtcaccgccgcgagccccgtgtaccagcggtgcttccaggacggcgccatcgtgaagcagaacccgtccaaggaggccgtcaccgaggtgtgcctgaaggacgacgtgagcatgatcaagacggaggcccgctacatccggaacgccaccggggtcttctccaacaacgtggcgatccgcaagtggctggtgagcgactggcacgactgccggcccaagcgcatcatcggcgggcacatcaacgtcatcgaggtgggcgacgacctctccctgcacaccgagagctacgtgtgctccgccgactgcaccatcggggtcgacaaggagacggcccaggtgcggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtcaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtgtaccaccccttcaccgagtgcgggacccactgcgtgtgcggcgcccgctacgacacgagcgaccggatgaagctccaccgcgcctccggcctgtgccccgggtacaagagcctgcgggcggcccgcgtcatgtgcaagagcaagggcccggcctccatcctcagcatcatcaccgccgtgctggtgctgaccttcgtcacccccatcaactccatggtgctcggggagagcaaggagacgttcgagctggaggagctgcccgacgacatgctcggcatggcctcccggatcaacagctactacttcacgtgcatcctgaactacgcggtctcctggggcctggtgatcatcgggctcctgaccggcctcctgttcaagaagtaccagcaccgcttcctgaacgtgtacgccatgtactgcgaggagtgcgacatgtaccacgacaagagcgggctgaagcggcacggcgacttcaccaacaagtgccgccagtgcacgtgcgggcagtacgaggacgccaccggcctcatggcccaccggaagacctacaactgcctggtccagtacaaggccaagtggatgatgaacttcctggtgatctacatcttcctcatcctgatcaaggactccgcgatcgtggtccaggccgccggcaccgacttcacgacctgcctggagaccgagagcatcaactggaactgcaccgggcccttcctcaacctgggcaactgccagaagcagcagaagaaggagccgtacaccaacatcgccacccagctgaaggggctcaaggccatctccgtgctggacatccccatcatcaccggcatccccgacgacatcgcgggggccctgcgctacatcgaggagcgggaggacttccacgtgcagctgaccatcgagtacgccatgctcagcaagtactgcgactactacacccagttctccgacaacagcggctactcccagacgacctggcgcgtctacctgcgcagccacgacttcgaggcctgcatcctgtaccccaaccagcacttctgccggtgcgtgaagaacggcgagaagtgctccagctccaactgggacttcgcgaacgagatgaaggacttctacagcgggaagcagaccaagttcgacaaggacctcaacctggccctgaccgccctccaccacgccttccgcggcacgagctccgcctacatcgcgaccatgctgagcaagaagtccaacgacgacctgatcgcctacaccaacaagatcaagaccaagttcccggggaacgccctcctgaaggccatcatcgactacatcgcctacatgaagtccctgcccggcatggcgaacttcaagcacgacgagttctgggacgagctcctgtacaagcccaaccccgccaaggccagcaacctggcccgggggaaggagagctcctacaacttcaagctcgccatcagctccaagagcatcaagacgtgcaagaacgtgaaggacgtcgcgtgcctgtccccgcgcagcggcgccatctacgcctccatcatcgcctgcggcgagcccaacgggcccagcgtgtaccggaagccctccggcggggtgttccagagctccaccgaccgcagcatctactgcctgctcgacagccactgcctggaggagttcgaggcgatctcccaggaggagctggacgccgtcaagaagtccaagtgctgggagatcgagtacccggacgtgaagcccctccaggagggcgacggcaccaagagctgccggatgaaggacagcgggaactgcaacgtggccaccaaccgctggcccgtcatccagtgcgagaacgacaagttctactactccgagctgcagaaggactacgacaagacgcaggacatcggccactactgcctgagccccgggtgcaccaccgtgcggtacccgatcaaccccaagcacatctccaactgcaactggcaggtcagccgctccagcatcgccaagatcgacgtgcacaacatcgaggacatcgagcagtacaagaaggccatcacccagaagctccagacgtccctgagcctgttcaagtacgcgaagaccaagaacctcccccacatcaagccgatctacaagtacatcaccatcgagggcaccgagacggccgaggggatcgagtccgcctacatcgagagcgaggtgcccgccctggccggcacctccatcggcttcaagatcaacagcaaggaggggaagcacctcctggacgtgatcgcgtacgtcaagtccgccagctactccagcgtgtacgccaagctgtacagcaccggccccacctccgggatcaacacgaagcacgacgagctgtgcaccggcccctgcccggccaacatcaaccaccaggtggggtggctcaccttcgcccgggagcgcaccagctcctggggctgcgaggagttcggctgcctggcggtcagcgacgggtgcgtgttcggctcctgccaggacatcatcaaggaggagctgagcgtgtaccggaaggagacggaggaggtcaccgacgtggagctctgcctgaccttctccgacaagacctactgcacgaacctgaaccccgtgacccccatcatcaccgacctcttcgaggtccagttcaacaccgtggagacgtacagcctgccccgcatcgtggccgtccagaaccacgagatcaagatcgggcagatcaacgacctgggcgtgtactccaaggggtgcggcaacgtgcagaaggtcaacggcaccgtgtacgggaacggcgtgccgcggttcgactacctctgccacctggccagccgcaaggaggtcatcgtgcggaagtgcttcgacaacgactaccaggcctgcaagttcctgcagtcccccgcgagctaccgcctcgaggaggactccgggaccgtgaccatcatcgactacaagaagatcctgggcaccatcaagatgaaggccatcctgggggacgtcaagtacaagacgttcgccgacagcgtggacatcaccgccgagggctcctgcaccggctgcatcaactgcttcgagaacatccactgcgagctcaccctgcacacgaccatcgaggccagctgccccatcaagtccagctgcaccgtgttccacgaccggatcctggtcacccccaacgagccgcagtacgcgctcaagatggtgtgcacggagcgccccgggaacaccctgaccatcaaggtgtgcaacaccaagatcgaggcctccatggccctggtcgacgccaagcccatcatcgagctcgcccccgtggaccagacggcgtacatccgcgagaaggacgagcggtgcaagacctggatgtgccgcgtccgggacgagggcctccaggtgatcctggagccgttcaagaacctgttcgggagctacatcggcatcttctacaccttcatcatcagcatggtggccctgctggtcatcatctacgtgctcctgcccatctgcttcaagctgcgcgacaccctccggaagcacgaggacgcctacaagcgcgagatgaagatccggtga

SEQ ID NO: 12665 - RNA, 4326 nt, synthetic construct
  misc_feature 1..4326: note = derived and/or modified CDS sequence (opt1) from LACV(LAC81-4)__U70208.1__GP
  source 1..4326: mol_type = other RNA
atgatccgcatcctggtgctcatcgccgtcaccgccgcgagccccgtgtaccagcggtgcttccaggacggcgccatcgtgaagcagaacccgtccaaggaggccgtcaccgaggtgtgcctgaaggacgacgtgagcatgatcaagacggaggcccgctacatccggaacgccaccggggtcttctccaacaacgtggcgatccgcaagtggctggtgagcgactggcacgactgccggcccaagaagatcatcggcgggcacatcaacgtcatcgaggtgggcgacgacctctccctgcacaccgagagctacgtgtgctccgccgactgcaccatcggggtcgacaaggagacggcccaggtgcgcctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcggttcctgcaccgcaccatcctccccggctccatcgccaacagcatctgccagaacatcgagatcatcatcctggtcaccctgacgctcctgatcttcatcctgctctccatcctgagcaagacctacatctgctacctgctcatgccgatcttcatccccatcgcctacgtgtacgggatcatctacaacaagtcctgcaagaagtgcaagctgtgcggcctggtgtaccaccccttcaccgagtgcgggacccactgcgtctgcggcgcccggtacgacacgagcgaccgcatgaagctccaccgggcctccggcctgtgccccgggtacaagagcctgcgcgcggcccgggtgatgtgcaagagcaagggcccggcctccatcctcagcatcatcaccgccgtgctggtcctgaccttcgtgacccccatcaactccatggtcctcggggagagcaaggagacgttcgagctggaggagctgcccgacgacatgctcggcatggcctcccgcatcaacagctactacttcacgtgcatcctgaactacgcggtgtcctggggcctggtgatcatcgggctcctgaccggcctcctgttcaagaagtaccagcaccggttcctgaacgtctacgccatgtactgcgaggagtgcgacatgtaccacgacaagagcgggctgaagcgccacggcgacttcaccaacaagtgccggcagtgcacgtgcgggcagtacgaggacgccaccggcctcatggcccaccgcaagacctacaactgcctggtgcagtacaaggccaagtggatgatgaacttcctggtgatctacatcttcctcatcctgatcaaggactccgcgatcgtcgtgcaggccgccggcaccgacttcacgacctgcctggagaccgagagcatcaactggaactgcaccgggcccttcctcaacctgggcaactgccagaagcagcagaagaaggagccgtacaccaacatcgccacccagctgaaggggctcaaggccatctccgtgctggacatccccatcatcaccggcatccccgacgacatcgcgggggccctgcggtacatcgaggagcgcgaggacttccacgtccagctgaccatcgagtacgccatgctcagcaagtactgcgactactacacccagttctccgacaacagcggctactcccagacgacctggcgggtgtacctgcgcagccacgacttcgaggcctgcatcctgtaccccaaccagcacttctgccgctgcgtgaagaacggcgagaagtgctccagctccaactgggacttcgcgaacgagatgaaggacttctacagcgggaagcagaccaagttcgacaaggacctcaacctggccctgaccgccctccaccacgccttccggggcacgagctccgcctacatcgcgaccatgctgagcaagaagtccaacgacgacctgatcgcctacaccaacaagatcaagaccaagttcccggggaacgccctcctgaaggccatcatcgactacatcgcctacatgaagtccctgcccggcatggcgaacttcaagcacgacgagttctgggacgagctcctgtacaagcccaaccccgccaaggccagcaacctggcccgcgggaaggagagctcctacaacttcaagctcgccatcagctccaagagcatcaagacgtgcaagaacgtcaaggacgtggcgtgcctgtccccgcggagcggcgccatctacgcctccatcatcgcctgcggcgagcccaacgggcccagcgtgtaccgcaagccctccggcggggtcttccagagctccaccgaccggagcatctactgcctgctcgacagccactgcctggaggagttcgaggcgatctcccaggaggagctggacgccgtgaagaagtccaagtgctgggagatcgagtacccggacgtgaagcccctccaggagggcgacggcaccaagagctgccgcatgaaggacagcgggaactgcaacgtcgccaccaaccggtggcccgtgatccagtgcgagaacgacaagttctactactccgagctgcagaaggactacgacaagacgcaggacatcggccactactgcctgagccccgggtgcaccaccgtgcgctacccgatcaaccccaagcacatctccaactgcaactggcaggtcagccggtccagcatcgccaagatcgacgtgcacaacatcgaggacatcgagcagtacaagaaggccatcacccagaagctccagacgtccctgagcctgttcaagtacgcgaagaccaagaacctcccccacatcaagccgatctacaagtacatcaccatcgagggcaccgagacggccgaggggatcgagtccgcctacatcgagagcgaggtgcccgccctggccggcacctccatcggcttcaagatcaacagcaaggaggggaagcacctcctggacgtcatcgcgtacgtgaagtccgccagctactccagcgtgtacgccaagctgtacagcaccggccccacctccgggatcaacacgaagcacgacgagctgtgcaccggcccctgcccggccaacatcaaccaccaggtcgggtggctcaccttcgcccgcgagcggaccagctcctggggctgcgaggagttcggctgcctggcggtgagcgacgggtgcgtgttcggctcctgccaggacatcatcaaggaggagctgagcgtctaccgcaaggagacggaggaggtgaccgacgtggagctctgcctgaccttctccgacaagacctactgcacgaacctgaaccccgtcacccccatcatcaccgacctcttcgaggtgcagttcaagaccgtggagacgtacagcctgccccggatcgtcgccgtgcagaaccacgagatcaagatcgggcagatcaacgacctgggcgtgtactccaaggggtgcggcaacgtccagaaggtgaacggcaccgtgtacgggaacggcgtcccgcgcttcgactacctctgccacctggccagccggaaggaggtgatcgtgcgcaagtgcttcgacaacgactaccaggcctgcaagttcctgcagtcccccgcgagctaccggctcgaggaggactccgggaccgtcaccatcatcgactacaagaagatcctgggcaccatcaagatgaaggccatcctgggggacgtgaagtacaagacgttcgccgacagcgtggacatcaccgccgagggctcctgcaccggctgcatcaactgcttcgagaacatccactgcgagctcaccctgcacacgaccatcgaggccagctgccccatcaagtccagctgcaccgtcttccacgaccgcatcctggtgacccccaacgagccgcagtacgcgctcaagatggtgtgcacggagcggcccgggaacaccctgaccatcaaggtctgcaacaccaagatcgaggcctccatggccctggtggacgccaagcccatcatcgagctcgcccccgtcgaccagacggcgtacatccgcgagaaggacgagcgctgcaagacctggatgtgccgggtgcgcgacgagggcctccaggtgatcctggagccgttcaagaacctgttcgggagctacatcggcatcttctacaccttcatcatcagcatggtcgccctgctggtgatcatctacgtgctcctgcccatctgcttcaagctgcgggacaccctccgcaagcacgaggacgcctacaagcgggagatgaagatccgctga

SEQ ID NO: 12666 - RNA, 4326 nt, synthetic construct
  misc_feature 1..4326: note = derived and/or modified CDS sequence (opt1) from LACV(LACR56869)__U70205.1__GP
  source 1..4326: mol_type = other RNA
atgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacatctacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacgtacaactgcctggtgcagtacaaggcgaagtggatgatgaacttcctcatcatctacatcttcctgatcctgatcaaggactccgccatcgtggtccaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtgcccatcatcacggggatccccgacgacatcgccggcgccctgcgctacatcgaggagaaggaggacttccacgtccagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtgaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatggccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtcaaggacgtggcctgcctgtccccgcggagcggggccatctacgcctccatcatcgcgtgcggcgagcccaacggccccagcgtgtaccgcaagccctccgggggcgtcttccagagctccaccgaccggagcatctactgcctcctggacagccactgcctggaggagttcgaggccatcgggcaggaggagctcgacgccgtgaagaagtccaagtgctgggagatcgagtacccggacgtgaagctgatccaggagggcgacggcaccaagagctgccgcatgaaggactccgggaactgcaacgtcgccaccaaccggtggcccgtgatccagtgcgagaacgacaagttctactacagcgagctgcagaaggactacgacaagacccaggacatcggccactactgcctctcccccgggtgcaccacggtgcgctaccccatcaacccgaagcacatcagcaactgcaactggcaggtctcccggagctccatcgccaagatcgacgtgcacaacatcgaggacatcgagcagtacaagaaggcgatcacccagaagctgcagaccagcctgtccctcttcaagtacgccaagaccaagaacctgccccacatcaagcccatctacaagtacatcacgatcgagggcaccgagaccgccgaggggatcgagagcgcctacatcgagtccgaggtgccggccctggcgggcaccagcatcggcttcaagatcaactccaaggaggggaagcacctcctggacgtcatcgcctacgtcaagagcgcctcctacagctccgtgtacacgaagctgtacagcaccggccccaccagcgggatcaacaccaagcacgacgagctctgcacgggcccctgccccgccaacatcaaccaccaggacgggtggctgaccttcgcccgcgagcggacctccagctggggctgcgaggagttcggctgcctggcggtgtccgacgggtgcgtgttcggcagctgccaggacatcatcaaggaggagctctccgtgtaccgcaaggagaccgaggaggtcacggacgtggagctgtgcctgaccttcagcgacaagacctactgcaccaacctcaacccggtgacgcccatcatcaccgacctgttcgaggtccagttcaagaccgtggagacctactccctgccccggatcgtggccgtccagaaccacgagatcaagatcgggcagatcaacgacctcggcgtgtacagcaaggggtgcggcaacgtgcagaaggtcaacggcacgatctacgggaacggcgtgccccgcttcgactacctgtgccacctggcctcccggaaggaggtgatcgtccgcaagtgcttcgacaacgactaccaggcctgcaagttcctccagagcccggcgtcctaccggctggaggaggacagcgggaccgtgaccatcatcgactacaagaagatcctgggcaccatcaagatgaaggccatcctcggggacgtgaagtacaagaccttcgccgactccgtcgacatcacggccgagggcagctgcaccggctgcatcaactgcttcgagaacatccactgcgagctgaccctgcacaccacgatcgaggcctcctgccccatcaagagctcctgcaccgtgttccacgaccgcatcctcgtgacccccaacgagcacaagtacgcgctgaagatggtctgcaccgagaagcccgggaacacgctgaccatcgaggtgtgcaacaccaagatcgaggccagcatggccctcgtggacgccaagccgatcatcgagctggcccccgtcgaccagaccacgtacatccgggagaaggacgagcgctgcaagacctggatgtgccgggtgcgcgacgagggcctgcaggtcatcctcgagcccttcaagaacctgttcgggtcctacatcggcatcttctacaccttcatcatcagcatcgtggcgctgctcgtgatcatctacgtcctgctgcccatctgcttcaagctccgcgacaccctgcggaagcacgaggacgcctacaagcgcgagatgaagatccggtga

SEQ ID NO: 12667 - RNA, 4326 nt, synthetic construct
  misc_feature 1..4326: note = derived and/or modified CDS sequence (opt1) from LACV(NAT_Crawford_WI_2007)__GU596383.1__GP
  source 1..4326: mol_type = other RNA
atgatccgcatcctggtgctcatcgccgtcaccgccgcgagccccgtgtaccagcggtgcttccaggacggcgccatcgtgaagcagaacccgtccaaggaggccgtcaccgaggtgtgcctgaaggacgacgtgagcatgatcaagacggaggcccgctacgtccggaacgccaccggggtgttctccaacaacgtggcgatccgcaagtggctggtcagcgactggcacgactgccggcccaagaagatcatcggcgggcacatcaacgtgatcgaggtgggcgacgacctctccctgcacaccgagagctacgtctgctccgccgactgcaccatcggggtggacaaggagacggcccaggtgcgcctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtccggttcctgcaccgcaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacgtgtacgggatcatctacaacaagtcctgcaagaagtgcaagctgtgcggcctggtctaccaccccttcaccgagtgcgggacccactgcgtgtgcggcgcccggtacgacacgagcgaccgcatgaagctccaccgggcctccggcctgtgccccgggtacaagagcctgcgcgcggcccgggtgatgtgcaagagcaagggcccggcctccatcctcagcatcatcaccgccgtcctggtgctgaccttcgtcacccccatcaactccatggtgctcggggagagcaaggagacgttcgagctggaggagctgcccgacgacatgctcgagatggcctcccgcatcaacagctactacttcacgtgcatcctgaactacgcggtgtcctggggcctggtcatcatcggcctcctgaccgggctcctgttcaagaagtaccagcaccggttcctgaacgtgtacgccatgtactgcgaggagtgcgacatgtaccacgacaagagcggcctgaagcgccacggggacttcaccaacaagtgccggcagtgcacgtgcggccagtacgaggacgccaccgggctcatggcccaccgcaagacctacaactgcctggtgcagtacaaggccaagtggatgatgaacttcctgatcatctacatcttcctcatcctgatcaaggactccgcgatcgtcgtgcaggccgccggcaccgacttcacgacctgcctggagaccgagagcatcaactggaactgcaccggccccttcctcaacctggggaactgccagaagcagcagaagaaggagccgtacaccaacatcgccacccagctgaagggcctcaaggccatctccgtgctggacatccccatcatcaccgggatccccgacgacatcgcgggcgccctgcggtacatcgaggagcgcgaggacttccacgtccagctgaccatcgagtacgccatgctcagcaagtactgcgactactacacccagttctccgacaacagcgggtactcccaggccacgtggcgggtgtacctgcgcagccacgacttcgaggcgtgcatcctgtaccccaaccagcacttctgccgctgcgtgaagaacggcgagaagtgctccagctccaactgggacttcgccaacgagatgaaggacttctacagcggcaagcagaccaagttcgacaaggacctcaacctggccctgaccgccctccaccacgccttccgggggaccagctccgcgtacatcgccacgatgctgagcaagaagtccaacgacgacctgatcgcctacaccaacaagatcaagaccaagttcccgggcaacgccctcctgaaggccatcatcgactacatcgcgtacatgaagtccctgcccgggatggccaacttcaagtacgacgagttctgggacgagctcctgtacaagcccaaccccgccaaggccagcaacctggcccgcggcaaggagagctcctacaacttcaagctcgcgatcagctccaagagcatcaagacctgcaagaacgtcaaggacgtggcctgcctgtccccgcggagcggggccatctacgcctccatcatcgcgtgcggcgagcccaacggccccagcgtgtaccgcaagccctccgggggcgtcttccagagctccacggaccggagcatctactgcctgctcgacagccactgcctggaggagttcgaggccatctcccaggaggagctggacgccgtgaagaagtccaagtgctgggagatcgagtacccggacgtgaagcccctccaggagagcgacgggaccaagagctgccgcatgaaggactccggcaactgcaacgtcgccaccaaccggtggcccgtgatccagtgcgagaacgacaagttctactacagcgagctgcagaaggactacgacaagacccaggacatcggccactactgcctgtcccccgggtgcacgaccgtgcgctacccgatcaaccccaagcacatcagcaactgcaactggcaggtctcccggagctccatcgccaagatcgacgtgcacaacatcgaggacatcgagcagtacaagaaggcgatcacccagaagctccagaccagcctgtccctgttcaagtacgccaagacgaagaacctcccccacatcaagccgatctacaagtacatcaccatcgagggcaccgagaccgccgaggggatcgagagcgcctacatcgagtccgaggtgcccgccctggcgggcacgagcatcgggttcaagatcaactccaaggagggcaagcacctcctggacgtcatcgcctacgtcaagagcgcctcctacagcagcgtgtacgccaagctgtactccaccggccccaccagcgggatcaacaccaagcacgacgagctgtgcacgggcccctgcccggccaacatcaaccaccaggtggggtggctcaccttcgcgcgcgagcggacctccagctggggctgcgaggagttcgggtgcctggccgtgtccgacggctgcgtgttcggcagctgccaggacatcatcaaggaggagctgtccgtctaccgcaaggagaccgaggaggtgacggacgtggagctctgcctgaccttcagcgacaagacctactgcaccaacctgaaccccgtcacgcccatcatcaccgacctcttcgaggtgcagttcaagaccgtggagacctactccctgccccggatcgtcgccgtgcagaaccacgagatcaagatcgggcagatcaacgacctgggcgtgtacagcaaggggtgcggcaacgtccagaaggtgaacgggacggtgtacggcaacggcgtcccgcgcttcgactacctctgccacctggcctcccggaaggaggtgatcgtgcgcaagtgcttcgacaacgactaccaggcgtgcaagttcctgcagagccccgcctcctaccggctcgaggaggacagcgggaccgtcaccatcatcgactacaagaagatcctgggcaccatcaagatgaaggccatcctgggggacgtgaagtacaagaccttcgccgactccgtggacatcacggccgagggcagctgcaccgggtgcatcaactgcttcgagaacatccactgcgagctcaccctgcacaccacgatcgaggcgtcctgccccatcaagagctcctgcaccgtcttccacgaccgcatcctggtgacccccaacgagcacaagtacgccctcaagatggtgtgcaccgagcggccgggcaacacgctgaccatcaaggtctgcaacaccaagatcgaggccagcatggccctggtggacgccaagcccatcatcgagctcgcgcccgtcgaccagaccgcctacatccgcgagaaggacgagcgctgcaagacgtggatgtgccgggtgcgcgacgagggcctccaggtgatcctggagcccttcaagaacctgttcgggagctacatcggcatcttctacaccttcatcatctccatcgtcgccctgctggtgatcatctacgtgctcctgccgatctgcttcaagctgcgggacaccctccgcaagcacgaggacgcctacaagcgggagatgaagatccgctga

SEQ ID NO: 12668 - RNA, 4326 nt, synthetic construct
  misc_feature 1..4326: note = derived and/or modified CDS sequence (opt1) from LACV(77)__DQ196119.1__GP
  source 1..4326: mol_type = other RNA
atgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcgagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggaccatctacaacaagtcctgcaagaagtgcaagctgtgcggcctggtctaccaccccttcaccgagtgcgggacgcactgcatctgcggcgcccgctacgacaccagcgaccggatgaagctccaccgcgcctccggcctgtgccccgggtacaagagcctgcgggcggcccgcgtgatgtgcaagagcaagggcccggcctccatcctcagcatcatcaccgccgtgctggtcctgaccttcgtgacgcccatcaactccatggtcctcggggagagcaaggagaccttcgagctggaggacctgcccgacgacatgctcgagatggcctcccggatcaacagctactacctgacctgcatcctgaactacgcggtgtcctggggcctcgtgatcatcggcctgctgatcgggctcctgttcaagaagtaccagcaccgcttcctgaacgtctacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacctacaactgcctggtgcagtacaaggcgaagtggatgatgaacttcctcatcatctacatcttcctgatcctgatcaaggactccgccatcgtggtccaggccgccggcaccgacttcaccacgtgcctcgagaccgagagcatcaactggaactgcaccggccccttcctgaacctggggaactgccagaagcagcagaagaaggagccgtacaccaacatcgccacgcagctcaagggcctgaaggcgatctccgtgctggacgtgcccatcatcaccgggatccccgacgacatcgccggcgccctgcgctacatcgaggagaaggaggacttccacgtccagctcaccatcgagtacgccatgctgagcaagtactgcgactactacacccagttctccgacaacagcgggtactcccagaccacgtggcgggtgtacctgcgcagccacgacttcgaggcgtgcatcctctaccccaaccagcacttctgccggtgcgtgaagaacggcgagaagtgctccagctccaaccgcgacttcgccaacgagatgaaggactactacagcggcaagcagaccaagttcgacaaggacctgaacctggccctcaccgccctgcaccacgccttccgcgggaccagctccgcgtacatcgccacgatgctgagcaagaagtccaacgacgacctcatcgcctacaccaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccggggcaaggagagctcctacaacttcaagctggcgatcagctccaagagcatcaagacctgcaagaacgtcaaggacgtggcctgcctgtccccgcgcagcggggccatctacgcctccatcatcgcgtgcggcgagcccaacggccccagcgtgtaccggaagccctccgggggcgtcttccagagctccacggaccagagcatctactgcctcctggacagccactgcctggaggagttcgaggccatcgggcaggaggagctcgacgccgtgaagaagtccaagtgctgggagatcgagtacccggacgtgaagctgatccaggagggcgacggcaccaagagctgccgcatgaaggactccgggaactgcaacgtcgccaccaaccggtggcccgtgatccagtgcgagaacgacaagttctactacagcgagctgcagaaggactacgacaagacccaggacatcggccactactgcctctcccccgggtgcacgaccgtgcgctaccccatcaacccgaagcacatcagcaactgcaactggcaggtctcccggagctccatcgccaagatcgacgtgcacaacatcgaggacatcgagcagtacaagaaggcgatcacccagaagctgcagaccagcctgtccctcttcaagtacgccaagacgaagaacctgccccacatcaagcccatctacaagtacatcaccatcgagggcaccgagaccgccgaggggatcgagagcgcctacatcgagtccgaggtgccggccctggcgggcacgagcatcggcttcaagatcaactccaaggaggggaagcacctcctggacgtcatcgcctacgtcaagagcgcctcctacagctccgtgtacaccaagctgtacagcaccggccccaccagcgggatcaacacgaagcacgacgagctctgcaccggcccctgccccgccaacatcaaccaccaggtggggtggctgaccttcgcccgcgagcggacctccagctggggctgcgaggagttcggctgcctggcggtgtccgacgggtgcgtgttcggcagctgccaggacatcatcaaggaggagctctccgtctaccgcaaggagacggaggaggtgaccgacgtggagctgtgcctgaccttcagcgacaagacctactgcacgaacctcaacccggtcacccccatcatcaccgacctgttcgaggtgcagttcaagaccgtggaggcctactccctgccccggatcgtcgccgtgcagaaccacgagatcaagatcgggcagatcaacgacctcggcgtgtacagcaaggggtgcggcaacgtccagaaggtgaacggcacgatctacgggaacggcgtgccccgcttcgactacctgtgccacctggcctcccggaaggaggtcatcgtgcgcaagtgcttcgacaacgactaccaggcgtgcaagttcctccagagcccggcctcctaccggctggaggaggacagcgggaccgtgaccatcatcgactacaagaagatcctgggcaccatcaagatgaaggccatcctcggggacgtcaagtacaagaccttcgccgactccgtggacatcacggccgagggcagctgcaccggctgcatcaactgcttcgagaacatccactgcgagctgaccctgcacaccacgatcgaggcgtcctgccccatcaagagctcctgcaccgtgttccacgaccgcatcctcgtcacccccaacgagcacaagtacgccctgaagatggtgtgcaccgagaagcccgggaacacgctgaccatcaaggtgtgcaacaccaagatcgaggccagcatggccctcgtcgacgccaagccgatcatcgagctggcgcccgtggaccagaccgcctacatccgggagaaggacgagcgctgcaagacgtggatgtgccgggtccgcgacgagggcctccaggtgatcctggagcccttcaagaacctgttcgggtcctacatcggcatcttctacaccttcatcatcagcatcgtggccctgctcgtcatcatctacgtgctgctgcccatctgcttcaagctccgcgacaccctgcggaagcacgaggacgcctacaagcgcgagatgaagatccggtga

SEQ ID NO: 12669 - RNA, 4326 nt, synthetic construct
  misc_feature 1..4326: note = derived and/or modified CDS sequence (opt1) from LACV(LACV/00/NC-M (NC00-283))__GU206112.1__GP
  source 1..4326: mol_type = other RNA
atgatccgcatcctggtgctcatcgccgtcaccgccgcgagccccgtgtaccagcggtgcttccaggacggcgccatcgtgaagcagaacccgtccaaggaggccgtcaccgaggtgtgcctgaaggacgacgtgagcatgatcaagacggaggcccgctacgtccggaacgccaccggggtgttctccaacaacgtggcgatccgcaagtggctggtcagcgactggcacgactgccggcccaagaagatcatcggcgggcacatcaacgtgatcgaggtgggcgacgacctctccctgcacaccgagagctacgtctgctccgccgactgcaccatcggggtggacaaggagacggcccaggtgcgcctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtccggttcctgcaccgcaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatgtacgggatcatctacaacaagtcctgcaagaagtgcaagctgtgcggcctggtgtaccaccccttcaccgagtgcgggacccactgcgtctgcggcgcccggtacgacacgagcgaccgcatgaagctccaccgggcctccggcctgtgccccgggtacaagagcctgcgcgcggcccgggtgatgtgcaagagcaagggcccggcctccatcctcagcatcatcaccgccgtgctggtcctgaccttcgtgacccccatcaactccatggtcctcggggagagcaaggagacgttcgagctggaggagctgcccgacgacatgctcgagatggcctcccgcatcaacagctactacttcacgtgcatcctgaactacgcggtgtcctggggcctggtgatcatcggcctcctgaccgggctcctgttcaagaagtaccagcaccggttcctgaacgtctacgccatgtactgcgaggagtgcgacatgtaccacgacaagagcggcctgaagcgccacggggacttcaccaacaagtgccggcagtgcacgtgcggccagtacgaggacgccgccgggctcatggcccaccgcaagacctacaactgcctggtgcagtacaaggcgaagtggatgatgaacttcctgatcatctacatcttcctcatcctgatcaaggactccgccatcgtggtccaggccgccggcaccgacttcacgacctgcctggagaccgagagcatcaactggaactgcaccggccccttcctcaacctggggaactgccagaagcagcagaagaaggagccgtacaccaacatcgccacccagctgaagggcctcaaggcgatctccgtgctggacatccccatcatcaccgggatccccgacgacatcgccggcgccctgaagtacatcgaggagcgggaggacttccacgtgcagctgaccatcgagtacgccatgctcagcaagtactgcgactactacacccagttctccgacaacagcgggtactcccagaccacgtggcgcgtctacctgcggagccacgacttcgaggcgtgcatcctgtaccccaaccagcacttctgccgctgcgtgaagaacggcgagaagtgctccagctccaactgggacttcgccaacgagatgaaggactactacagcggcaagcagaccaagttcgacaaggacctcaacctggccctgaccgccctccaccacgccttccgcgggaccagctccgcgtacatcgccacgatgctgagcaagaagtccaacgacgacctgatcgcctacaccaacaagatcaagaccaagttcccgggcaacgccctcctgaaggccatcatcgactacatcgcgtacatgaagtccctgcccgggatgaccaacttcaagtacgacaagttctgggacgagctcctgtacaagcccaaccccgccaaggccagcaacctggcccggggcaaggagagctcctacaacttcaagctcgccatcagctccaagagcatcaagacgtgcaagaacgtgaaggacgtcgcgtgcctgtccccgcgcagcggggccatctacgcctccatcatcgcctgcggcgagcccaacggccccagcgtgtaccggaagccctccgggggcgtgttccagagctccaccgaccgcagcatctactgcctgctcgacagccactgcctggaggagttcgaggcgatcaaccaggaggagctggacgccgtcaagaagtccaagtgctgggagatcgagtacagcgacgtgaagccgctccaggagggggacggcaccaagtcctgccggatgaaggacagcggcaactgcaacgtggccaccaaccgctggcccgtcatccagtgcgagaacgacaagttctactactccgagctgcagaaggactacgacaagacgcaggacatcgggcactactgcctgagccccggctgcaccaccgtgcggtaccccatcaacccgaagcacatctccaactgcaactggcaggtcagccgctccagcatcgccaagatcgacgtgcacaacatcgaggacatcgagcagtacaagaaggccatcacccagaagctccagacgtccctgagcctgttcaagtacgcgaagaccaagaacctcccccacatcaagcccatctacaagtacatcaccatcgaggggaccgagacggccgagggcatcgagtccgcctacatcgagagcgaggtgccggccctggccgggacctccatcggcttcaagatcaacagcaaggagggcaagcacctcctggacgtgatcgcgtacgtcaagtccgccagctactccagcgtgtacgccaagctgtacagcaccgggcccacctccggcatcaacacgaagcacgacgagctgtgcaccgggccctgccccgccaacatcaaccaccaggtgggctggctcaccttcgccaaggagcggaccagctcctgggggtgcgaggagttcggctgcctggcggtcagcgacggctgcgtgttcgggtcctgccaggacatcatcaaggaggagctgagcgtgtaccgcaaggagacggaggaggtcaccgacgtggagctctgcctgaccttctccgacaagacctactgcacgaacctgaacccggtgacccccatcatcaccgacctcttcgaggtccagttcaagaccgtggagacgtacagcctgccccggatcgtggccgtccagaaccacgagatcaagatcggccagatcaacgacctgggggtgtactccaagggctgcgggaacgtgcagaaggtcaacggcaccgtgtacggcaacggggtgccccgcttcgactacctctgccacctggccagccggaaggaggtcatcgtgcgcaagtgcttcgacaacgactaccaggcctgcaagttcctgcagtccccggcgagctaccggctcgaggaggactccggcaccgtgaccatcatcgactacaagaagatcctggggaccatcaagatgaaggccatcctgggcgacgtcaagtacaagacgttcgccgacaacgtggacatcaccgccgaggggagctgcaccggctgcatcaactgcttcgagaacatccactgcgagctcaccctgcacacgaccatcgaggcctcctgccccatcaagagctcctgcaccgtgttccacgaccgcatcctggtcacccccagcgagcacaagtacgcgctcaagatggtgtgcacggagaagcccggcaacaccctgaccatcaaggtgtgcaacaccaagatcgaggcctccatggccctggtcgacgccaagccgatcatcgagctcgcccccgtggaccagacggcgtacatccgggagaaggacgagcgctgcaagacctggatgtgccgggtccgcgacgaggggctccaggtgatcctggagcccttcaagaacctgttcggcagctacatcgggatcttctacaccttcatcatcagcatcatggccctgctggtgatcatctacgtcctcctgcccatctgcttcaagctgcgcgacaccctccggaagcacgaggacgcctacaagcgcgagatgaagatccggtga

SEQ ID NO: 12670 - RNA, 4326 nt, synthetic construct
  misc_feature 1..4326: note = derived and/or modified CDS sequence (opt1) from LACV(LACV/00/WV-M (WV00-3178))__GU206148.1__GP
  source 1..4326: mol_type = other RNA
atgatccgcatcctggtgctcatcgccatcaccgccgcgagccccgtctaccagcggtgcttccaggacggcgccatcgtgaagcagaacccgtccaaggaggccgtgaccgaggtctgcctgaaggacgacgtgagcatgatcaagacggaggcccgctacgtgcggaacgccaccggggtcttctccaacaacgtggcgatccgcaagtggctggtgagcgactggcacgactgccggcccaagaagatcatcggcgggcacatcaacgtcatcgaggtgggcgacgacctctccctgcacaccgagagctacgtgtgctccagcgactgcaccatcggggtcgacaaggagacggcccaggtgcgcctgcagaccgacaccaccaaccacttcgagatcgccggcacgaccgtgaagtccggctggttcaagagcaccacctacatcacgctcgaccagacctgcgagcacctgaaggtctcctgcgggcccaagagcgtgcagttccacgcctgcttcaaccagcacatgtcctgcgtgcggttcctgcaccgcaccatcctccccggcagcatcgcgaactccatctgccagaacatcgagatcatcatcctggtcaccctgacgctcctgatcttcatcctgctcagcatcctgtccaagacctacatctgctacctgctcatgccgatcttcatccccatcgcctacatctacgggatcatctacaacaagagctgcaagaagtgcaagctgtgcggcctggtgtaccaccccttcaccgagtgcgggacccactgcgtgtgcggcgcccggtacgacacgtccgaccgcatgaagctccaccgggccagcggcctgtgccccgggtacaagagcctgcgcgccgcgcgggtcatgtgcaagtccaagggcccggccagcatcctctccatcatcaccgccgtgctggtgctgaccttcgtcacccccatcaacagcatggtgctcggggagtccaaggagacgttcgagctggaggagctgcccgacgacatgctcgagatggccagccgcatcaactcctactacctgacctgcatcctgaactacgccgtcagctggggcctcgtgatcatcggcctgctgaccgggctcctgttcaagaagtaccagcaccggttcctgaacacctacgcgatgtactgcgaggagtgcgacatgtaccacgacaagtccggcctcaagcgccacggggacttcacgaacaagtgccggcagtgcacgtgcggccagtacgaggacgccgccgggctgatgacccaccgcaagacctacaactgcctggtgcagtacaaggccaagtggatgatgaacttcctcatcatctacatcttcctgatcctgatcaaggacagcgccatcatcgtccaggcggccggcacggacttcacgacctgcctcgagaccgagtccatcaactggaactgcaccggccccttcctgaacctggggaactgccagaagcagcagaagaaggagccgtacaccaacatcgccacccagctcaagggcctgaaggccatcagcgtgctggacatccccatcatcaccgggatccccgacgacatcgccggcgcgctgcggtacatcgaggagcgcgaggacttccacgtgcagctcaccacggagtacgccatgctgtcccggtactgcgactactacacccagttcagcgacaactcccgctacagccagaccacctggcgcgtctacctgcggtcccacgacttcgaggcctgcatcctctaccccaaccagcacttctgccgctgcgtgaagaacggggagaagtgcagctccagcaactgggacttcgccaacgagatgaaggactactacagcggcaagcagacgaagttcgacaaggacctgaacctggcgctcaccgccctgcaccacgccttccggggcacctccagcgcctacatcgccaccatgctgtccaagaagtccaacgacgacctcatcacgtacaccaacaagatcaagaccaagttcccggggaacgcgctgctgaaggccatcatcgactacatcgcctacatgaagtccctccccggcatggccaacttcaagtacgacgagttctgggacgagctgctgtacaagcccaaccccgccaagaccagcaacctcgcgcgcgggaaggagagcacgtacaacttcaagctggccatcagctccaagagcatcaagacctgcaagaacgtgaaggacgtcgcctgcctgtccccgcggagcggcgccatctacgcctccatcatcgcgtgcggggagcccaacggccccagcgtgtaccgcaagccctccggcggggtgttccagagctccaccgaccggagcatctactgcctcctggacagccactgcctggaggagttcgaggccatctcccaggaggagctcgacgccgtcaagaagtccaagtgctgggagaccgagtacccggaggtgaagcccctgcaggagagcgacggcaccaagagctgccgcatgaaggactccgggaactgcaacgtggccaccaaccggtggcccgtcatccagtgcgagaacgacaagttctactacagcgagctgcagaaggactacgacaagacccaggacatcggccactactgcctctcccccggctgcaccacggtgcgctacccgatcaaccccaagcacatcagcaactgcaactggcaggtctcccggagctccatcgcgaagatcgacgtgcacaacatcgaggacatcgagcagtacaagaaggccatcacccagaagctgcagaccagcctgtccctcttcaagtacgccaagaccaagaacctgccccacatcaagccgatctacaagtacatcacgatcgaggggaccgagaccgccgagggcatcgagagcgcctacatcgagtccgaggtgcccgcgctggccgggaccagcatcggcttcaagatcaactccaaggaggggaagcacctcctggacgtgatcgcctacgtcaagagcgcctcctacagcagcgtgtacgccaagctgtactccacgggccccaccagcggcatcaacaccaagcacgacgagctctgcaccgggccctgcccggcgaacatcaaccaccagatcggctggctgacgttcgccaaggagcgcacctccagctgggggtgcgaggagttcggctgcctggccgtgtccgacgggtgcgtcttcggcagctgccaggacatcatcaaggaggagctctccgtgtaccggaaggagaccgaggaggtgaccgacgtcgagctgtgcctgacgttcagcgacaagacctactgcaccaacctcaaccccgtgacccccatcatcaccgacctgttcgaggtgcagttcaagacggtcgagacctactccctgccccgcatcgtggccgtgcagaaccacgagatcaagatcggccagatcaacgacctcggggtctacagcaagggctgcgggaacgtgcagaaggtgaacggcaccgtctacgggaacggcgtgccgcggttcgactacctgtgccacctggcctcccgcaaggaggtgatcgtccggaagtgcttcgacaacgactaccaggcgtgcaagttcctccagagccccgcctcctaccgcctggaggaggacagcggcaccgtgacgatcatcgactacaagaagatcctggggaccatcaagatgaaggccatcctcggcgacgtgaagtacaagaccttcgccgagtccgtcgacatcaccgcggaggggagctgcacgggctgcatcaactgcttcgagaacatccactgcgagctgaccctgcacaccaccatcgaggcctcctgccccatcaagagctcctgcacggtgttccacgaccggatcctcgtgacccccaacgagcacaagtacgccctgaagatggtctgcaccgagcgcccggggaacaccctgacgatcaaggtgtgcaacaccaagatcgaggccagcatgaccctcgtggacgccaagcccatcatcgagctggcgcccgtcgaccagaccgcctacatccgcgagaaggacgagcggtgcaagacgtggatgtgccgcgtgcgggacgagggcctccaggtgatcctggagcccttcaagaacctgttcggcagctacatcgggatcttctacaccttcatcatctccatcgtcgccctgctcgtgatcatctacgtcctgctgccgatctgcttcaagctccgcgacaccctgcggaagcacgaggacgcctacaagcgcgagatgaagatccggtga

SEQ ID NO: 12671 - RNA, 4326 nt, synthetic construct
  misc_feature 1..4326: note = derived and/or modified CDS sequence (opt1) from LACV(LACV/03/NY-M (41030016))__GU206130.1__GP
  source 1..4326: mol_type = other RNA
atgatctacatcctggtgctcatcgccgtcaccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacatccgcaacgccaccggggtcttctccaacaacgtggcgatccggaagtggctggtgagcgactggcacgactgccgccccaagaagatcgtcggcgggcacatcaacgtgatcgaggtgggcgacgacctctccctgcacaccgagagctacgtctgctccgccgactgcaccatcggggtggacaaggagacggcccaggtgcggctgcagaccgacaccaccaaccacttcgagatcgccggcacgaccgtcaagagcggctggttcaagtccaccacctacatcacgctcgaccagacctgcgagcacctgaaggtgagctgcgggcccaagtccatccagttccacgcgtgcttcaaccagcacatgagctgcgtgcgcttcctgcaccggaccatcctccccggctccatcgccaacagcatctgccagaacatcgagatcatcatcctggtcaccctgacgctcctgatcttcatcctgctctccatcctgagcaagacctacatctgctacctgctcatgccggtgttcatccccatcgcctacgtgtacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggaggtgttcgagctggaggagctgcccgacgacatgctcgagatggccctgcggatcaacttctactacttcacgtgcatcctgaactacgcggtctcctggagcctcgtgatcatcggcctgctgaccggcctcctgttcaagcgctaccagcacaagttcctgaacatctacgccatgtactgcgaggagtgcgacatgtaccacgacaagtccgggctcaagcggcacggcgacttcaccaacaagtgccgccagtgcacgtgcgggcagtacgaggacgccaccggcctgatgacccaccggaagacctacaactgcctggtgcagtacaaggccaagtggatcatgaacttcctcatcatctacatcttcctggtcctgatcaaggacagcgccatcatcgtgcaggcggccgggaccgacttctccagctgcctcgagacggagtccatcaactggaactgcaccggccccttcctgaacctgggcaactgccagaagcagcagaagaaggagccgtacaccaacatcgccgcccagctcaaggggctgcgcgccatcagcgtgctggacatccccatgatcaccgagatccccgacgacatcgcgtccgccctgcggtacatcgaggagcgcgaggccttccacgtccagctcacggccgagtacgcgatgctgacccggtactgcgactactacacccagttcagcgacaactccggctacagccagaccacctggcgcgtgtacctgcgctcccacgacttcgaggcctgcatcatgtaccccaaccagcacttctgccggtgcgtgaagaacggggagaagtgcagctccagcaactgggacttcgccaacgagatgaaggactactacagcggcaagcaggccaagttcgacaaggacctcaacctggccctgacggcgctccaccacgccttccgcgggacctccagcgcctacatcgccgccatgctgtccaagaagtccaacgacgacctgatcacctacaccaacaagatcaagacgaagttcccgggcaacgcgctcctgaaggccatcatcgactacatcgcctacatgaagggcctgcccgggatggcctccttcaagcacgacgagttctgggacgagctcctgtacaagcccacccccaccaaggccccgaacctggcgcggggccgcgagagctcctacaacttcaagctcgccatcagctccaagagcatcaagacctgcaagaacgtcaaggacgtggcctgcctgagcccccggagcggggccatctacgcgtccatcatcgcctgcggcgagcccaacgggcccagcgtgtaccgcaagccgtccaacggcgtcttccagagctccacggaccagagcatgtactgcctgctcgacagccactgcctggaggagttcgaggccatctcccaggaggagctggacgccgtgaagaagtccaagtgctgggagatcgagtaccccgacatcaagcccctccaggagagcgacggcaccaagagctgccggatgaaggactccgggaactgcaacgtggccaccaaccgctggcccgtcatccagtgcgagaacgacaagttctactacagcgagctgcagaaggactacgacaagacccaggacatcggccactactgcctgtccccggggtgcacgaccgtgcggtaccccatcaaccccaagcacatcagcaactgcaactggcaggtctcccgcagctccatcgcgaagatcgacgtgcacaacatcgaggacatcgagcagtacaagaaggccatcacccagaagctccagaccagcctgtccctgttcaagtacgccaagacgaagaacctcccgcacatcaagcccatctacaagtacatcaccatcgagggcaccgagaccgccgagggcatcgagagcgcctacatcgagtccgaggtgcccgcgctggccgggacgagcatcggcttcaagatcaactccaaggaggggaagcacctcctggacgtgatcgcctacgtcaagagcgcctcctacagcagcgtgtacaccaagctgtactccaccggccccaccagcgggatcaacacgaagcacgacgagctgtgcaccggcccgtgccccgccaacatcaaccaccaggtgggctggctcaccttcgcgaaggagcggacctccagctgggggtgcgaggagttcggctgcctggccgtctccgacgggtgcgtgttcggcagctgccaggacatcatcaaggaggagctgtccgtgtaccgcaaggagacggaggaggtcaccgacgtggagctctgcctgaccttcagcgacaagacctactgcacgaacctgaaccccgtgacccccatcatcaccgacctcttcgaggtccagttcaagaccgtggagacgtactccctgccgcggatcgtggccgtccagaaccacgagatcaagatcgggcagatcaacgacctgggcgtgtacagcaagggctgcgggaacgtgcagaaggtcaacggcaccgtgtacgggaacggcgtgccccgcttcgactacctctgccacctggcctcccggaaggaggtcatcgtgcgcaagtgcttcgacaacgactaccaggcgtgcaagttcctgcagagccccgcctcctaccggctcgaggaggacagcgggaccgtgaccgtcatcgactacaagaagatcctgggcaccatcaagatgaaggccatcctgggcgacgtgaagtacaagacgttcgccgacaacgtggacatcaccgccgaggggtcctgcaccggctgcatcaactgcttcgagaacatccactgcgagctcaccctgcacacgaccatcgaggcgagctgccccatcaagtccagctgcaccgtcttccacgaccgcatcctggtgaccccgaacgagcacaagtacgccctcaaggtggtctgcacggagaagcccgggaacaccctgaccatcaaggtgtgcaacaccaagatcgaggcctccatggccctggtcgacgccaagcccatcatcgagctcgcgcccgtggaccagacggcctacatccgggagaaggacgagcgctgcaagacctggatgtgccgcgtgcgggacgagggcctgcaggtcatcctggagccgttcaagaacctcttcgggagctacatcggcatcttctacaccttcatcatcagcatcgtggccctgctggtgatcatctacatcctcctgcccatctgcttcaagctgcgcgacaccctccggaagcacgaggacgcctacaagcgcgagatgaagatccggtga

SEQ ID NO: 12672 - RNA, 4326 nt, synthetic construct
  misc_feature 1..4326: note = derived and/or modified CDS sequence (opt1) from LACV(LACV/06/NY(1)-M (06MS2900303))__GU206118.1__GP
  source 1..4326: mol_type = other RNA
atgatctacatcctggtgctcatcgccgtcaccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacatccgcaacgccaccggggtcttctccaacaacgtggcgatccggaagtggctggtgagcgactggcacgactgccgccccaagaagatcgtcggcgggcacatcaacgtgatcgaggtgggcgacgacctctccctgcacaccgagagctacgtctgctccgccgactgcaccatcggggtggacaaggagacggcccaggtgcggctgcagaccgacaccaccaaccacttcgagatcgccggcacgaccgtcaagagcggctggttcaagtccaccacctacatcacgctcgaccagacctgcgagcacctgaaggtgagctgcgggcccaagtccatccagttccacgcgtgcttcaaccagcacatgagctgcgtgcgcttcctgcaccggaccatcctccccggctccatcgccaacagcatctgccagaacatcgagatcatcatcctggtcaccctggccctcctgatcttcatcctgctctccatcctgagcaagacgtacatctgctacctgctcatgccggtgttcatccccatcgcctacgtgtacggggtcatctacaacaagtcctgcaagaagtgcaagctgtgcggcctggtgtaccaccccttcaccgagtgcgggacccactgcgtgtgcggcgcccgctacgacaccagcgaccggatgaagctccaccgcgcgtccggcctgtgccccgggtacaagagcctgcgggccgcccgcgtcatgtgcaagagcaagggcccggcctccatcctcagcatcatcacggccgtgctggtcctgaccttcgtgacccccatcaactccatggtgctcggggagagcaaggaggtcttcgagctggaggagctgcccgacgacatgctcgagatggcgctgcggatcaacttctactacttcacgtgcatcctgaactacgccgtgtcctggagcctcgtgatcatcggcctgctgaccggcctcctgttcaagcgctaccagcacaagttcctgaacatctacgccatgtactgcgaggagtgcgacatgtaccacgacaagtccgggctcaagcggcacggcgacttcaccaacaagtgccgccagtgcacgtgcgggcagtacgaggacgccaccggcctgatgacccaccggaagacctacaactgcctggtccagtacaaggccaagtggatcatgaacttcctcatcatctacatcttcctggtgctgatcaaggacagcgcgatcatcgtgcaggccgccgggaccgacttctccagctgcctcgagaccgagtccatcaactggaactgcacgggccccttcctgaacctgggcaactgccagaagcagcagaagaaggagccgtacgccaacatcgccgcgcagctcaaggggctgaaggccatcagcgtcctggacatccccatgatcaccgagatccccgacgacatcgcctccgccctgcgctacatcgaggagcgggaggcgttccacgtgcagctcaccgccgagtacgccatgctgacccgctactgcgactactacacgcagttcagcgacaactccggctacagccagaccacctggcgggtgtacctgcgctcccacgacttcgaggcctgcatcatgtaccccaaccagcacttctgccgctgcgtcaagaacggggagaagtgcagctccagcaactgggacttcgccaacggcatgaaggactactacagcgggaagcaggcgaagttcgacaaggacctcaacctggccctgaccgccctccaccacgccttccggggcacctccagcgcctacatcgcgacgatgctgtccaagaagtccaacgacgacctgatcgcctacaccaacaagatcaagaccaagttcccgggcaacgccctcctgaaggccatcatcgactacatcgcctacatgaaggggctgcccggcatggcgaacttcaagcacgacgagttctgggacgagctcctgtacaagcccacccccacgaaggccccgaacctggcccgcgggcgggagagcagctacaacttcaagctcgccatctccagcaagtccatcaagacctgcaagaacgtgaaggacgtggcgtgcctgagcccccgctccggcgccatctacgccagcatcatcgcctgcggggagcccaacggcccctccgtctaccggaagccgctgaacggcgtgttccagagctccaccgaccagagcatgtactgcctcctggactcccactgcctggaggagttcgaggccatcagccaggaggagctcgacgcggtgaagaagtccaagtgctgggagatcgagtacagcgacatcaagcccctgcaggagagcgacgggaccaagtcctgccgcatgaaggacagcggcaactgcaacgtcgccacgaaccggtggcccgtgatccagtgcgagaacgacaagttctactactccgagctgcagaaggactacgacaagacccaggacatcgggcactactgcctcagccccggctgcaccaccgtgcgctacccgatcaaccccaagcacatctccaactgcaactggcaggtcagccggtccagcatcgccaagatcgacgtgcacaacatcgaggacatcgagcagtacaagaaggccatcacgcagaagctgcagacctccctgagcctcttcaagtacgccaagaccaagaacctgccccacatcaagccgatctacaagtacatcaccatcgagggcacggagaccgcggaggggatcgagtccgcctacatcgagagcgaggtgcccgccctggccggcacctccatcgggttcaagatcaacagcaaggagggcaagcacctcctggacgtcatcgcctacgtgaagtccgcgagctactccagcgtgtacaccaagctgtacagcacggggcccacctccggcatcaacaccaagcacgacgagctctgcaccggcccctgcccggccaacatcaaccaccaggtcgggtggctgacgttcgccaaggagcgcaccagctcctggggctgcgaggagttcgggtgcctggccgtgagcgacggctgcgtgttcgggtcctgccaggacatcatcaaggaggagctcagcgtctaccggaaggagaccgaggaggtgaccgacgtggagctgtgcctgacgttctccgacaagacctactgcaccaacctcaaccccgtcacccccatcatcacggacctgttcgaggtgcagttcaagaccgtggagacctacagcctgccccgcatcgtcgcggtgcagaaccacgagatcaagatcggccagatcaacgacctcggcgtgtactccaaggggtgcggcaacgtccagaaggtgaacgggaccgtgtacggcaacggggtcccgcggttcgactacctgtgccacctggccagccgcaaggaggtgatcgtgcggaagtgcttcgacaacgactaccaggcctgcaagttcctccagtcccccgccagctaccgcctggaggaggactccggcacggtcaccgtgatcgactacaagaagatcctgggcaccatcaagatgaaggccatcctcggggacgtgaagtacaagaccttcgcggacaacgtcgacatcaccgccgagggcagctgcacggggtgcatcaactgcttcgagaacatccactgcgagctgaccctgcacaccaccatcgaggcctcctgccccatcaagagctcctgcacggtgttccacgaccggatcctcgtgacccccaacgagcacaagtacgccctgaaggtcgtgtgcaccgagaagccgggcaacaccctgacgatcaaggtctgcaacaccaagatcgaggccagcatggcgctcgtggacgccaagcccatcatcgagctggcccccgtggaccagaccgcctacatccgcgagaaggacgagcggtgcaagacctggatgtgccgcgtccgcgacgaggggctccaggtgatcctggagcccttcaagaacctgttcggctcctacatcggcatcttctacacgttcatcatcagcatcgtgaccctgctcgtcatcatctacatcctgctgccgatctgcttcaaggtgcgggacaccctccgcaagcacgaggacgcctacaagcgggagatgaagatccgctga

SEQ ID NO: 12673 - RNA, 4326 nt, synthetic construct
  misc_feature 1..4326: note = derived and/or modified CDS sequence (opt1) from LACV(LACV/06/NY(2)-M (06MS350140))__GU206109.1__GP
  source 1..4326: mol_type = other RNA
atgatctacatcctggtgctcatcgccgtcaccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacatccgcaacgccaccggggtcttctccaacaacgtggcgatccggaagtggctggtgagcgactggcacgactgccgccccaagaagatcgtcggcgggcacatcaacgtgatcgaggtgggcgacgacctctccctgcacaccgagagctacgtctgctccgccgactgcaccatcggggtggacaaggagacggcccaggtgcggctgcagaccgacaccaccaaccacttcgagatcgccggcacgaccgtcaagagcggctggttcaagtccaccacctacatcacgctcgaccagacctgcgagcacctgaaggtgagctgcgggcccaagtccatccagttccacgcgtgcttcaaccagcacatgagctgcgtgcgcttcctgcaccggaccatcctccccggctccatcgccaacagcatctgccagaacatcgagatcatcatcctggtcaccctggccctcctgatcttcatcctgctctccatcctgagcaagacgtacatctgctacctgctcatgccggtgttcatccccatcgcctacgtgtacggggtcatctacaacaagtcctgcaagaagtgcaagctgtgcggcctggtgtaccaccccttcaccgagtgcgggacccactgcgtgtgcggcgcccgctacgacaccagcgaccggatgaagctccaccgcgcgtccggcctgtgccccgggtacaagagcctgcgggccgcccgcgtcatgtgcaagagcaagggcccggcctccatcctcagcatcatcacggccgtgctggtcctgaccttcgtgacccccatcaactccatggtgctcggggagagcaaggaggtcttcgagctggaggagctgcccgacgacatgctcgagatggcgctgcggatcaacttctactacttcacgtgcatcctgaactacgccgtgtcctggagcctcgtgatcatcggcctgctgaccggcctcctgttcaagcgctaccagcacaagttcctgaacatctacgccatgtactgcgaggagtgcgacatgtaccacgacaagtccgggctcaagcggcacggcgacttcaccaacaagtgccgccagtgcacgtgcgggcagtacgaggacgccaccggcctgatgacccaccggaagacctacaactgcctggtccagtacaaggccaagtggatcatgaacttcctcatcatctacatcttcctggtgctgatcaaggacagcgcgatcatcgtgcaggccgccgggaccgacttctccagctgcctcgagaccgagtccatcaactggaactgcacgggccccttcctgaacctgggcaactgccagaagcagcagaagaaggagccgtacgccaacatcgccgcgcagctcaaggggctgaaggccatcagcgtcctggacatccccatgatcaccgagatccccgacgacatcgcctccgccctgcgctacatcgaggagcgggaggcgttccacgtgcagctcaccgccgagtacgccatgctgacccgctactgcgactactacacgcagttcagcgacaactccggctacagccagaccacctggcgggtgtacctgcgctcccacgacttcgaggcctgcatcatgtaccccaaccagcacttctgccgctgcgtcaagaacggggagaagtgcagctccagcaactgggacttcgccaacgagatgaaggactactacagcggcaagcaggcgaagttcgacaaggacctcaacctggccctgaccgccctccaccacgccttccgggggacctccagcgcctacatcgcgacgatgctgtccaagaagtccaacgacgacctgatcgcctacaccaacaagatcaagaccaagttcccgggcaacgccctcctgaaggccatcatcgactacatcgcctacatgaagggcctgcccgggatggcgaacttcaagcacgacgagttctgggacgagctcctgtacaagcccacccccacgaaggccccgaacctggcccgcggccgggagagcagctacaacttcaagctcgccatctccagcaagtccatcaagacctgcaagaacgtgaaggacgtggcgtgcctgagcccccgctccggggccatctacgccagcatcatcgcctgcggcgagcccaacgggccctccgtctaccggaagccgctgaacggcgtgttccagagctccaccgaccagagcatgtactgcctcctggactcccactgcctggaggagttcgaggccatcagccaggaggagctcgacgcggtgaagaagtccaagtgctgggagatcgagtaccccgacatcaagcccctgcaggagagcgacggcaccaagagctgccgcatgaaggactccgggaactgcaacgtcgccacgaaccggtggcccgtgatccagtgcgagaacgacaagttctactacagcgagctgcagaaggactacgacaagacccaggacatcggccactactgcctctccccggggtgcaccaccgtgcgctaccccatcaaccccaagcacatcagcaactgcaactggcaggtctcccggagctccatcgccaagatcgacgtgcacaacatcgaggacatcgagcagtacaagaaggccatcacgcagaagctgcagaccagcctgtccctcttcaagtacgccaagaccaagaacctgccgcacatcaagcccatctacaagtacatcaccatcgagggcacggagaccgcggagggcatcgagagcgcctacatcgagtccgaggtgcccgccctggccgggaccagcatcggcttcaagatcaactccaaggaggggaagcacctcctggacgtcatcgcctacgtcaagagcgcgtcctacagctccgtgtacaccaagctgtacagcacgggccccaccagcgggatcaacaccaagcacgacgagctctgcaccggcccgtgccccgccaacatcaaccaccaggtgggctggctgacgttcgccaaggagcgcacctccagctgggggtgcgaggagttcggctgcctggccgtgtccgacgggtgcgtgttcggcagctgccaggacatcatcaaggaggagctctccgtctaccggaaggagaccgaggaggtgaccgacgtggagctgtgcctgacgttcagcgacaagacctactgcaccaacctcaaccccgtcacccccatcatcacggacctgttcgaggtgcagttcaagaccgtggagacctactccctgccgcgcatcgtcgcggtgcagaaccacgagatcaagatcgggcagatcaacgacctcggcgtgtacagcaagggctgcgggaacgtccagaaggtgaacggcaccgtgtacgggaacggcgtcccccggttcgactacctgtgccacctggcctcccgcaaggaggtgatcgtgcggaagtgcttcgacaacgactaccaggcctgcaagttcctccagagccccgcctcctaccgcctggaggaggacagcgggacggtcaccgtgatcgactacaagaagatcctgggcaccatcaagatgaaggccatcctcggcgacgtgaagtacaagaccttcgcggacaacgtcgacatcaccgccgaggggtcctgcacgggctgcatcaactgcttcgagaacatccactgcgagctgaccctgcacaccaccatcgaggccagctgccccatcaagtccagctgcacggtgttccacgaccggatcctcgtgaccccgaacgagcacaagtacgccctgaaggtcgtgtgcaccgagaagcccgggaacaccctgacgatcaaggtctgcaacaccaagatcgaggcctccatggcgctcgtggacgccaagcccatcatcgagctggcccccgtggaccagaccgcctacatccgcgagaaggacgagcggtgcaagacctggatgtgccgcgtccgcgacgagggcctccaggtgatcctggagccgttcaagaacctgttcgggagctacatcggcatcttctacacgttcatcatctccatcgtgaccctgctcgtcatcatctacatcctgctgcccatctgcttcaagctccgggacaccctgcgcaagcacgaggacgcctacaagcgggagatgaagatccgctga

SEQ ID NO: 12674 - RNA, 4326 nt, synthetic construct
  misc_feature 1..4326: note = derived and/or modified CDS sequence (opt1) from LACV(LACV/06/NY(3)-M (06MS270036))__GU206121.1__GP
  source 1..4326: mol_type = other RNA
atgatctacatcctggtgctcatcgccgtcaccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacatccgcaacgccaccggggtcttctccaacaacgtggcgatccggaagtggctggtgagcgactggcacgactgccgccccaagaagatcgtcggcgggcacatcaacgtgatcgaggtgggcgacgacctctccctgcacaccgagagctacgtctgctccgccgactgcaccatcggggtggacaaggagacggcccaggtgcggctgcagaccgacaccaccaaccacttcgagatcgccggcacgaccgtcaagagcggctggttcaagtccaccacctacatcacgctcgaccagacctgcgagcacctgaaggtgagctgcgggcccaagtccatccagttccacgcgtgcttcaaccagcacatgagctgcgtgcgcttcctgcaccggaccatcctccccggctccatcgccaacagcatctgccagaacatcgagatcatcatcctggtcaccctggccctcctgatcttcatcctgctctccatcctgagcaagacgtacatctgctacctgctcatgccggtgttcatccccatcgcctacgtgtacggggtcatctacaacaagtcctgcaagaagtgcaagctgtgcggcctggtgtaccaccccttcaccgagtgcgggacccactgcgtgtgcggcgcccgctacgacaccagcgaccggatgaagctccaccgcgcgtccggcctgtgccccgggtacaagagcctgcgggccgcccgcgtcatgtgcaagagcaagggcccggcctccatcctcagcatcatcacggccgtgctggtcctgaccttcgtgacccccatcaactccatggtgctcggggagagcaaggaggtcttcgagctggaggagctgcccgacgacatgctcgagatggcgctgcggatcaacttctactacttcacgtgcatcctgaactacgccgtgtcctggagcctcgtgatcatcggcctgctgaccggcctcctgttcaagcgctaccagcacaagttcctgaacatctacgccatgtactgcgaggagtgcgacatgtaccacgacaagtccgggctcaagcggcacggcgacttcaccaacaagtgccgccagtgcacgtgcgggcagtacgaggacgccaccggcctgatgacccaccggaagacctacaactgcctggtccagtacaaggccaagtggatcatgaacttcctcatcatctacatcttcctggtgctgatcaaggacagcgcgatcatcgtgcaggccgccgggaccgacttctccagctgcctcgagaccgagtccatcaactggaactgcacgggccccttcctgaacctgggcaactgccagaagcagcagaagaaggagccgtacgccaacatcgccgcgcagctcaaggggctgaaggccatcagcgtcctggacatccccatgatcaccgagatccccgacgacatcgcctccgccctgcgctacatcgaggagcgggaggcgttccacgtgcagctcaccgccgagtacgccatgctgacccgctactgcgactactacacgcagttcagcgacaactccggctacagccagaccacctggcgggtgtacctgcgctcccacgacttcgaggcctgcatcatgtaccccaaccagcacttctgccgctgcgtcaagaacggggagaagtgcagctccagcaactgggacttcgccaacggcatgaaggactactacagcgggaagcaggcgaagttcgacaaggacctcaacctggccctgaccgccctccaccacgccttccggggcacctccagcgcctacatcgcgacgatgctgtccaagaagtccaacgacgacctgatcgcctacaccaacaagatcaagaccaagttcccgggcaacgccctcctgaaggccatcatcgactacatcgcctacatgaaggggctgcccggcatggcgaacttcaagcacgacgagttctgggacgagctcctgtacaagcccacccccacgaaggccccgaacctggcccgcgggcgggagagcagctacaacttcaagctcgccatctccagcaagtccatcaagacctgcaagaacgtgaaggacgtggcgtgcctgagcccccgctccggcgccatctacgccagcatcatcgcctgcggggagcccaacggcccctccgtctaccggaagccgctgaacggcgtgttccagagctccaccgaccagagcatgtactgcctcctggactcccactgcctggaggagttcgaggccatcagccaggaggagctcgacgcggtgaagaagtccaagtgctgggagatcgagtacagcgacatcaagcccctgcaggagagcgacgggaccaagtcctgccgcatgaaggacagcggcaactgcaacgtcgccacgaaccggtggcccgtgatccagtgcgagaacgacaagttctactactccgagctgcagaaggactacgacaagacccaggacatcgggcactactgcctcagccccggctgcaccaccgtgcgctacccgatcaaccccaagcacatctccaactgcaactggcaggtcagccggtccagcatcgccaagatcgacgtgcacaacatcgaggacatcgagcagtacaagaaggccatcacgcagaagctgcagacctccctgagcctcttcaagtacgccaagaccaagaacctgccccacatcaagccgatctacaagtacatcaccatcgagggcacggagaccgcggaggggatcgagtccgcctacatcgagagcgaggtgcccgccctggccggcacctccatcgggttcaagatcaacagcaaggagggcaagcacctcctggacgtcatcgcctacgtgaagtccgcgagctactccagcgtgtacaccaagctgtacagcacggggcccacctccggcatcaacaccaagcacgacgagctctgcaccggcccctgcccggccaacatcaaccaccaggtcgggtggctgacgttcgccaaggagcgcaccagctcctggggctgcgaggagttcgggtgcctggccgtgagcgacggctgcgtgttcgggtcctgccaggacatcatcaaggaggagctcagcgtctaccggaaggagaccgaggaggtgaccgacgtggagctgtgcctgacgttctccgacaagacctactgcaccaacctcaaccccgtcacccccatcatcacggacctgttcgaggtgcagttcaagaccgtggagacctacagcctgccccgcatcgtcgcggtgcagaaccacgagatcaagatcggccagatcaacgacctcggcgtgtactccaaggggtgcggcaacgtccagaaggtgaacgggaccgtgtacggcaacggggtcccgcggttcgactacctgtgccacctggccagccgcaaggaggtgatcgtgcggaagtgcttcgacaacgactaccaggcctgcaagttcctccagtcccccgccagctaccgcctggaggaggactccggcacggtcaccgtgatcgactacaagaagatcctgggcaccatcaagatgaaggccatcctcggggacgtgaagtacaagaccttcgcggacaacgtcgacatcaccgccgagggcagctgcacggggtgcatcaactgcttcgagaacatccactgcgagctgaccctgcacaccaccatcgaggcctcctgccccatcaagagctcctgcacggtgttccacgaccggatcctcgtgacccccaacgagcacaagtacgccctgaaggtcgtgtgcaccgagaagccgggcaacaccctgacgatcaaggtctgcaacaccaagatcgaggccagcatggcgctcgtggacgccaagcccatcatcgagctggcccccgtggaccagaccgcctacatccgcgagaaggacgagcggtgcaagacctggatgtgccgcgtccgcgacgaggggctccaggtgatcctggagcccttcaagaacctgttcggctcctacatcggcatcttctacacgttcatcatcagcatcgtgaccctgctcgtcatcatctacatcctgctgccgatctgcttcaagctccgggacaccctgcgcaagcacgaggacgcctacaagcgggagatgaagatccgctga

SEQ ID NO: 12675 - RNA, 4326 nt, synthetic construct
  misc_feature 1..4326: note = derived and/or modified CDS sequence (opt1) from LACV(LACV/65/OH-M (W17258))__GU206124.1__GP
  source 1..4326: mol_type = other RNA
atgatccgcatcctggtgctcatcgccgtcaccgccgcgaaccccgtgtaccagcggtgcttccaggacggcgccatcgtgaagcagaacccgagcaaggaggccgtcaccgaggtgtgcctgaaggacgacgtgtccatgatcaagacggaggcccgctacatccggaacgccaccggggtcttcagcaacaacgtggcgatccgcaagtggctggtgtccgactggcacgactgccggcccaagaagatcatcggcgggcacatcaacgtcatcgaggtgggcgacgacctcagcctgcacaccgagtcctacgtgtgcagcgccgactgcaccatcggggtcgacaaggagacggcccaggtgcgcctgcagaccgacaccaccaaccacttcgagatcgccggcacgaccgtgaagtccggctggttcaagagcaccacctacatcacgctcgaccagacctgcgagcacctgaaggtctcctgcgggcccaagagcgtgcagttccacgcgtgcttcaaccagcacatgtcctgcgtgcggttcctgcaccgcaccgtcctccccggcagcatcgccaactccatctgccagaacatcgagatcatcatcctggtgaccctgacgctcctgatcttcatcctgctcagcatcctgtccaagacctacatctgctacctgctcatgccgatcttcatccccatcgcctacgtgtacgggatcatctacaacaagagctgcaagaagtgcaagctgtgcggcctggtctaccaccccttcaccgagtgcgggacccactgcgtgtgcggcgcccggtacgacacgtccgaccgcatgaagctccaccgggccagcggcctgtgccccgggtacaagtccctgcgcgcggcccgggtgatgtgcaagagcaagggcccggccagcatcctctccatcatcaccgccgtcctggtgctgaccttcgtcacccccatcaacagcatggtgctcggggagtccaaggagacgttcgagctggaggagctgcccgacgacatgctcgagatggccagccgcatcgactcctactacttcacgtgcatcctgaactacgcggtgagctggggcctggtcatcatcggcctcctgaccgggctcctgttcaagaagtaccagcaccggttcctgaacgtgtacgccatgtactgcgaggagtgcgacatgtaccacgacaagtccggcctgaagcgccacggggacttcaccaacaagtgccggcagtgcacgtgcggccagtacgaggacgccaccgggctcatggcccaccgcaagacctacaactgcctggtgcagtacaaggccaagtggatgatgaacttcctgatcatctacatcttcctcatcctgatcaaggacagcgcgatcgtcgtgcaggccgccggcaccgacttcacgacctgcctggagaccgagaacatcaactggaactgcaccggccccttcctcaacctggggaactgccagaagcagcagaagaaggagccgtacaccaacatcgccacccagctgaagggcctcaaggccatctccgtgctggacatccccatcatcaccgggatccccgacgacatcgcgggcgccctgcggtacatcgaggagaaggaggacttccacgtccagctgaccatcgagtacgccatgctcagcaagtactgcgactactacacccagttctccgacaacagcgggtactcccagacgacctggcgcgtgtacctgcggagccacgacttcgaggcctgcatcctgtaccccaaccagcacttctgccgctgcgtgaagaacggcgagaagtgctccagctccaactgggacttcgcgaacgagatgaaggacttctacagcggcaagcagaccaagttcgacaaggacctcaacctggccctgaccgccctccaccacgccttccgcgggacgtccagcgcctacatcgcgaccatgctgagcaagaagtccaacgacgacctgatcgcctacaccaacaagatcaagaccaagttcccgggcaacgccctcctgaaggccatcatcgactacatcgcctacatgaagtccctgcccgggatggcgaacttcaagtacgacgagttctgggacgagctcctgtacaagcccaaccccgccaaggccagcaacctggcccggggcaaggagagctcctacaacttcaagctcgccatcagctccaagagcatcaagacgtgcaagaacgtcaaggacgtggcgtgcctgtccccgcgcagcggggccatctacgcctccatcatcgcctgcggcgagcccaacggccccagcgtgtaccggaagccctccgggggcgtcttccagagctccaccgaccgcagcatctactgcctgctcgactcccactgcctggaggagttcgaggcgatcagccaggaggagctggacgccgtgaagaagtccaagtgctgggagatcgagtacccggacgtgaagcccctccaggagggggacggcaccaagagctgccggatgaaggacagcggcaactgcaacgtcgccaccaaccgctggcccgtgatccagtgcgagaacgacaagttctactactccgagctgcagaaggactacgacaagacgcaggacatcgggcactactgcctgagccccggctgcaccaccgtgcggtacccgatcaaccccaagcacatctccaactgcaactggcaggtcagccgctccagcatcgccaagatcgacgtgcacaacatcgaggacatcgagcagtacaagaaggccatcacccagaagctccagacgtccctgagcctgttcaagtacgcgaagaccaagaacctcccccacatcaagccgatctacaagtacatcaccatcgaggggaccgagacggccgagggcatcgagtccgcctacatcgagagcgaggtgcccgccctggccgggacctccatcggcttcaagatcaacagcaaggagggcaagcacctcctggacgtcatcgcgtacgtgaagtccgccagctactccagcgtgtacgccaagctgtactccaccgggcccaccagcggcatcaacacgaagcacgacgagctgtgcaccgggccctgcccggccaacatcaaccaccaggtcggctggctcaccttcgcccgggagcgcaccagctcctgggggtgcgaggagttcggctgcctggcggtgagcgacggctgcgtgttcgggtcctgccaggacatcatcaaggaggagctgagcgtctaccggaaggagacggaggaggtgaccgacgtggagctctgcctgaccttctccgacaagacctactgcacgaacctgaaccccgtcacccccatcatcaccgacctcttcgaggtgcagttcaagaccgtggagacgtacagcctgccccgcatcgtcgccgtgcagaaccacgagatcaagatcggccagatcaacgacctgggggtgtactccaagggctgcgggaacgtccagaaggtgaacggcaccgtgtacggcaacggggtcccgcggttcgactacctctgccacctggccagccgcaaggaggtgatcgtgcggaagtgcttcgacaacgactaccaggcctgcaagttcctgcagtcccccgcgagctaccgcctcgaggaggactccggcaccgtcaccatcatcgactacaagaagatcctggggaccatcaagatgaaggccatcctgggcgacgtgaagtacaagacgttcgccgacagcgtggacatcaccgccgaggggtcctgcaccggctgcatcaactgcttcgagaacatccactgcgagctcaccctgcacacgaccatcgaggccagctgccccatcaagtccagctgcaccgtcttccacgaccggatcctggtgacccccaacgagcacaagtacgcgctcaagatggtgtgcacggagaagccgggcaacaccctgaccatcaaggtctgcaacaccaagatcgaggcctccatggccctggtggacgccaagcccatcatcgagctcgcccccgtcgaccagacggcgtacatccgcgagaaggacgagcggtgcaagacctggatgtgccgcgtgcgcgacgaggggctccaggtgatcctggagcccttcaagaacctgttcggcagctacatcgggatcttctacaccttcatcatctccatcgtcgccctgctggtgatcatctacgtgctcctgccgatctgcttcaagctgcgggacaccctccgcaagcacgaggacgcctacaagcgggagatgaagatccgctga

SEQ ID NO: 12676 - RNA, 4326 nt, synthetic construct
  misc_feature 1..4326: note = derived and/or modified CDS sequence (opt1) from LACV(LACV/67/NY-M (67-8109))__GU206115.1__GP
  source 1..4326: mol_type = other RNA
atgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggaccatctacaacaagtcctgcaagaagtgcaagctgtgcggcctggtctaccaccccttcaccgagtgcgggacgcactgcgtgtgcggcgcccgctacgacaccagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacgcccatcaactccatggtgctcggggagagcaaggagaccttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacctacaactgcctggtgcagtacaaggcgaagtggatgatgaacttcctcatcatctacatcttcctgatcctgatcaaggactccgccatcgtcgtgcaggccgccggcaccgacttcaccacgtgcctcgagaccgagagcatcaactggaactgcaccggccccttcctgaacctggggaactgccagaagcagcagaagaaggagccgtacaccaacatcgccacgcagctcaagggcctgaaggcgatctccgtgctggacgtccccatcatcaccgggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacgtggcgggtgtacctgcgcagccacgacttcgaggcgtgcatcctctaccccaaccagcacttctgccggtgcgtcaagaacggcgagaagtgctccagctccaaccgcgacttcgccaacgagatgaaggactactacagcggcaagcagaccaagttcgacaaggacctgaacctggccctcaccgccctgcaccacgccttccgcgggaccagctccgcgtacatcgccacgatgctgagcaagaagtccaacgacgacctcatcgcctacaccaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccggggcaaggagagctcctacaacttcaagctggcgatcagctccaagagcatcaagacctgcaagaacgtgaaggacgtggcctgcctgtccccgcgcagcggggccatctacgcctccatcatcgcgtgcggcgagcccaacggccccagcgtctaccggaagccctccgggggcgtgttccagagctccacggaccagagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaagacccaggacatcggccactactgcctctcccccgggtgcacgaccgtccgctaccccatcaacccgaagcacatcagcaactgcaactggcaggtctcccggagctccatcgccaagatcgacgtgcacaacatcgaggacatcgagcagtacaagaaggcgatcacccagaagctgcagaccagcctgtccctcttcaagtacgccaagacgaagaacctgccccacatcaagcccatctacaagtacatcaccatcgagggcaccgagaccgccgaggggatcgagagcgcctacatcgagtccgaggtgccggccctggcgggcacgagcatcggcttcaagatcaactccaaggaggggaagcacctcctggacgtgatcgcctacgtcaagagcgcctcctacagctccgtgtacaccaagctgtacagcaccggccccaccagcgggatcaacacgaagcacgacgagctctgcaccggcccctgccccgccaacatcaaccaccaggtggggtggctgaccttcgcccgcgagcggacctccagctggggctgcgaggagttcggctgcctggcggtgtccgacgggtgcgtcttcggcagctgccaggacatcatcaaggaggagctctccgtgtaccgcaaggagacggaggaggtgaccgacgtcgagctgtgcctgaccttcagcgacaagacctactgcacgaacctcaacccggtgacccccatcatcaccgacctgttcgaggtgcagttcaagaccgtcgagacgtactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcctgcaagttcctccagagcccggcgtcctaccggctggaggaggacagcgggaccgtcaccatcatcgactacaagaagatcctgggcaccatcaagatgaaggccatcctcggggacgtgaagtacaagacgttcgccgactccgtggacatcaccgccgagggcagctgcaccggctgcatcaactgcttcgagaacatccactgcgagctgaccctgcacacgaccatcgaggcctcctgccccatcaagagctcctgcaccgtcttccacgaccgcatcctcgtgacccccaacgagcacaagtacgcgctgaagatggtgtgcacggagaagcccgggaacaccctgaccatcaaggtctgcaacaccaagatcgaggccagcatggccctcgtggacgccaagccgatcatcgagctggcccccgtcgaccagacggcgtacatccgggagaaggacgagcgctgcaagacctggatgtgccgggtgcgcgacgagggcctccaggtgatcctggagcccttcaagaacctgttcgggtcctacatcggcatcttctacaccttcatcatcagcatcgtcgccctgctcgtgatcatctacgtgctgctgcccatctgcttcaagctccgcgacaccctgcggaagcacgaggacgcctacaagcgcgagatgaagatccggtga

SEQ ID NO: 12677 - RNA, 4326 nt, synthetic construct
  misc_feature 1..4326: note = derived and/or modified CDS sequence (opt1) from LACV(LACV/74/NY-M (74-32813))__GU206142.1__GP
  source 1..4326: mol_type = other RNA
atgatccgcatgctggtgctcatcgtcgtgaccgccgccagccccgtgtaccagcggtgcttccaggacggcgcgatcgtcaagcagaacccgtccaaggaggccgtgaccgaggtgtgcctgaaggacgacgtcagcatgatcaagacggaggcccgctacgtgaagaacgccaccggggtgttctccaacaacgtcgccatccggaagtggctggtgagcgactggcacgactgccgccccaagaagatcgtgggcgggcacatcaacgtcatcgaggtgggcgacgacctctccctgcacaccgagagctacgtgtgctccgcggactgcaccatcggggtcgacaaggagacggcccaggtgcggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcctgcttcaaccagcacatgagctgcgtgcgcttcctgcaccggaccatcctccccggctccatcgcgaacagcatctgccagaacatcgagatcatcatcctggtcaccctgacgctcctgatcttcatcctgctctccatcctgagcaagacctacatctgctacctgctcatgccgatcttcatccccatcgcctacatgtacggggtgatctacaacaagtcctgcaagaagtgcaagctgtgcggcctggtgtaccaccccttcaccgagtgcgggacccactgcgtctgcggcgcccgctacgacacgagcgaccggatgaagctccaccgcgcctccggcctgtgccccgggtacaagagcctgcgggccgcgcgcgtgatgtgcaagagcaagggcccggcctccatcctcagcatcatcaccgccgtcctggtgctgaccttcgtgacccccatcaactccatggtcctcggggagagcaaggagacgttcgagctggaggagctgcccgacgacatgctcgagatggccctgcggatcaactcctactacttcacgtgcatcctgaactacgccgtgagctggggcctcatcatcgcgggcctgctggtggggctcatcttcaagaagtaccagcaccgcttcctgaacatctacgccatgtactgcgaggagtgcaacatgtaccacgacaagtccggcctgaagcggcacggggacttcaccaacaagtgccgccagtgcacgtgcggccagtacgaggacgccaccgggctcatcacccaccggaagacctacaactgcctggtccagtacaaggccaagtggatgatgaacttcctgatcatctacatcttcctcatcctgatcaaggacagcgccatcgtggtgcaggcgaccggcaccgacttcacgacctgcctggagaccgagtccatcaactggaactgcaccggccccttcctcaacctggggaactgccagaagcagcagaagaaggagccgtacaccaacatcgccacccagctgaagggcctcaaggccatcagcgtcctggacatccccatcatcacctccatccccgacgacatcgccggggccctgcgctacatcgaggagaaggaggacttccacgtgcagctgaccacggagtacgcgatgctcagcaagtactgcgactactacacccagttctccgacaacagcggctactcccagaccacctggcgggtgtacctgcgcagccacgacttcgaggcctgcatcctgtaccccaaccagcacttctgcaagtgcgtcaagaacggggagaagtgctccagctccaactgggacttcgccaacgagatgaagaactactacagcggcaagcaggccaagttcgacaaggacctcaacctggcgctgacggccctccaccacgccttccggggcaccagctccgcctacatcgccgcgatgctgagcaagaagtccaacgacgacctgatcgcctacaccaacaagatcaaggccaagttcccggggaacgccctcctgaaggccatcatcgactacatcgcgtacatgaagggcctgcccgagatggccaacttcaagtacgacgagttctgggacgagctcctgtacaagcccaaccccgccaaggccagcaacctggcccgcgggaaggagtccagctacaacttcaagctcgcgatctccagcaagtccatcaagacctgcaagaacgtgaaggacgtggcctgcctgagcccgcgctccggcgccatctacagctccatcatcgcctgcggggagcccaacggccccagcgtctaccggaagccctccggcggggtgttccagagctccacggaccgcagcatctactgcctgctcgacagccactgcctggaggagttcgaggcgatctcccaggaggagctggacgccgtgaagaagtccaagtgctgggagatcgagtacccggacgtccggcccctccaggagagcgacggcgccaagagctgccgcatgaaggactccgggaactgcaacgtggccaccaaccggtggcccgtgatgcagtgcgagaacgacaagttctactacagcgagctgcagaaggactacgacaagacccaggacatcggccactactgcctgtcccccggctgcaccacgatccgctacccgatcaaccccaagcacatcagcaactgcaactggcaggtctcccggagctccatcgccaagatcgacgtgcacaacgtggaggacatcgagcagtacaagaaggcgatcacccagaagctccagaccagcctgtccctgttcaagtacgccaagaccaagaacctcccccacatcaagccgatctacaagtacatcacgatcgaggggaccgagaccgccgagggcatcgagagcgcctacatcgagtccgaggtccccgccctggcggggaccagcgtgggcttcaagatcaactccaaggaggggaagcacctcctggacgtgatcgcctacgtcaagagcgcctcctacagcagcgtgtacgccaagctgtactccacgggccccaccagcggcatcaacaccaagcacgacgagctgtgcaccgggccctgcccggccaacatcaaccaccaggtgggctggctcacgttcgcgcgcgagcggacctccagctgggggtgcgaggagttcggctgcctggccgtctccgacgggtgcgtgttcggcagctgccaggacatcatcaaggaggagctgtccgtgtaccgcaaggagaccgaggaggtcaccaacgtggagctctgcctgacgttcagcgacaagacctactgcaccaacctgaaccccgtgacccccatcatcacggacctcttcgaggtccagttcaagaccgtggagacctactccctgccccggatcgtggccgtccagaaccacgagatcaagatcggccagatcaacgacctgggggtgtacagcaagggctgcgggaacgtgcagaaggtcaacggcaccgtgtacgggaacggcgtgccgcgcttcgactacctctgccacctggcctcccggaaggaggtcatcgtgcgcaagtgcttcgacaacgactaccaggcgtgcaagttcctgcagagccccgcctcctaccggctcgaggaggacagcggcacggtgaccatcatcgactacaagaagatcctggggaccatcaagatgaaggccatcctgggcgacgtcaagtacaagaccttcgccgactccgtggacatcaccgccgaggggagctgcgcgggctgcatcaactgcttcgagaacatccactgcgagctcacgctgcacaccaccatcgaggcctcctgccccatcaagagctcctgcaccgtgttccacgaccgcatcctggtcacgcccaacgagcacaagtacgccctcaagatggtgtgcaccgagaagccggggaacaccctgaccatcaaggtctgcaacacgcggatcgaggccagcatggccctggtggacgcgaagcccatcatcgagctcgcccccgtggaccagaccgcctacatccgcgagaaggacgagcggtgcaagacctggatgtgccgcgtccgcgacgagggcctccaggtgatcctggagcccttcaagaacctgttcggcagctacatcgggatcttctacaccttcatcatctccatcatcgccctgctggtgatcatctacgtcctcctgccgatctgcttcaagctgcgggacacgctccgcaagcacgacgacgcctacaagcgggagatgaagatccgctga

SEQ ID NO: 12678 - RNA, 4326 nt, synthetic construct
  misc_feature 1..4326: note = derived and/or modified CDS sequence (opt1) from LACV(LACV/93/MO-H)__GU206139.1__GP
  source 1..4326: mol_type = other RNA
atgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacatctacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacgtacaactgcctggtgcagtacaaggcgaagtggatgatgaacttcctcatcatctacatcttcctgatcctgatcaaggactccgccatcgtggtccaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtgcccatcatcacggggatccccgacgacatcgccggcgccctgcgctacatcgaggagaaggaggacttccacgtccagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtgaagaacggcgagaagtgctccagctccaactggggcttcgccaacgagatgaaggactactacagcgggaagcagacgaagttcgacaaggacctgaacctggccctcaccgccctgcaccacgccttccgcggcaccagctccgcgtacatggccaccatgctgagcaagaagtccaacgacgacctcatcgcctacacgaacaagatcaagaccaagttcccggggaacgccctgctgaaggccatcatcgactacatcgcgtacatgaagtccctccccggcatggccaacttcaagtacgacgagttctgggacgagctgctgtacaagcccaaccccgccaaggccagcaacctcgcccgcgggaaggagagctcctacaacttcaagctggcgatcagctccaagagcatcaagacctgcaagaacgtcaaggacgtggcctgcctgtccccgcggagcggcgccatctacgcctccatcatcgcgtgcggcgagcccaacgggcccagcgtgtaccgcaagccctccggcggggtcttccagagctccaccgaccggagcatctactgcctcctggacagccactgcctggaggagttcgaggccatcggccaggaggagctcgacgccgtgaagaagtccaagtgctgggagatcgagtacccggacgtgaagctgatccaggagggcgacgggaccaagagctgccgcatgaaggactccggcaactgcaacgtcgccaccaaccggtggcccgtgatccagtgcgacaacgacaagttctactacagcgagctgcagaaggactacgacaagacccaggacatcgggcactactgcctctcccccggctgcaccacggtgcgctaccccatcaacccgaagcacatcagcaactgcaactggcaggtctcccggagctccatcgccaagatcgacgtgcacaacatcgaggacatcgagcagtacaagaaggcgatcacccagaagctgcagaccagcctgtccctcttcaagtacgccaagaccaagaacctgccccacatcaagcccatctacaagtacatcacgatcgaggggaccgagaccgccgagggcatcgagagcgcctacatcgagtccgaggtgccggccctggcgggcaccagcatcgggttcaagatcaactccaaggagggcaagcacctcctggacgtcatcgcctacgtcaagagcgcctcctacagctccgtgtacacgaagctgtacagcaccgggcccaccagcggcatcaacaccaagcacgacgagctctgcacggggccctgccccgccaacatcaaccaccaggacggctggctgaccttcgcccgcgagcggacctccagctggggctgcgaggagttcgggtgcctggcggtgtccgacggctgcgtgttcgggagctgccaggacatcatcaaggaggagctctccgtgtaccgcaaggagaccgaggaggtcacggacgtggagctgtgcctgaccttcagcgacaagacctactgcaccaacctcaacccggtgacgcccatcatcaccgacctgttcgaggtccagttcaagaccgtggagacctactccctgccccggatcgtggccgtccagaaccacgagatcaagatcggccagatcaacgacctcggggtgtacagcaagggctgcggcaacgtgcagaaggtcaacgggacgatctacggcaacggggtgccccgcttcgactacctgtgccacctggcctcccggaaggaggtgatcgtccgcaagtgcttcgacaacgactaccaggcctgcaagttcctccagagcccggcgtcctaccggctggaggaggacagcggcaccgtgaccatcatcgactacaagaagatcctggggaccatcaagatgaaggccatcctcggcgacgtgaagtacaagaccttcgccgactccgtcgacatcacggccgagggcagctgcaccgggtgcatcaactgcttcgagaacatccactgcgagctgaccctgcacaccacgatcgaggcctcctgccccatcaagagctcctgcaccgtgttccacgaccgcatcctcgtgacccccaacgagcacaagtacgcgctgaaggtcgtgtgcaccgagaagcccggcaacacgctgaccatcgaggtgtgcaacaccaagatcgaggccagcatggccctcgtcgacgccaagccgatcatcgagctggcccccgtggaccagaccacgtacatccgggagaaggacgagcgctgcaagacctggatgtgccgggtccgcgacgaggggctccaggtgatcctggagcccttcaagaacctgttcggctcctacatcggcatcttctacaccttcatcatcagcatcgtggcgctgctcgtcatcatctacgtgctgctgcccatctgcttcaagctccgcgacaccctgcggaagcacgaggacgcctacaagcgcgagatgaagatccggtga

SEQ ID NO: 12679 - RNA, 4326 nt, synthetic construct
  misc_feature 1..4326: note = derived and/or modified CDS sequence (opt1) from LACV(LACV/95/OH-H (CCH-MB96))__GU206136.1__GP
  source 1..4326: mol_type = other RNA
atgatccgcatcctggtgctcatcgccgtcaccgccgcgagccccgtgtaccagcggtgcttccaggacggcgccatcgtgaagcagaacccgtccaaggaggccgtcaccgaggtgtgcctgaaggacgacgtgagcatgatcaagacggaggcccgctacatccggaacgccaccggggtcttctccaacaacgtggcgatccgcaagtggctggtgagcgactggcacgactgccggcccaagaagatcatcggcgggcacatcaacgtcatcgaggtgggcgacgacctctccctgcacaccgagagctacgtgtgctccgccgactgcaccatcggggtcgacaaggagacggcccaggtgcgcctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcggttcctgcaccgcaccatcctccccggctccatcgccaacagcatctgccagaacatcgagatcatcatcctggtcaccctgacgctcctgatcttcatcctgctctccatcctgagcaagacctacatctgctacctgctcatgccgatcttcatccccatcgcctacgtgtacgggatcatctacaacaagtcctgcaagaagtgcaagctgtgcggcctggtgtaccaccccttcaccgagtgcgggacccactgcgtctgcggcgcccggtacgacacgagcgaccgcatgaagctccaccgggcctccggcctgtgccccgggtacaagagcctgcgcgcggcccgggtgatgtgcaagagcaagggcccggcctccatcctcagcatgatcaccgccgtgctggtcctgaccttcgtgacccccatcaactccatggtcctcggggagagcaaggagacgttcgagctggaggagctgcccgacgacatgctcgagatggtgtcccgcatcaacagctactacttcacgtgcatcctgaactacgccgtgtcctggggcctgatcatcatcggcctcctgaccgggctcctgttcaagaagtaccagcaccggttcctgaacgtctacgcgatgtactgcgaggagtgcgacatgtaccacgacaagagcggcctgaagcgccacggggacttcaccaacaagtgccggcagtgcacgtgcggccagtacgaggacgccgccgggctcatggcccaccgcaagacctacaactgcctggtgcagtacaaggccaagtggatgatgaacttcctgatcatctacatcttcctcatcctgatcaaggactccgcgatcgtggtccaggccgccggcaccgacttcacgacctgcctggagaccgagagcatcaactggaactgcaccggccccttcctcaacctggggaactgccagaagcagcagaagaaggagccgtacaccaacatcgccacccagctgaagggcctcaaggccatctccgtgctggacatccccatcatcaccgggatccccgacgacatcgcgggcgccctgcggtacatcgaggagcgcgaggacttccacgtgcagctgaccatcgagtacgccatgctcagcaagtactgcgactactacacccagttctccgacaacagcgggtactcccagaccacgtggcgggtctacctgcgcagccacgacttcgaggcctgcatcctgtaccccaaccagcacttctgccgctgcgtgaagaacggcgagaagtgctccagctccaactggggcttcgcgaacgagatgaaggacttctacagcgggaagcagaccaagttcgacaaggacctcaacctggccctgaccgccctccaccacgccttccggggcaccagctccgcctacatcgcgacggtgctgagcaagaagtccaacgacgacctgatcgcctacaccaacaagatcaagaccaagttcccggggaacgccctcctgaaggccatcatcgactacatcgcctacatgaagtccctgcccggcatggcgaacttcaagtacgacgagttctgggacgagctcctgtacaagcccaaccccgccaaggccagcaacctggcccgcgggaaggagagctcctacaacttcaagctcgccatcagctccaagagcatcaagacctgcaagaacgtcaaggacgtggcgtgcctgtccccgcggagcggcgccatctacgcctccatcatcgcctgcggcgagcccagcgggccctccgtgtaccgcaagcccccgggcggggtcttccagagctccacggaccggagcatctactgcctgctcgacagccactgcctggaggagttcgaggcgatctcccaggaggagctggacgccgtgaagaagtccaagtgctgggagatcgagtaccccgacgtgaagcccctccaggagagcgacggcaccaagagctgccgcatgaaggactccggcaactgcaacgtcgccaccaaccggtggcccgtgatccagtgcgagaacgacaagttctactacagcgagctgcagaaggactacgacaagacccaggacatcgggcactactgcctgtccccgggctgcacgaccgtgcgctaccccatcaaccccaagcacatcagcaactgcaactggcaggtctcccggagctccatcgccaagatcgacgtgcacaacatcgaggacatcgagcagtacaagaaggccatcacccagaagctccagaccagcctgtccctgttcaagtacgcgaagacgaagaacctcccgcacatcaagcccatctacaagtacatcaccatcgaggggaccgagaccgccgagggcatcgagagcgcctacatcgagtccgaggtgcccgccctggccgggacgagcatcggcttcaagatcaactccaaggagggcaagcacctcctggacgtcatcgcgtacgtcaagagcgcctcctacagcagcgtgtacaccaagctgtactccaccgggcccaccagcggcatcaacacgaagcacgacgagctgtgcaccgggccgtgccccgccaacatcaaccaccaggtgggctggctcaccttcgcccgcgagcggacctccagctgggggtgcgaggagttcggctgcctggccgtgtccgacggctgcgtgttcgggagctgccaggacatcatcaaggaggagctgtccgtctaccgcaaggagacggaggaggtgaccgacgtggagctctgcctgaccttcagcgacaagacctactgcacgaacctgaaccccgtcacccccatcatcaccgacctcttcgaggtgcagttcaagaccgtggagacgtactccctgccgcggatcgtcgcggtgcagaaccacgagatcaagatcggccagatcaacgacctgggggtgtacagccgcggctgcgggaacgtccagaaggtgaacggcaccgtgtacggcaacggggtcccccggttcgactacctctgccacctggcctcccgcaaggaggtgatcgtgcggaagtgcttcgacaacgactaccaggcctgcaagttcctgcagagccccgcctcctaccgcctcgaggaggacagcggcaccgtcaccatcatcgactacaagaagatcctggggaccatcaagatgaaggcgatcctgggcgacgtgaagtacaagacgttcgccgactccgtggacatcaccgccgaggggagctgcaccggctgcatcaactgcttcgagaacatccactgcgagctcaccctgcacacgaccatcgaggcctcctgccccatcaagagctcctgcaccgtcttccacgaccggatcctggtgaccccgaacgagcacaagtacgccctcaagatggtgtgcacggagaagcccggcaacaccctgaccatcaaggtctgcaacaccaagatcgaggcgagcatggccctggtggacgccaagcccatcatcgagctcgcccccgtcgaccagacggcctacatccgcgagaaggacgagcgctgcaagacctggatgtgccgggtgcgcgacgaggggctccaggtgatcctggagccgttcaagaacctgttcggcagctacatcgggatcttctacaccttcatcatctccatcgtcgcgctgctggtgatcatctacgtgctcctgcccatctgcttcaagctgcgggacaccctccgcaagcacgaggacgcctacaagcgggagatgaagatccgctga

SEQ ID NO: 12680 - RNA, 4326 nt, synthetic construct
  misc_feature 1..4326: note = derived and/or modified CDS sequence (opt1) from LACV(LACV/95/WV-H)__GU206133.1__GP
  source 1..4326: mol_type = other RNA
atgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggaccatctacaacaagtcctgcaagaagtgcaagctgtgcggcctggtctaccaccccttcaccgagtgcgggacgcactgcgtgtgcggcgcccgctacgacaccagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacgcccatcaactccatggtgctcggggagagcaaggagaccttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacctacaactgcctggtgcagtacaaggcgaagtggatgatgaacttcctcatcatctacatcttcctgatcctgatcaaggactccgccatcgtcgtgcaggccgccggcaccgacttcaccacgtgcctcgagaccgagagcatcaactggaactgcaccggccccttcctgaacctggggaactgccagaagcagcagaagaaggagccgtacaccaacatcgccacgcagctcaagggcctgaaggcgatctccgtgctggacgtccccatcatcaccgggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacgtggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagaccaagttcgacaaggacctgaacctggccctcaccgccctgcaccacgccttccgcgggaccagctccgcgtacatcgccacgatgctgagcaagaagtccaacgacgacctcatcgcctacaccaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccacggaccagagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccggatgaaggactccgggaactgcaacgtggccaccaaccgctggcccgtgatccagtgcgagaacgacaagttctactacagcgagctgcagaaggactacgacaagacccaggacatcggccactactgcctctcccccgggtgcacgaccgtccggtaccccatcaacccgaagcacatcagcaactgcaactggcaggtctcccgcagctccatcgccaagatcgacgtgcacaacatcgaggacatcgagcagtacaagaaggcgatcacccagaagctgcagaccagcctgtccctcttcaagtacgccaagacgaagaacctgccccacatcaagcccatctacaagtacatcaccatcgagggcaccgagaccgccgaggggatcgagagcgcctacatcgagtccgaggtgccggccctggcgggcacgagcatcggcttcaagatcaactccaaggaggggaagcacctcctggacgtgatcgcctacgtcaagagcgcctcctacagctccgtgtacaccaagctgtacagcaccggccccaccagcgggatcaacacgaagcacgacgagctctgcaccggcccctgccccgccaacatcaaccaccaggtggggtggctgaccttcgcccgggagcgcacctccagctggggctgcgaggagttcggctgcctggcggtgtccgacgggtgcgtcttcggcagctgccaggacatcatcaaggaggagctctccgtgtaccggaaggagacggaggaggtgaccgacgtcgagctgtgcctgaccttcagcgacaagacctactgcacgaacctcaacccggtgacccccatcatcaccgacctgttcgaggtgcagttcaagaccgtcgagacgtactccctgccccgcatcgtggccgtgcagaaccacgagatcaagatcgggcagatcaacgacctcggcgtctacagcaaggggtgcggcaacgtgcagaaggtgaacggcaccatctacgggaacggcgtcccccggttcgactacctgtgccacctggcctcccgcaaggaggtgatcgtgcggaagtgcttcgacaacgactaccaggcctgcaagttcctccagagcccggcgtcctaccgcctggaggaggacagcgggaccgtcaccatcatcgactacaagaagatcctgggcaccatcaagatgaaggccatcctcggggacgtgaagtacaagacgttcgccgactccgtggacatcaccgccgagggcagctgcaccggctgcatcaactgcttcgagaacatccactgcgagctgaccctgcacacgaccatcgaggcctcctgccccatcaagagctcctgcaccgtcttccacgaccggatcctcgtgacccccaacgagcacaagtacgcgctgaagatggtgtgcacggagaagcccgggaacaccctgaccatcaaggtctgcaacaccaagatcgaggccagcatggccctcgtggacgccaagccgatcatcgagctggcccccgtcgaccagacggcgtacatccgcgagaaggacgagcggtgcaagacctggatgtgccgcgtgcgggacgagggcctccaggtgatcctggagcccttcaagaacctgttcgggtcctacatcggcatcttctacaccttcatcatcagcatcgtcgccctgctcgtgatcatctacgtgctgctgcccatctgcttcaagctccgcgacaccctgcgcaagcacgaggacgcctacaagcgggagatgaagatccgctga

SEQ ID NO: 12681 - RNA, 4326 nt, synthetic construct
  misc_feature 1..4326: note = derived and/or modified CDS sequence (opt1) from LACV(LACV/96/WV-M (WV96-3955))__GU206145.1__GP
  source 1..4326: mol_type = other RNA
atgatctacatcctggtgctcatcgccgtcaccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacatccgcaacgccaccggggtcttctccaacaacgtggcgatccggaagtggctggtgagcgactggcacgactgccgccccaagaagatcaccggcgggcacatcaacgtcatcgaggtgggcgacgacctctccctgcacaccgagagctacgtgtgctccgccgactgcacgatcggggtcgacaaggagaccgcccaggtgcggctgcagaccgacaccacgaaccacttcgagatcgccggcaccaccgtcaagagcggctggttcaagtccaccacgtacatcaccctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtcacgctgaccctcctgatcttcatcctgctctccatcctgagcaagacctacatctgctacctgctcatgccgatcttcatccccatcgcctacgtgtacgggatcatctacaacaagtcctgcaagaagtgcaagctgtgcggcctggtgtaccaccccttcaccgagtgcgggacgcactgcgtctgcggcgcccgctacgacaccagcgaccggatgaagctccaccgcgcctccggcctgtgccccgggtacaagagcctgcgggcggcccgcgtgatgtgcaagagcaagggcccggcctccatcctcagcatcatcaccgccgtgctggtcctgaccttcgtgacgcccatcaactccatggtcctcggggagagcaaggaggtgttcgagctggaggagctgcccgacgacatgctcgagatggccctgcggatcaactcctactacttcacgtgcatcctgaactacgcggtgagctggggcctcatcatcatcggcctgctgaccgggctcctgttcaagaagtaccagcaccgcttcctgaacatctacgccatgtactgcgaggagtgcgacatgtaccacgacaagtccggcctcaagcggcacggggacttcaccaacaagtgccgccagtgcacgtgcggccagtacgaggacgccgccgggctgatgacccaccggaagacctacaactgcctggtccagtacaaggccaagtggatcatgaacttcctcatcgtgtacatcttcctgatcctgatcaaggacagcgcgatcatcgtgcgcgccgccggcaccgacttctccagctgcctcgagaccgagatcatcaactggaactgcaccggccccttcctgaacctggggaactgccagcggcagcagaagaaggagccgtacgccaacatcgccgcgcagctcaagggcctgaaggccatctccgtcctggacatccccatgatcaccgagatccccgacgacatcgccagcgccctgcgctacatcgaggagcgggaggcgttccacgtgcagctcaccgccgagtacgccatgctgtcccgctactgcgactactacacgcagttcagcgacaactccgggtacagccagaccacctggcgcgtgtacctgcggtcccacgacttcgaggcctgcatcctctaccccaaccagcacttctgccgctgcgtcaagaacggcgagaagtgcagctccgccaactgggacttcgcgaacgagatgaaggactactacagcgggaagcaggccaagttcgacaaggacctgaacctggccctcaccgccatgcaccacgccttccggggcaccagctccgcgtacatggccgccatgctgagcaagaagtccaacgacgacctgatcacgtacaccaacaagctcaagaccaagttcccgggcaacgccctgctgaaggccatcatcgactacatcgcgtacatgaaggggctccccggcatggccaacttcaagcacgacgagttctgggacgagctgctgtacaagcccacccccacgaaggccccgaacctcgcccgcgggcgggagagctcctacaacttcgagctggcgatcagctccaagagcatcaagacctgcaagaacgtgaaggacgtggcctgcctgagcccccgcagcggcgccatctacgcctccatcatcgcctgcggggagcccaacggccccagcgtctaccggaagccgtccggcggggtgttccagagctccaccgaccagagcatgtactgcctcctggactcccactgcctggaggagttcgaggcgatcagccaggaggagctcgacgccgtgaagaagtccaagtgctgggagatcgagtaccccgacgtcaagctgctgcaggagaacgacggcaccaagtcctgccgcatgaaggacagcgggaactgcaacgtggccacgaaccggtggcccgtgatccagtgcgagaacgacaagttctactactccgagctccagaaggactacgacaagacccaggacatcggccactactgcctgagccccggctgcgccaccatccgctacccgatcaaccccaagcacatctccaactgcaactggcaggtcagccggtccagcatcgccaagatcgacgtgcacaacatcgaggacatcgagcagtacaagaaggcgatcacccagaagctgcagacgtccctcagcctgttcaagtacgccaagaccaagaacctgccccacatcaagccgatctacaagtacatcaccatcgaggggaccgagacggccgagggcatcgagtccgcctacatcgagagcgaggtgcccgccctcgcggggacctccatcggcttcaagatcaacagcaaggaggggaagcacctcctggacgtcatcgcctacgtgaagtccgccagctactccagcgtgtacaccaagctgtactccaccggccccacgagcggcgtcaacaccaagcacgacgagctgtgcaccgggccctgcccggccaacatcaaccaccaggtgggctggctgaccttcgcgcgcgagcggacgagctcctgggggtgcgaggagttcggctgcctcgccgtgagcgacgggtgcgtcttcggctcctgccaggacatcatcaaggaggagctgagcgtgtaccgcaaggagaccgaggaggtgaccgacgtcgagctgtgcctcaccttctccgacaagacgtactgcaccaacctgaaccccgtgacccccatcatcaccgacctgttcgaggtgcagttcaagacggtcgagacctacagcctcccccggatcgtggccgtgcagaaccacgagatcaagatcggccagatcaacgacctgggggtctactccaagggctgcgggaacgtgcagaaggtgaacggcaccatctacgggaacggcgtcccgcgcttcgactacctgtgccacctcgccagccggaaggaggtgatcgtgcgcaagtgcttcgacaacgactaccaggcctgcaagttcctgcagtcccccgcgagctaccggctggaggaggactccggcaccgtcacgatcatcgactacaagaagatcctcgggaccatcaagatgaaggccatcctgggcgacgtgaagtacaagaccttcgccgacaacgtggacatcaccgccgaggggagctgcaccggctgcatcaactgcttcgagaacatccactgcgagctgacgctccacaccaccatcgaggcctcctgccccatcaagagctcctgcaccgtcttccacgaccgcatcctggtgacgcccaacgagcacaagtacgcgctgaaggtggtctgcaccgagaagccggggaacaccctcaccatcaaggtgtgcaacacgaagatcgaggccgccatggccctggtggacgccaagcccatcatcgagctggcgcccgtcgaccagaccgcctacatccgcgagaaggacgagcggtgcaagacctggatgtgccgcgtgcgggacgagggcctccaggtcatcctggagcccttcaagaacctgttcggcagctacatcgggatcttctacaccttcatcatctccatcgtggccctcctggtgatcatctacatcctgctcccgatctgcttcaagctgcgcgacacgctgcggaagcacgaggacgcctacaagcgcgagatgaagatccggtga

SEQ ID NO: 12682 - RNA, 4326 nt, synthetic construct
  misc_feature 1..4326: note = derived and/or modified CDS sequence (opt1) from LACV(LACV/97/NC-M (NC97-7306))__GU206127.1__GP
  source 1..4326: mol_type = other RNA
atgatccgcatcctggtgctcatcgccgtcaccgccgcgagccccgtgtaccagcggtgcttccaggacggcgccatcgtgaagcagaacccgtccaaggaggccgtcaccgaggtgtgcctgaaggacgacgtgagcatgatcaagacggaggcccgctacatccggaacgccaccggggtcttctccaacaacgtggcgatccgcaagtggctggtgagcgactggcacgactgccggcccaagaagatcatcggcgggcacatcaacgtcatcgaggtgggcgacgacctctccctgcacaccgagagctacgtgtgctccgccgactgcaccatcggggtcgacaaggagacggcccaggtgcgcctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcggttcctgcaccgcaccatcctccccggctccatcgccaacagcatctgccagaacatcgagatcatcatcctggtcaccctgacgctcctgatcttcatcctgctctccatcctgagcaagacctacatctgctacctgctcatgccgatcttcatccccatcgcctacgtgtacgggatcatctacaacaagtcctgcaagaagtgcaagctgtgcggcctggtgtaccaccccttcaccgagtgcgggacccactgcgtctgcggcgcccggtacgacacgagcgaccgcatgaagctccaccgggcctccggcctgtgccccgggtacaagagcctgcgcgcggcccgggtgatgtgcaagagcaagggcccggcctccatcctcagcatgatcaccgccgtgctggtcctgaccttcgtgacccccatcaactccatggtcctcggggagagcaaggagacgttcgagctggaggagctgcccgacgacatgctcgagatggtgtcccgcatcaacagctactacttcacgtgcatcctgaactacgccgtgtcctggggcctgatcatcatcggcctcctgaccgggctcctgttcaagaagtaccagcaccggttcctgaacgtctacgcgatgtactgcgaggagtgcgacatgtaccacgacaagagcggcctgaagcgccacggggacttcaccaacaagtgccggcagtgcacgtgcggccagtacgaggacgccgccgggctcatggcccaccgcaagacctacaactgcctggtgcagtacaaggccaagtggatgatgaacttcctgatcatctacatcttcctcatcctgatcaaggactccgcgatcgtggtccaggccgccggcaccgacttcacgacctgcctggagaccgagagcatcaactggaactgcaccggccccttcctcaacctggggaactgccagaagcagcagaagaaggagccgtacaccaacatcgccacccagctgaagggcctcaaggccatctccgtgctggacatccccatcatcaccgggatccccgacgacatcgcgggcgccctgcggtacatcgaggagcgcgaggacttccacgtgcagctgaccatcgagtacgccatgctcagcaagtactgcgactactacacccagttctccgacaacagcgggtactcccagaccacgtggcgggtctacctgcgcagccacgacttcgaggcctgcatcctgtaccccaaccagcacttctgccgctgcgtgaagaacggcgagaagtgctccagctccaactgggacttcgcgaacgagatgaaggacttctacagcggcaagcagaccaagttcgacaaggacctcaacctggccctgaccgccctccaccacgccttccgggggaccagctccgtgtacatcgccacgatgctgagcaagaagtccaacgacgacctgatcgcgtacaccaacaagatcaagaccaagttcccgggcaacgccctcctgaaggccatcatcgactacatcgcctacatgaagtccctgcccgggatggccaacttcaagtacgacgagttctgggacgagctcctgtacaagcccaaccccgcgaaggccagcaacctggcccgcggcaaggagagctcctacaacttcaagctcgccatcagctccaagagcatcaagacctgcaagaacgtcaaggacgtggcctgcctgtccccgcggagcggggcgatctacgcctccatcatcgcctgcggcgagcccaacggccccagcgtgtaccgcaagcccccgggcggggtcttccagtccagcacggaccggtccatctactgcctgctcgacagccactgcctggaggagttcgaggccatcagccaggaggagctggacgcggtgaagaagtccaagtgctgggagatcgagtaccccgacgtgaagcccctccaggagagcgacgggaccaagtcctgccgcatgaaggacagcggcaactgcaacgtcgccaccaaccggtggcccgtgatccagtgcgagaacgacaagttctactactccgagctgcagaaggactacgacaagacccaggacatcggccactactgcctgagcccggggtgcacgaccgtgcgctaccccatcaaccccaagcacatctccaactgcaactggcaggtcagccggtccagcatcgccaagatcgacgtgcacaacatcgaggacatcgagcagtacaagaaggccatcacccagaagctccagacctccctgagcctgttcaagtacgccaagacgaagaacctcccgcacatcaagcccatctacaagtacatcaccatcgagggcaccgagaccgcggaggggatcgagtccgcctacatcgagagcgaggtgcccgccctggccggcacgtccatcgggttcaagatcaacagcaaggagggcaagcacctcctggacgtcatcgcctacgtgaagtccgcgagctactccagcgtgtacaccaagctgtacagcaccggccccacctccgggatcaacacgaagcacgacgagctgtgcaccggcccgtgccccgccaacatcaaccaccaggtcgggtggctcaccttcgcccgcgagcggaccagctcctggggctgcgaggagttcgggtgcctggccgtgagcgacggctgcgtgttcggctcctgccaggacatcatcaaggaggagctgagcgtctaccgcaaggagacggaggaggtgaccgacgtggagctctgcctgaccttctccgacaagacctactgcacgaacctgaaccccgtcacccccatcatcaccgacctcttcgaggtgcagttcaagaccgtggagacgtacagcctgccgcggatcgtcgccgtgcagaaccacgagatcaagatcgggcagatcaacgacctgggcgtgtactccaaggcgtgcgggaacgtccagaaggtgaacggcaccgtgtacgggaacggcgtcccccgcttcgactacctctgccacctggccagccggaaggaggtgatcgtgcgcaagtgcttcgacaacgactaccaggcctgcaagttcctgcagtcccccgccagctaccggctcgaggaggactccggcaccgtcaccatcatcgactacaagaagatcctggggaccatcaagatgaaggcgatcctgggcgacgtgaagtacaagacgttcgccgacagcgtggacatcaccgccgaggggtcctgcaccggctgcatcaactgcttcgagaacatccactgcgagctcaccctgcacacgaccatcgaggccagctgccccatcaagtccagctgcaccgtcttccacgaccgcatcctggtgaccccgaacgagcacaagtacgccctcaagatggtgtgcacggagcggcccgggaacaccctgaccatcaaggtctgcaacaccaagatcgaggcgtccatggccctggtggacgccaagcccatcatcgagctcgcccccgtcgaccagacggcctacatccgcgagaaggacgagcgctgcaagacctggatgtgccgggtgcgcgacgagggcctccaggtgatcctggagccgttcaagaacctgttcggcagctacatcgggatcttctacaccttcatcatcagcatcgtcgcgctgctggtgatcatctacgtgctcctgcccatctgcttcaagctgcgggacaccctccgcaagcacgaggacgcctacaagcgggagatgaagatccgctga

SEQ ID NO: 12683 - RNA, 4326 nt, synthetic construct
  misc_feature 1..4326: note = derived and/or modified CDS sequence (opt1) from LACV(LACV/human/1960)__EF485031.1__GP
  source 1..4326: mol_type = other RNA
atgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggaccatctacaacaagtcctgcaagaagtgcaagctgtgcggcctggtctaccaccccttcaccgagtgcgggacgcactgcgtgtgcggcgcccgctacgacaccagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacgcccatcaactccatggtgctcggggagagcaaggagaccttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaaggggcacggcgacttcaccaacaagtgccggcagtgcacgtgcgggcagtacgaggacgccgccggcctgatggcccaccgcaagacctacaactgcctggtgcagtacaaggcgaagtggatgatgaacttcctcatcatctacatcttcctgatcctgatcaaggactccgccatcgtcgtgcaggccgccggcaccgacttcaccacgtgcctcgagaccgagagcatcaactggaactgcaccgggcccttcctgaacctgggcaactgccagaagcagcagaagaaggagccgtacaccaacatcgccacgcagctcaaggggctgaaggcgatctccgtgctggacgtccccatcatcaccggcatccccgacgacatcgccggggccctgcggtacatcgaggagaaggaggacttccacgtgcagctcaccatcgagtacgccatgctgagcaagtactgcgactactacacccagttctccgacaacagcggctactcccagaccacgtggcgcgtgtacctgcggagccacgacttcgaggcgtgcatcctctaccccaaccagcacttctgccgctgcgtcaagaacggcgagaagtgctccagctccaactgggacttcgccaacgagatgaaggactactacagcgggaagcagaccaagttcgacaaggacctgaacctggccctcaccgccctgcaccacgccttccggggcaccagctccgcgtacatcgccacgatgctgagcaagaagtccaacgacgacctcatcgcctacaccaacaagatcaagaccaagttcccgggggacgccctgctgaaggccatcatcgactacatcgcgtacatgaagtccctccccggcatggccaacttcaagtacgacgagttctgggacgagctgctgtacaagcccaaccccgccaaggccagcaacctcgcccgcgggaaggagagctcctacaacttcaagctggcgatcagctccaagagcatcaagacctgcaagaacgtgaaggacgtggcctgcctgtccccgcgcagcggcgccatctacgcctccatcatcgcgtgcggcgagcccaacgggcccagcgtctaccggaagccctccggcggggtgttccagagctccacggaccagagcatctactgcctcctggacagccactgcctggaggagttcgaggccatcggccaggaggagctcgacgccgtgaagaagtccaagtgctgggagatcgagtacccggacgtcaagctgatccaggagggcgacgggaccaagagctgccgcatgaaggactccggcaactgcaacgtggccaccaaccggtggcccgtgatccagtgcgagaacgacaagttctactacagcgagctgcagaaggactacgacaagacccaggacatcgggcactactgcctctcccccggctgcacgaccgtccgctaccccatcaacccgaagcacatcagcaactgcaactggcaggtctcccggagctccatcgccaagatcgacgtgcacaacatcgaggacatcgagcagtacaagaaggcgatcacccagaagctgcagaccagcctgtccctcttcaagtacgccaagacgaagaacctgccccacatcaagcccatctacaagtacatcaccatcgaggggaccgagaccgccgagggcatcgagagcgcctacatcgagtccgaggtgccggccctggcgggcacgagcatcgggttcaagatcaactccaaggagggcaagcacctcctggacgtgatcgcctacgtcaagagcgcctcctacagctccgtgtacaccaagctgtacagcaccgggcccaccagcggcatcaacacgaagcacgacgagctctgcaccgggccctgccccgccaacatcaaccaccaggtgggctggctgaccttcgcccgcgagcggacctccagctggggctgcgaggagttcgggtgcctggcggtgtccgacggctgcgtcttcgggagctgccaggacatcatcaaggaggagctctccgtgtaccgcaaggagacggaggaggtgaccgacgtcgagctgtgcctgaccttcagcgacaagacctactgcacgaacctcaacccggtgacccccatcatcaccgacctgttcgaggtgcagttcaagaccgtcgagacgtactccctgccccggatcgtggccgtgcagaaccacgagatcaagatcggccagatcaacgacctcggggtctacagcaagggctgcggcaacgtgcagaaggtgaacgggaccatctacggcaacggggtcccccgcttcgactacctgtgccacctggcctcccggaaggaggtgatcgtgcgcaagtgcttcgacaacgactaccaggcctgcaagttcctccagagcccggcgtcctaccggctggaggaggacagcggcaccgtcaccatcatcgactacaagaagatcctggggaccatcaagatgaaggccatcctcggcgacgtgaagtacaagacgttcgccgactccgtggacatcaccgccgagggcagctgcaccgggtgcatcaactgcttcgagaacatccactgcgagctgaccctgcacacgaccatcgaggcctcctgccccatcaagagctcctgcaccgtcttccacgaccgcatcctcgtgacccccaacgagcacaagtacgcgctgaagatggtgtgcacggagaagcccggcaacaccctgaccatcaaggtctgcaacaccaagatcgaggccagcatggccctcgtggacgccaagccgatcatcgagctggcccccgtcgaccagacggcgtacatccgggagaaggacgagcgctgcaagacctggatgtgccgggtgcgcgacgaggggctccaggtgatcctggagcccttcaagaacctgttcggctcctacatcggcatcttctacaccttcatcatcagcatcgtcgccctgctcgtgatcatctacgtgctgctgcccatctgcttcaagctccgggacaccctgcgcaagcacgaggacgcctacaagcgcgagatgaagatccggtga

SEQ ID NO: 12684 - RNA, 4326 nt, synthetic construct
  misc_feature 1..4326: note = derived and/or modified CDS sequence (opt1) from LACV(LACV/mosquito/1978)__EF485037.1__GP
  source 1..4326: mol_type = other RNA
atgatccgcatcctggtgctcatcgccgtcaccgccgcgagccccgtgtaccagcggtgcttccaggacggcgccatcgtgaagcagaacccgtccaaggaggccgtcaccgaggtgtgcctgaaggacgacgtgagcatgatcaagacggaggcccgctacgtccggaacgccaccggggtgttctccaacaacgtggcgatccgcaagtggctggtcagcgactggcacgactgccggcccaagaagatcatcggcgggcacatcaacgtgatcgaggtgtccgacgacctcagcctgcacaccgagtcctacgtctgcagcgccgactgcaccatcggcgtggacaaggagacggcccaggtgcgcctgcagaccgacaccaccaaccacttcgagatcgccgggacgaccgtcaagtccggctggttcaagagcaccacctacatcacgctcgaccagacctgcgagcacctgaaggtgtcctgcggccccaagagcgtgcagttccacgcgtgcttcaaccagcacatgtcctgcgtccggttcctgcaccgcaccatcctccccgggagcatcgccaactccatctgccagaacatcgagatcatcatcctggtgaccctgacgctcctgatcttcatcctgctcagcatcctgtccaagacctacatctgctacctgctcatgccgatcttcatccccatcgcctacatgtacggcatcatctacaacaagagctgcaagaagtgcaagctgtgcgggctggtgtaccaccccttcaccgagtgcggcacccactgcgtctgcggggcccggtacgacacgtccgaccgcatgaagctccaccgggccagcggcctgtgccccggctacaagagcctgcgcgcggcccgggtgatgtgcaagtccaaggggccggccagcatcctctccatcatcaccgccgtgctggtcctgaccttcgtgacccccatcaacagcatggtcctcggcgagtccaaggagacgttcgagctggaggagctgcccgacgacatgctcgagatggccagccgcatcaactcctactacttcacgtgcatcctgaactacgcggtgagctgggggctggtgatcatcggcctcctgaccggcctcctgttcaagaagtaccagcaccggttcctgaacatctacgccatgtactgcgaggagtgcgacatgtaccacgacaagtccgggctgaagcgccacggcgacttcaccaacaagtgccggcagtgcacgtgcgggcagtacgaggacgccgccggcctcatggcccaccgcaagacctacaactgcctggtccagtacaaggcgaagtggatgatgaacttcctgatcatctacatcttcctcatcctgatcaaggacagcgccatcgtggtgcaggccgccgggaccgacttcacgacctgcctggagaccgagtccatcgactggaactgcaccggccccttcctcaacctgggcaactgccagaagcagcagaagaaggagccgtacaccaacatcgccacccagctgaaggggctcaaggcgatcagcgtcctggacatccccatcatcacccggatccccgacgacatcgccggcgccctgcgctacatcgaggagcgggaggacttccacgtgcagctgaccaccgagtacgccatgctctccaagtactgcgactactacacccagttcagcgacaactccgggtacagccagacgacctggcgcgtgtacctgcgctcccacgacttcgaggcgtgcatcctgtaccccaaccagaacttctgccggtgcgtcaagaacggcgagaagtgcagctccagcaactgggacttcgccaacgagatgaaggactactacccggggaagcaggccaagttcgacaaggacctcaacctggccctgaccgccctccaccacgcgttccgcggcaccagctccgcctacatcgccacgatgctgagcaagaagtccaacgacgacctgatcgcctacaccaacaagatcaagaccaagttccccggcaacgccctcctgaaggcgatcatcgactacatcgcctacatgaagtccctgcccgggatggccaacttcaagtacgacgagttctgggacgagctcctgtacaagcccaacccggccaaggcctccaacctggcgcggggcaaggagagctcctacaacttcaagctcgccatcagctccaagagcatcaagacctgcaagaacgtgaaggacgtggcctgcctgagcccccgcagcggggccatctacgcgtccatcatcgcctgcggcgagcccaacgggcccagcgtctaccggaagccgtccggcggcgtgttccagagctccacggaccgcagcatctactgcctgctcgacagccactgcctggaggagttcgaggccatctcccaggaggagctggacgccgtgaagaagtccaagtgctgggagatcgagtacagcgacgtcaagcccctccaggaggggaacggcaccaagagctgccggatgaaggactccgggaactgcaacgtggccaccaaccgctggcccgtgatccagtgcgagaacgacaagttctactacagcgagctgcagaaggactacgacaagacccaggacatcggccactactgcctgtcccccggctgcacgaccgtccggtacccgatcaaccccaagcacatcagcaactgcaactggcaggtctcccgcagctccatcgcgaagatcgacgtgcacaacatcgaggacatcgagcagtacaagaaggccatcacccagaagctccagaccagcctgtccctgttcaagtacgccaagacgaagaacctcccccacatcaagccgatctacaagtacatcaccatcgaggggaccgagaccgccgagggcatcgagagcgcctacatcgagtccgaggtgcccgcgctggccgggacgagcatcggcttcaagatcaactccaaggaggggaagcacctcctggacgtgatcgcctacgtcaagagcgcctcctacagcagcgtgtacgccaagctgtactccaccggccccaccagcggcatcaacaccaagcacgacgagctgtgcacggggccctgcccggcgaacatcaaccaccaggtgggctggctcaccttcgccaaggagcggacctccagctgggggtgcgaggagttcggctgcctggccgtgtccgacgggtgcgtcttcggcagctgccaggacatcatcaaggaggagctgtccgtgtaccgcaaggagaccgaggaggtgacggacgtcgagctctgcctgaccttcagcgacaagacctactgcaccaacctgaaccccgtgacgcccatcatcaccgacctcttcgaggtgcagttcaagaccgtcgagacctactccctgccccggatcgtggccgtgcagaaccacgagatcaagatcggccagatcaacgacctgggggtctacagcaagggctgcgggaacgtgcagaaggtgaacggcacggtctacgggaacggcgtgccgcgcttcgactacctctgccacctggcgtcccggaaggaggtgatcgtccgcaagtgcttcgacaacgactaccaggcctgcaagttcctgcagagccccgcctcctaccggctcgaggaggacagcggcaccgtgaccatcatcgactacaagaagatcctggggaccatcaagatgaaggccatcctgggcgacgtgaagtacaagaccttcgccgactccgtcgacatcacggcggaggggagctgcaccggctgcatcaactgcttcgagaacatccactgcgagctcaccctgcacaccacgatcgaggcctcctgccccatcaagagctcctgcaccgtgttccacgaccgcatcctggtgacccccaacgagcacaagtacgccctcaagatggtctgcaccgagaagccggggaacacgctgaccatcaaggtgtgcaacaccaagatcgaggccagcatggccctggtggacgcgaagcccatcatcgagctcgcccccgtcgaccagaccgcctacatccgggagaaggacgagcgctgcaagacgtggatgtgccgcgtgcgggacgagggcctgcaggtcatcctggagcccttcaagaacctcttcggcagctacatcgggatcttctacaccttcatcatctccatcgtggccctgctggccatcatctacgtgctcctgccgatctgcttcaagctgcgcgacaccctccggaagcacgaggacgcgtacaagcgcgagatgaagatccggtga

SEQ ID NO: 12685 - RNA, 4326 nt, synthetic construct; identical to SEQ ID NO: 12654
  misc_feature 1..4326: note = derived and/or modified CDS sequence (opt1) from LACV__KP271111.1__GP
  source 1..4326: mol_type = other RNA

SEQ ID NO: 12686 - RNA, 4263 nt, synthetic construct
  misc_feature 1..4263: note = derived and/or modified CDS sequence (opt1) from OROV(BeAn19992)__NC_005775.1__GP
  source 1..4263: mol_type = other RNA
atggccaacctgatcatcatcagcatggtgctcggcgtcgcctacgggcaccccctgtccaccagccagatcggcgaccgctgcttcgccgggggcaacctgttcaaggagatgaacctctccgtggggctgggcgagatctgcgtgaaggacgacatcagcatcgtcaagtccaccacggtgttcagcaagaacaagccggcgctggaggccaccaccaagttctaccggtccttcatcgtgaaggactggagcgagtgcaaccccgtcctcgacaagttcggcaacttcatggtgctgtccgtggacgacaacgggcacatcatccccaagatgtacacgtgccgcgccgcctgcgacatccggctgaacaaggacaacgcggagatcatcctcagctccaccaagctgaaccacttcgagatcgtcggcaccaccagcacctccgggtggttcaagaacacgatcaccaacaacctggagcacacgtgcgagcacgtgaccgtgaactgcggccagaagtccgtcaagttccacgcctgcttccgccagcaccgggggtgcatccgcttcttcaagggcacctacatgccctacagcatgatcgaggccatgtgcgtgaacatcgagctcatcatcctgaccctgtacatcttcgccgcgatcatcttcgccctcatcatcaccaagagctacgtggcctacctgctgctcccgctgttctaccccgtcacctggttctacggcaaggtgtacaagaagatcaactcctgccccaactgcctgctcgccagccaccccttcacgtcctgcccgaagttctgcatctgcgggagccggttcagctgcaccgaggccctgaaggtgcaccgcatgggcaaggactgcctggggtacaagtccctcagcaaggcgcggcagatgtgcaagtccaagagctggtccttcaccgccgccatcctgaccggcctgatcctcatggagttcatcagccccatcgccggcgagcgcatgtacaagctggaggagctggccgacgagttcatcaagctcacggagcaggtcaacatcctggagcgggagatggaggtgctgaagcagtccatcatcgtgatgttcgcgatcatcctcgtcctgctgctgttcgagaacatgatcttcaaccgcctgttccggatcttctaccgcagctgctccatgtgcgggctgatccactaccggcccggcctcaagatcgacctgaccaagaccaaccgctgcgggagctgcatctgcggcttcgacgagcagcagtccagcgggttcgagtacgagatcttcctgaaggacatgcacgtgcagaaggagtcctgcaagttcagcccccgggtgaaccacttccgcaacatcaaggccctcctgttcgccctggtcatctgcgccaccatctacacggtgtacgccgacgaggactgcctctccaaggacatcaagatcacctaccaggagctgcacaactgcatcggcccgaagatcatgggcgacacgtgcgtcagcaagtccgagctgtacagcgacctcttctccaagaacctggtgaccgagtacgacaagaagtacttcgagcccgacaccgtgaacgaccagttcaacaagatcgagttcgcgcaggacgcccaccggatgatcctgctggagcgcatcctctacaagaccgagtgcgagatgctgagcctgaagaagaacagcgggccctacaacgtcgcctggcggacctacctcaagaaccacaacatcgacctgtgctcccgccacaactacaagatgatctgccagtgcatcaacacccacagcatgtgcaacaacacggacatcgactacaacaaggagatcgagacctactacaagtccaacgccgccgcgtaccgcgccgacctgaacaccatcatggacaccctcaagacggccttccggggcctgaccaaggtgctgatcgagaactacatcgagaaggacgacagcgacgccctcaaggcgctgttctccaacatcaccgacagcgtgcaggacaactaccagatgatcgggatcctgaagttcgcctccaagctcctggacatcaacctgggccgcagcacccggtccgcccaccacagcatcatgaccaacgagatccccaagtccaacccgttcacggactacagctactccaacctcaacatcaaggagtgcatgagccccgagtccctgaagtgcttcaagaagcgcgggagcacgccccacaccaaccacctcctctgcaagatcgacaacaagtacaaggccttcgactggcccgagatcgagaccatccagaagggccagaagctgtgcctgggcgactcccactgcaacctcgagttcaccgccatcaccgcggacaagatcatgagcctgaccaactgctacaaggagagcttcaccgcccagccggccgacatgcaggccgggatcaagaagtgctccgccgacgagatcggcgagtgcacgaccctggaggacaagacctggcccatcatcttctgcgggggcaagtactactacagcgactccaaggagcacgcgaaggacgggagcatcaacaactactgcctcaccaacaagtgctccgagcagcggttccccatccacgagaactggttcaagaagtgcaactgggacaagacgcacaaggagttcagcaccatgcgccagatcaactacaacgacatcacctcctaccggaaggccatcgagagcgagatcggcaccgacctgatgacgcaccactacaagcccaccaagaacctgccgcacgtcgtgccccgctaccactccatcgacgtgcagggcaccgagagcaccgaggggatcatcaacggcttcatccagaacacgatccccgccatctccgggctcggcgtcggctaccacctgaacttccagagcaaccagctgttcgacatcgtgatcttcgtgaagaaggccgtctacaaggcccagtaccagaaggcgtacaccaccgggccctccatcagcatcaacatcgagcacaacgagcggtgcaccggccactgcccggagaagatccccgccaaggaggggtggctcacgttctccaaggagcacaccagctcctggggctgcgaggagtacgggtgcctggccatcgacaccggctgcctgtacggcagctgccaggacgtgatccgccccgagctcgacgtgtacaagaagatcgggtccgaggtcagcctgatcgagatctgcatcaccctgccgcacgagacgtactgcaacgacatggacatcctcgagcccatcatcggcgacaagctgagcgcctccttccagaacacccagaccaaccagctgcccaccctcatcgcgtacaagaaggggaagatctacacgggccagatcaacgacatcgggaacaccgccctgcagtgcggcagcatccaggtgatcaacggctccaccatcgggaccggcagccccaagttcgactacatctgccacgccatgcggcgcaaggacgtgatcgtccggaagtgcttcaacgacaactaccagtcctgcacgcgcctggagaagcggaacgacctcatcccgtaccgcaagggggacgtgatcgaggtgagcaagaccggctccaacatggggcagatgaccttcaagatcgagctgggcgacatcaactacaagatcttcaccaagagcatcgacctgcagatgtccggcatctgcgccgggtgcatcgactgcgccgagggcatcagctgctccatcaacgcggaggtccccgccgagaccgtgtgccactgcaagacgaactgcgaggacttcatcaacaacatcgtgttcagcccccagatcaagaactacaacatcaaggtccactgcaagtccaaggtggagaagatcaccgcccacatctgcgggcgggacatcgacctccagctgaccatcaagccctacaaccagaagatcgacctgagccagctcgacgagtccaactacatccgcgaggaggacctgcagtgcggcacctggctgtgcaaggtgcagaaggaggggatcgacatcatcttcaagggcctcttcagcggcctggggcggtactggacgatcctgatctactccatcatcggcgtcgtgatcatcgtgatcctcgtctacatcctgctgccgatcgggcgcctcctgaaggccttcctgatccgccacgagatcgagtacgccatggagcagaagatcaagtga

SEQ ID NO: 12687 - RNA, 4263 nt, synthetic construct
  misc_feature 1..4263: note = derived and/or modified CDS sequence (opt1) from OROV(BeH759021)__KP691607.1__GP
  source 1..4263: mol_type = other RNA
atggccaacctgatcatcatcagcatggtgctctccgtcgcctacggccaccccctgagcacctcccagatcggggaccgctgcttcgcgggcgggaacctgttcaaggagatgaacctcagcgtgggcctgggggagatctgcgtgaaggacgacatctccatcgtcaagagcaccacggtgttctccaagaaccggccggccctggaggccaccaccaagttctaccgcagcttcatcgtgaaggactggtccgagtgcaaccccgtcctcgacaagttcggcaacttcatggtgctgagcgtggacgacaacggccacatcatgcccaagatgtacacgtgccgggccgcctgcgacatccgcctgaacaaggacaacgcggagatcatcctctccagcaccaagctgaaccacttcgagatcgtcgggaccacctccaccagcggctggttcaagaacacgatcaccaacaacctggagcacacgtgcgagcacgtgaccgtgaactgcgggcagaagtccgtcaagttccacgcctgcttccggcagcaccgcggctgcatccggttcttcaaggggacctacatgccctacagcatgatcgaggccatgtgcgtgaacatcgagctcatcatcctgaccctgtacatcttcgccgcgatcatcttcgccctcatcatcaccaagtcctacgtggcctacctgctgctcccgctgttctaccccgtcacctggttctacggcaaggtgtacaagaagatcaacagctgccccaactgcctgctcgcctcccaccccttcacgagctgcccgaagatctgcatctgcggcagccgcttctcctgcaccgaggccctgaaggtgcaccggatggggaaggactgcctgggctacaagagcctctccaaggcgcgccagatgtgcaagagcaagtcctggagcttcaccgccgccatcctgaccgggctgatcctcatggagttcatctcccccatcgccggcgagcggatgtacaagctggaggagctggccgacgagttcatcaagctcacggagcaggtcaacatcctggagcgcgagatggaggtgctgaagcagagcatcatcgtgatgttcgcgatcatcctcgtcctgctgctgttcgagaacatgatcttcaaccggctgttctccatcttctaccgcagctgctccatgtgcggcctgatccactaccggcccgggctcaagatcgacctgaccaagaccaacaagtgcggcagctgcatctgcgggttcaacgagcagcagtccagcggcttcgagtacgagatcttcctgaaggacatgcacatccagaaggagtcctgcaagttcagcccccgcgtgaaccacttccggaacatcaaggccctcctgttcgccctggtgatctgcgccaccatctacacggtctacgccgacgaggactgcctctccaaggacatcaagatcacctaccaggagctgcacaactgcatcgggccgaagatcatgggcaacacgtgcgtgagcaagaacgagctgtactccgacctcttcagcaagaacctggtcaccgagtacgacaagaagtacttcgagcccgacaccgtgaacgaccagttcaacaagatcgagttcgcgcaggacgcccaccgcatgatcctgctggagcggatcctctacaagaccgagtgcgagatgctgagcctgaagaagaactccggcccctacaacgtggcctggcgcacctacctcaagaaccacaacatcgacctgtgcagccggcacaactacaagatgatctgccagtgcatcaacacccactccatgtgcaagaacacggacatcgactacaacaaggagatcgagacctactacaagagcaacgccgccgcgtaccgcgccgacctgaacaccatcatggacaccctcaagacggccttccgcgggctgaccaaggtcctgatcgagaactacatcgagaaggacgactccgacgccctcaaggcgctgttcagcaacatcaccgactccgtgcaggacaactaccagatgatcggcatcctgaagttcgccagcaagctcctggacatcaacctggggcggtccacccgcagcgcccaccactccatcatgaccaacgagatccccaagagcaacccgttcacggactactcctacagcaacgtgaacatcaaggagtgcatgtcccccgagagcctcaagtgcttcaagaagcgggactccacgccccacaccaaccacctcctgtgcaagatcgacagcaagtacaaggccttcgactggcccgagatcgagaccatccagaagggccagaagctctgcctgggggacagccactgcaacctggagttcaccgccatcaccgcggacaagatcatgtccctcaccaactgctacaaggagagcttcaccgcccagccggccgacatgcagacgggcatcaagaagtgctccgccgacgagatcggcgagtgcaccaccctggaggacaagacctggcccatcgtcttctgcgggggcaagtactactacagcgactccaaggagcacgccaaggacgggagcatcaacaactactgcctgacgaacaagtgctccgagcagcgcttccccatccacgagaactggttcaagaagtgcaactgggacaagacccacaaggagttcagcaccatgcggcagatcaactacaacgacatcacctcctaccgcaaggcgatcgagagcgagatcggctccgacctcatgacgcaccactacaagcccaccaagaacctgccgcacgtggtgccccggtaccacagcatcgacgtccaggggaccgagtccaccgagggcatcatcaacggcttcatccagaacacgatccccgccatcagcgggctgggcgtggggtaccacctcaacttcaagggcaaccagctgttcgacatcgtgatcttcgtcaagaaggccgtgtacaaggcccagtaccagaaggcctacaccaccggcccctccatcagcatcaacatcgagcacaacgagcgctgcaccgggcactgcccggagaagatccccgcgaaggagggctggctgacgttctccaaggagcacaccagctcctgggggtgcgaggagtacggctgcctcgccatcgacaccgggtgcctgtacggcagctgccaggacgtgatccggcccgagctggacgtctacaagaagatcggcagcgaggtgtccctcatcgagatctgcatcaccctgccgcacgagacgtactgcaacgacatggacatcctggagcccatcatcggggacaagctcagcgcctccttccagaacacccagaccaaccagctgcccaccctgatcgcctacaagaagggcaagatctacacggggcagatcaacgacatcggcaacaccgcgctccagtgcgggagcatccaggtgatcaacggctccaccatcggcaccgggagccccaagttcgactacatctgccacgccatgcgccggaaggacgtcatcgtgcgcaagtgcttcaacgacaactaccagtcctgcacgcggctggagaagcgcaacgacctgatcccgtaccggaagggcgacgtgatcgaggtcagcaagaccgggtccaacatgggccagatgaccttcaagatcgagctcggggacgtgaactacaagatcttcaccaagagcatcgacctgcagatgtccggcatctgcgccggctgcatcgactgcgccgaggggatcagctgctccatcaacgccgaggtgcccgcggagaccgtctgccactgcaagacgaactgcgaggacttcatcaacaacatcgtgttcagcccccagatcaagaactacaacatcaaggtgcactgcaagtccaaggtcgagaagatcatcgcccacatctgcggccgcgacatcgacctgcagctcaccgtgaagccctacaaccagaagatcgacctgagccagctggacgagtccaactacatccgggaggaggacctccagtgcgggacctggctgtgcaaggtgcagaaggagggcgtcgacatcatcttcaaggggctgttcagcggcctcggccgctactggaccatcctgatctactccatcatcggggtggtgatcatcgtcatcctggtgtacatcctcctgccgatcggccggctgctcaaggccttcctgatccgccacgagatcgagtacgccatggagcagaagatcaagtga

SEQ ID NO: 12688 - RNA, 4263 nt, synthetic construct
  misc_feature 1..4263: note = derived and/or modified CDS sequence (opt1) from OROV(BeH759022)__KP691610.1__GP
  source 1..4263: mol_type = other RNA
atggccaacctgatcatcatcagcatggccctctccgtggcgtacggccaccccctgagcacctcccagatcggggaccgctgcttcgccggcgggaacctgttcaaggagatgaacctcagcgtcggcctgggggagatctgcgtgaaggacgacatctccatcgtcaagagcaccacggtgttctccaagaaccggccggccctggaggccaccaccaagttctaccgcagcttcatcgtgaaggactggtccgagtgcaaccccgtgctcgacaagttcggcaacttcatggtcctgagcgtggacgacaacggccacatcatgcccaagatgtacacgtgccgggccgcgtgcgacatccgcctgaacaaggacaacgccgagatcatcctctccagcaccaagctgaaccacttcgagatcgtggggaccacctccaccagcggctggttcaagaacacgatcaccaacaacctggagcacacgtgcgagcacgtcaccgtgaactgcgggcagaagtccgtgaagttccacgcctgcttccggcagcaccgcggctgcatccggttcttcaaggggacctacatgccctacagcatgatcgaggccatgtgcgtcaacatcgagctcatcatcctgaccctgtacatcttcgcggccatcatcttcgccctcatcatcaccaagtcctacgtggcctacctgctgctcccgctgttctaccccgtgacctggttctacggcaaggtctacaagaagatcaacagctgccccaactgcctgctcgcctcccaccccttcacgagctgcccgaagatctgcatctgcggcagccgcttctcctgcaccgaggcgctgaaggtgcaccggatggggaaggactgcctgggctacaagagcctctccaaggcccgccagatgtgcaagagcaagtcctggagcttcaccgccgccatcctgaccgggctgatcctcatggagttcatctcccccatcgccggcgagcggatgtacaagctggaggagctggcggacgagttcatcaagctcacggagcaggtcaacatcctggagcgcgagatggaggtgctgaagcagagcatcatcgtgatgttcgccatcatcctcgtgctgctgctgttcgagaacatgatcttcaaccggctgttctccatcttctaccgcagctgctccatgtgcggcctgatccactaccggcccgggctcaagatcgacctgaccaagaccaacaagtgcggcagctgcatctgcgggttcaacgagcagcagtccagcggcttcgagtacgagatcttcctgaaggacatgcacatccagaaggagtcctgcaagttcagcccccgcgtcaaccacttccggaacatcaaggccctcctgttcgccctggtgatctgcgccaccatctacacggtgtacgcggacgaggactgcctctccaaggacatcaagatcacctaccaggagctgcacaactgcatcgggccgaagatcatgggcaacacgtgcgtcagcaagaacgagctgtactccgacctcttcagcaagaacctggtgaccgagtacgacaagaagtacttcgagcccgacaccgtcaacgaccagttcaacaagatcgagttcgcccaggacgcccaccgcatgatcctgctggagcggatcctctacaagaccgagtgcgagatgctgagcctgaagaagaactccggcccctacaacgtggcctggcgcacctacctcaagaaccacaacatcgacctgtgcagccggcacaactacaagatgatctgccagtgcatcaacacccactccatgtgcaagaacacggacatcgactacaacaaggagatcgagacctactacaagagcaacgccgcggcctaccgcgccgacctgaacaccatcatggacaccctcaagacggccttccgcgggctgaccaaggtgctgatcgagaactacatcgagaaggacgactccgacgcgctcaaggccctgttcagcaacatcaccgactccgtccaggacaactaccagatgatcggcatcctgaagttcgccagcaagctcctggacatcaacctggggcggtccacccgcagcgcccaccactccatcatgaccaacgagatccccaagagcaacccgttcacggactactcctacagcaacgtgaacatcaaggagtgcatgtcccccgagagcctcaagtgcttcaagaagcgggactccacgccccacaccaaccacctcctgtgcaagatcgacagcaagtacaaggccttcgactggcccgagatcgagaccatccagaagggccagaagctctgcctgggggacagccactgcaacctggagttcaccgcgatcaccgccgacaagatcatgtccctcaccaactgctacaaggagagcttcaccgcccagccggccgacatgcagacgggcatcaagaagtgctccgccgacgagatcggcgagtgcaccaccctggaggacaagacctggcccatcgtgttctgcgggggcaagtactactacagcgactccaaggagcacgcgaaggacgggagcatcaacaactactgcctgacgaacaagtgctccgagcagcgcttccccatccacgagaactggttcaagaagtgcaactgggacaagacccacaaggagttcagcaccatgcggcagatcaactacaacgacatcacctcctaccgcaaggccatcgagagcgagatcggctccgacctcatgacgcaccactacaagcccaccaagaacctgccgcacgtcgtgccccggtaccacagcatcgacgtgcaggggaccgagtccaccgagggcatcatcaacggcttcatccagaacacgatccccgccatcagcgggctgggcgtcgggtaccacctcaacttcaagggcaaccagctgttcgacatcgtgatcttcgtgaagaaggccgtctacaaggcccagtaccagaaggcgtacaccaccggcccctccatcagcatcaacatcgagcacaacgagcgctgcaccgggcactgcccggagaagatccccgccaaggagggctggctgacgttctccaaggagcacaccagctcctgggggtgcgaggagtacggctgcctcgccatcgacaccgggtgcctgtacggcagctgccaggacgtgatccggcccgagctggacgtgtacaagaagatcggcagcgaggtctccctcatcgagatctgcatcaccctgccgcacgagacgtactgcaacgacatggacatcctggagcccatcatcggggacaagctcagcgcctccttccagaacacccagaccaaccagctgcccaccctgatcgcgtacaagaagggcaagatctacacggggcagatcaacgacatcggcaacaccgccctccagtgcgggagcatccaggtgatcaacggctccaccatcggcaccgggagccccaagttcgactacatctgccacgccatgcgccggaaggacgtgatcgtccgcaagtgcttcaacgacaactaccagtcctgcacgcggctggagaagcgcaacgacctgatcccgtaccggaagggcgacgtgatcgaggtgagcaagaccgggtccaacatgggccagatgaccttcaagatcgagctcggggacgtcaactacaagatcttcaccaagagcatcgacctgcagatgtccggcatctgcgccggctgcatcgactgcgccgaggggatcagctgctccatcaacgcggaggtgcccgccgagaccgtgtgccactgcaagacgaactgcgaggacttcatcaacaacatcgtcttcagcccccagatcaagaactacaacatcaaggtgcactgcaagtccaaggtggagaagatcatcgcccacatctgcggccgcgacatcgacctgcagctcaccgtcaagccctacaaccagaagatcgacctgagccagctggacgagtccaactacatccgggaggaggacctccagtgcgggacctggctgtgcaaggtgcagaaggagggcgtggacatcatcttcaaggggctgttcagcggcctcggccgctactggaccatcctgatctactccatcatcggggtcgtgatcatcgtgatcctggtctacatcctcctgccgatcggccggctgctcaaggccttcctgatccgccacgagatcgagtacgccatggagcagaagatcaagtga

SEQ ID NO: 12689 - RNA, 4263 nt, synthetic construct
  misc_feature 1..4263: note = derived and/or modified CDS sequence (opt1) from OROV(BeH759040)__KP691616.1__GP
  source 1..4263: mol_type = other RNA
atggccaacctgatcatcatcagcatgatcctctccgtggcctacggccaccccctgagcacctcccagatcggggaccgctgcttcgcgggcgggaacctgttcaaggagatgaacctcagcgtcggcctgggggagatctgcgtgaaggacgacatctccatcgtcaagagcaccacggtgttctccaagaaccggccggccctggaggccaccaccaagttctaccgcagcttcatcgtgaaggactggtccgagtgcaaccccgtgctcgacaagttcggcaacttcatggtcctgagcgtggacgacaacggccacatcatgcccaagatgtacacgtgccgggccgcctgcgacatccgcctgaacaaggacaacgcggagatcatcctctccagcaccaagctgaaccacttcgagatcgtggggaccacctccaccagcggctggttcaagaacacgatcaccaacaacctggagcacacgtgcgagcacgtcaccgtgaactgcgggcagaagtccgtgaagttccacgcctgcttccggcagcaccgcggctgcatccggttcttcaaggggacctacatgccctacagcatgatcgaggccatgtgcgtcaacatcgagctcatcatcctgaccctgtacatcttcgccgcgatcatcttcgccctcatcatcaccaagtcctacgtggcctacctgctgctcccgctgttctaccccgtgacctggttctacggcaaggtctacaagaagatcaacagctgccccaactgcctgctcgcctcccaccccttcacgagctgcccgaagatctgcatctgcggcagccgcttctcctgcaccgaggccctgaaggtgcaccggatggggaaggactgcctgggctacaagagcctctccaaggcgcgccagatgtgcaagagcaagtcctggagcttcaccgccgccatcctgaccgggctgatcctcatggagttcatctcccccatcgccggcgagcggatgtacaagctggaggagctggccgacgagttcatcaagctcacggagcaggtcaacatcctggagcgcgagatggaggtgctgaagcagagcatcatcgtgatgttcgcgatcatcctcgtgctgctgctgttcgagaacatgatcttcaaccggctgttctccatcttctaccgcagctgctccatgtgcggcctgatccactaccggcccgggctcaagatcgacctgaccaagaccaacaagtgcggcagctgcatctgcgggttcaacgagcagcagtccagcggcttcgagtacgagatcttcctgaaggacatgcacatccagaaggagtcctgcaagttcagcccccgcgtcaaccacttccggaacatcaaggccctcctgttcgccctggtgatctgcgccaccatctacacggtgtacgccgacgaggactgcctctccaaggacatcaagatcacctaccaggagctgcacaactgcatcgggccgaagatcatgggcaacacgtgcgtcagcaagaacgagctgtactccgacctcttcagcaagaacctggtgaccgagtacgacaagaagtacttcgagcccgacaccgtcaacgaccagttcaacaagatcgagttcgcgcaggacgcccaccgcatgatcctgctggagcggatcctctacaagaccgagtgcgagatgctgagcctgaagaagaactccggcccctacaacgtggcctggcgcacctacctcaagaaccacaacatcgacctgtgcagccggcacaactacaagatgatctgccagtgcatcaacacccactccatgtgcaagaacacggacatcgactacaacaaggagatcgagacctactacaagagcaacgccgccgcgtaccgcgccgacctgaacaccatcatggacaccctcaagacggccttccgcgggctgaccaaggtgctgatcgagaactacatcgagaaggacgactccgacgccctcaaggcgctgttcagcaacatcaccgactccgtccaggacaactaccagatgatcggcatcctgaagttcgccagcaagctcctggacatcaacctggggcggtccacccgcagcgcccaccactccatcatgaccaacgagatccccaagagcaacccgttcacggactactcctacagcaacgtgaacatcaaggagtgcatgtcccccgagagcctcaagtgcttcaagaagcgggactccacgccccacaccaaccacctcctgtgcaagatcgacagcaagtacaaggccttcgactggcccgagatcgagaccatccagaagggccagaagctctgcctgggggacagccactgcaacctggagttcaccgccatcaccgcggacaagatcatgtccctcaccaactgctacaaggagagcttcaccgcccagccggccgacatgcagacgggcatcaagaagtgctccgccgacgagatcggcgagtgcaccaccctggaggacaagacctggcccatcgtgttctgcgggggcaagtactactacagcgactccaaggagcacgccaaggacgggagcatcaacaactactgcctgacgaacaagtgctccgagcagcgcttccccatccacgagaactggttcaagaagtgcaactgggacaagacccacaaggagttcagcaccatgcggcagatcaactacaacgacatcacctcctaccgcaaggcgatcgagagcgagatcggctccgacctcatgacgcaccactacaagcccaccaagaacctgccgcacgtcgtgccccggtaccacagcatcgacgtgcaggggaccgagtccaccgagggcatcatcaacggcttcatccagaacacgatccccgccatcagcgggctgggcgtcgggtaccacctcaacttcaagggcaaccagctgttcgacatcgtgatcttcgtgaagaaggccgtctacaaggcccagtaccagaaggcctacaccaccggcccctccatcagcatcaacatcgagcacaacgagcgctgcaccgggcactgcccggagaagatccccgcgaaggagggctggctgacgttctccaaggagcacaccagctcctgggggtgcgaggagtacggctgcctcgccatcgacaccgggtgcctgtacggcagctgccaggacgtgatccggcccgagctggacgtgtacaagaagatcggcagcgaggtctccctcatcgagatctgcatcaccctgccgcacgagacgtactgcaacgacatggacatcctggagcccatcatcggggacaagctcagcgcctccttccagaacacccagaccaaccagctgcccaccctgatcgcctacaagaagggcaagatctacacggggcagatcaacgacatcggcaacaccgcgctccagtgcgggagcatccaggtgatcaacggctccaccatcggcaccgggagccccaagttcgactacatctgccacgccatgcgccggaaggacgtgatcgtccgcaagtgcttcaacgacaactaccagtcctgcacgcggctggagaagcgcaacgacctgatcccgtaccggaagggcgacgtgatcgaggtgagcaagaccgggtccaacatgggccagatgaccttcaagatcgagctcggggacgtcaactacaagatcttcaccaagagcatcgacctgcagatgtccggcatctgcgccggctgcatcgactgcgccgaggggatcagctgctccatcaacgccgaggtgcccgcggagaccgtgtgccactgcaagacgaactgcgaggacttcatcaacaacatcgtcttcagcccccagatcaagaactacaacatcaaggtgcactgcaagtccaaggtggagaagatcatcgcccacatctgcggccgcgacatcgacctgcagctcaccgtcaagccctacaaccagaagatcgacctgagccagctggacgagtccaactacatccgggaggaggacctccagtgcgggacctggctgtgcaaggtgcagaaggagggcgtggacatcatcttcaaggggctgttcagcggcctcggccgctactggaccatcctgatctactccatcatcggggtcgtgatcatcgtgatcctggtctacatcctcctgccgatcggccggctgctcaaggccttcctgatccgccacgagatcgagtacgccatggagcagaagatcaagtga

SEQ ID NO: 12690 - RNA, 4263 nt, synthetic construct
  misc_feature 1..4263: note = derived and/or modified CDS sequence (opt1) from OROV(BeH759146)__KP691631.1__GP
  source 1..4263: mol_type = other RNA
atggccaacctgatcatcatcagcatggtgctctccgtcgcctacggccaccccctgagcacctcccagatcggggaccgctgcttcgcgggcgggaacctgttcaaggagatgaacctcagcgtgggcctgggggagatctgcgtgaaggacgacatctccatcgtcaagagcaccacggtgttctccaagaaccggccggccctggaggccaccaccaagttctaccgcagcttcatcgtgaaggactggtccgagtgcaaccccgtcctcgacaagttcggcaacttcatggtgctgagcgtggacgacaacggccacatcatgcccaagatgtacacgtgccgggccgcctgcgacatccgcctgaacaaggacaacgcggagatcatcctctccagcaccaagctgaaccacttcgagatcgtcgggaccacctccaccagcggctggttcaagaacacgatcaccaacaacctggagcacacgtgcgagcacgtgaccgtgaactgctgccagaagtccgtcaagttccacgcctgcttccggcagcaccgcgggtgcatccggttcttcaagggcacctacatgccctacagcatgatcgaggccatgtgcgtgaacatcgagctcatcatcctgaccctgtacatcttcgccgcgatcatcttcgccctcatcatcaccaagtcctacgtggcctacctgctgctcccgctgttctaccccgtcacctggttctacgggaaggtgtacaagaagatcaacagctgccccaactgcctgctcgcctcccaccccttcacgagctgcccgaagatctgcatctgcggcagccgcttctcctgcaccgaggccctgaaggtgcaccggatgggcaaggactgcctggggtacaagagcctctccaaggcgcgccagatgtgcaagagcaagtcctggagcttcaccgccgccatcctgaccggcctgatcctcatggagttcatctcccccatcgccggggagcggatgtacaagctggaggagctggccgacgagttcatcaagctcacggagcaggtcaacatcctggagcgcgagatggaggtgctgaagcagagcatcatcgtgatgttcgcgatcatcctcgtcctgctgctgttcgagaacatgatcttcaaccggctgttctccatcttctaccgcagctgctccatgtgcggcctgatccactaccggcccggcctcaagatcgacctgaccaagaccaacaagtgcgggagctgcatctgcggcttcaacgagcagcagtccagcgggttcgagtacgagatcttcctgaaggacatgcacatccagaaggagtcctgcaagttcagcccccgcgtgaaccacttccggaacatcaaggccctcctgttcgccctggtgatctgcgccaccatctacacggtctacgccgacgaggactgcctctccaaggacatcaagatcacctaccaggagctgcacaactgcatcggcccgaagatcatggggaacacgtgcgtgagcaagaacgagctgtactccgacctcttcagcaagaacctggtcaccgagtacgacaagaagtacttcgagcccgacaccgtgaacgaccagttcaacaagatcgagttcgcgcaggacgcccaccgcatgatcctgctggagcggatcctctacaagaccgagtgcgagatgctgagcctgaagaagaactccggcccctacaacgtggcctggcgcacctacctcaagaaccacaacatcgacctgtgcagccggcacaactacaagatgatctgccagtgcatcaacacccactccatgtgcaagaacacggacatcgactacaacaaggagatcgagacctactacaagagcaacgccgccgcgtaccgcgccgacctgaacatcatcatggacaccctcaagaccgccttccgcggcctgacgaaggtcctgatcgagaactacatcgagaaggacgactccgacgccctcaaggcgctgttcagcaacatcaccgactccgtgcaggacaactaccagatgatcgggatcctgaagttcgccagcaagctcctggacatcaacctgggccggtccacccgcagcgcccaccactccatcatgaccaacgagatccccaagagcaacccgttcaccgactactcctacagcaacgtgaacatcaaggagtgcatgtcccccgagagcctcaagtgcttcaagaagcgggactccacgccccacaccaaccacctcctgtgcaagatcgacagcaagtacaaggccttcgactggcccgagatcgagaccatccagaaggggcagaagctctgcctgggcgacagccactgcaacctggagttcaccgccatcacggcggacaagatcatgtccctcaccaactgctacaaggagagcttcaccgcccagccggccgacatgcagaccgggatcaagaagtgctccgccgacgagatcggcgagtgcacgaccctggaggacaagacctggcccatcgtcttctgcggcgggaagtactactacagcgactccaaggagcacgccaaggacggcagcatcaacaactactgcctgaccaacaagtgctccgagcagcgcttccccatccacgagaactggttcaagaagtgcaactgggacaagacgcacaaggagttcagcaccatgcggcagatcaactacaacgacatcacctcctaccgcaaggcgatcgagagcgagatcgggtccgacctcatgacccaccactacaagcccacgaagaacctgccgcacgtggtgccccggtaccacagcatcgacgtccagggcaccgagtccaccgaggggatcatcaacggcttcatccagaacaccatccccgccatcagcggcctgggggtgggctaccacctcaacttcaaggggaaccagctgttcgacatcgtgatcttcgtcaagaaggccgtgtacaaggcccagtaccagaaggcctacacgaccggcccctccatcagcatcaacatcgagcacaacgagcgctgcaccggccactgcccggagaagatccccgcgaaggaggggtggctgaccttctccaaggagcacacgagctcctggggctgcgaggagtacgtgtgcctcgccatcgacaccgggtgcctgtacggcagctgccaggacgtcatccggcccgagctggacgtgtacaagaagatcgggagcgaggtgtccctcatcgagatctgcatcaccctgccgcacgagacctactgcaacgacatggacatcctggagcccatcatcggcgacaagctcagcgcctccttccagaacacgcagaccaaccagctgcccaccctgatcgcctacaagaagggcaagatctacaccgggcagatcaacgacatcggcaacacggcgctccagtgcgggagcatccaggtcatcaacggctccaccatcgggaccggcagccccaagttcgactacatctgccacgccatgcgccggaaggacgtgatcgtgcgcaagtgcttcaacgacaactaccagtcctgcacccggctggagaagcgcaacgacctgatcccgtaccggaagggcgacgtcatcgaggtgagcaagacggggtccaacatgggccagatgaccttcaagatcgagctcggggacgtgaactacaagatcttcaccaagagcatcgacctgcagatgtccggcatctgcgccgggtgcatcgactgcgccgagggcatcagctgctccatcaacgccgaggtccccgcggagaccgtgtgccactgcaagaccaactgcgaggacttcatcaacaacatcgtgttcagcccccagatcaagaactacaacatcaaggtccactgcaagtccaaggtggagaagatcatcgcccacatctgcggccgcgacatcgacctgcagctcacggtgaagccctacaaccagaagatcgacctgagccagctggacgagtccaactacatccgggaggaggacctccagtgcgggacctggctgtgcaaggtccagaaggagggcgtggacatcatcttcaaggggctgttcagcggcctcgggcgctactggaccatcctgatctactccatcatcggcgtggtcatcatcgtgatcctggtgtacatcctcctgccgatcggccggctgctcaaggccttcctgatccgccacgagatcgagtacgccatggagcagaagatcaagtga

SEQ ID NO: 12691 - RNA, 4263 nt, synthetic construct
  misc_feature 1..4263: note = derived and/or modified CDS sequence (opt1) from OROV(BeH759620)__KP691622.1__GP
  source 1..4263: mol_type = other RNA
atggccaacctgatcatcatcagcatggtgctctccgtcgcctacggccaccccctgagcacctcccagatcggggaccgctgcttcgcgggcgggaacctgttcaaggagatgaacctcagcgtgggcctgggggagatctgcgtgaaggacgacatctccatcgtcaagagcaccacggtgttctccaagaaccggccggccctggaggccaccaccaagttctaccgcagcttcatcgtgaaggactggtccgagtgcaaccccgtcctcgacaagttcggcaacttcatggtgctgagcgtggacgacaacggccacatcatgcccaagatgtacacgtgccgggccgcctgcgacatccgcctgaacaaggacaacgcggagatcatcctctccagcaccaagctgaaccacttcgagatcgtcgggaccacctccaccagcggctggttcaagaacacgatcaccaacaacctggagcacacgtgcgagcacgtgaccgtgaactgcgggcagaagtccatcaagttccacgcctgcttccggcagcaccgcggctgcatccggttcttcaaggggacctacatgccctacagcatgatcgaggccatgtgcgtcaacatcgagctcatcatcctgaccctgtacatcttcgccgcgatcatcttcgccctcatcatcaccaagtcctacgtggcctacctgctgctcccgctgttctaccccgtgacctggttctacggcaaggtctacaagaagatcaacagctgccccaactgcctgctcgcctcccaccccttcacgagctgcccgaagatctgcatctgcggcagccgcttctcctgcaccgaggccctgaaggtgcaccggatggggaaggactgcctgggctacaagagcctctccaaggcgcgccagatgtgcaagagcaagtcctggagcttcaccgccgccatcctgaccgggctgatcctcatggagttcatctcccccatcgccggcgagcggatgtacaagctggaggagctggccgacgagttcatcaagctcacggagcaggtcaacatcctggagcgcgagatggaggtgctgaagcagagcatcatcgtgatgttcgcgatcatcctcgtgctgctgctgttcgagaacatgatcttcaaccggctgttctccatcttctaccgcagctgctccatgtgcggcctgatccactaccggcccgggctcaagatcgacctgaccaagaccaacaagtgcggcagctgcatctgcgggttcaacgagcagcagtccagcggcttcgagtacgagatcttcctgaaggacatgcacatccagaaggagtcctgcaagttcagcccccgcgtcaaccacttccggaacatcaaggccctcctgttcgccctggtgatctgcgccaccatctacacggtgtacgccgacgaggactgcctctccaaggacatcaagatcacctaccaggagctgcacaactgcatcgggccgaagatcatgggcaacacgtgcgtcagcaagaacgagctgtactccgacctcttcagcaagaacctggtgaccgagtacgacaagaagtacttcgagcccgacaccgtcaacgaccagttcaacaagatcgagttcgcgcaggacagccaccgcatgatcctgctggagcggatcctctacaagaccgagtgcgagatgctgtccctgaagaagaacagcggcccctacaacgtggcctggcgcacctacctcaagaaccacaacatcgacctgtgctcccggcacaactacaagatgatctgccagtgcatcaacacccacagcatgtgcaagaacacggacatcgactacaacaaggagatcgagacctactacaagtccaacgccgccgcctaccgcgcggacctgaacaccatcatggacaccctcaagacggccttccgcgggctgaccaaggtgctgatcgagaactacatcgagaaggacgacagcgacgccctcaaggccctgttctccaacatcaccgacagcgtccaggacaactaccagatgatcggcatcctgaagttcgcgtccaagctcctggacatcaacctggggcggagcacccgctccgcccaccacagcatcatgaccaacgagatccccaagtccaacccgttcacggactacagctactccaacgtgaacatcaaggagtgcatgagccccgagtccctcaagtgcttcaagaagcgggacagcacgccccacaccaaccacctcctgtgcaagatcgacagcaagtacaaggccttcgactggcccgagatcgagaccatccagaagggccagaagctctgcctgggggactcccactgcaacctggagttcaccgccatcaccgccgacaagatcatgagcctcaccaactgctacaaggagtccttcaccgcgcagccggccgacatgcagacgggcatcaagaagtgcagcgccgacgagatcggcgagtgcaccaccctggaggacaagacctggcccatcgtgttctgcgggggcaagtactactactccgacagcaaggagcacgccaaggacgggtccatcaacaactactgcctgacgaacaagtgcagcgagcagcgcttccccatccacgagaactggttcaagaagtgcaactgggacaagacccacaaggagttctccaccatgcggcagatcaactacaacgacatcaccagctaccgcaaggccatcgagtccgagatcggcagcgacctcatgacgcaccactacaagcccaccaagaacctgccgcacgtcgtgccccggtaccactccatcgacgtgcaggggaccgagagcaccgagggcatcatcaacggcttcatccagaacacgatccccgcgatctccgggctgggcgtcgggtaccacctcaacttcaagggcaaccagctgttcgacatcgtgatcttcgtgaagaaggccgtctacaaggcccagtaccagaaggcctacaccaccggccccagcatctccatcaacatcgagcacaacgagcgctgcaccgggcactgcccggagaagatccccgccaaggagggctggctgacgttcagcaaggagcacacctccagctgggggtgcgaggagtacggctgcctcgcgatcgacaccgggtgcctgtacggcagctgccaggacgtgatccggcccgagctggacgtgtacaagaagatcggctccgaggtcagcctcatcgagatctgcatcaccctgccgcacgagacgtactgcaacgacatggacatcctggagcccatcatcggggacaagctctccgccagcttccagaacacccagaccaaccagctgcccaccctgatcgcctacaagaagggcaagatctacacggggcagatcaacgacatcggcaacaccgccctccagtgcgggtccatccaggtgatcaacggcagcaccatcggcaccgggtcccccaagttcgactacatctgccacgcgatgcgccggaaggacgtgatcgtccgcaagtgcttcaacgacaactaccagagctgcacgcggctggagaagcgcaacgacctgatcccgtaccggaagggcgacgtgatcgaggtgtccaagaccgggagcaacatgggccagatgaccttcaagatcgagctcggggacgtcaactacaagatcttcaccaagtccatcgacctgcagatgagcggcatctgcgccggctgcatcgactgcgccgaggggatctcctgcagcatcaacgccgaggtgcccgccgagaccgtgtgccactgcaagacgaactgcgaggacttcatcaacaacatcgtcttcagcccccagatcaagaactacaacatcaaggtgcactgcaagtccaaggtggagaagatcatcgcgcacatctgcggccgcgacatcgacctgcagctcaccgtcaagccctacaaccagaagatcgacctgtcccagctggacgagagcaactacatccgggaggaggacctccagtgcgggacctggctgtgcaaggtgcagaaggagggcgtggacatcatcttcaaggggctgttctccggcctcggccgctactggaccatcctgatctacagcatcatcggggtcgtgatcatcgtgatcctggtctacatcctcctgccgatcggccggctgctcaaggccttcctgatccgccacgagatcgagtacgccatggagcagaagatcaagtga

SEQ ID NO: 12692 - RNA, 4263 nt, synthetic construct
  misc_feature 1..4263: note = derived and/or modified CDS sequence (opt1) from OROV(BeAn19991)__KP052851.1__GP
  source 1..4263: mol_type = other RNA
atggccaacctgatcatcatcagcatggtgctcggcgtcgcctacgggcaccccctgtccaccagccagatcggcgaccgctgcttcgccgggggcaacctgttcaaggagatgaacctctccgtggggctgggcgagatctgcgtgaaggacgacatcagcatcgtcaagtccaccacggtgttcagcaagaacaagccggcgctggaggccaccaccaagttctaccggtccttcatcgtgaaggactggagcgagtgcaaccccgtcctcgacaagttcggcaacttcatggtgctgtccgtggacgacaacgggcacatcatccccaagatgtacacgtgccgcgccgcctgcgacatccggctgaacaaggacaacgcggagatcatcctcagctccaccaagctgaaccacttcgagatcgtcggcaccaccagcacctccgggtggttcaagaacacgatcaccaacaacctggagcacacgtgcgagcacgtgaccgtgaactgcggccagaagtccgtcaagttccacgcctgcttccgccagcaccgggggtgcatccgcttcttcaagggcacctacatgccctactccatgatcgaggccatgtgcgtgaacatcgagctcatcatcctgaccctgtacatcttcgccgcgatcatcttcgccctcatcatcaccaagagctacgtggcctacctgctgctcccgctgttctaccccgtcacctggttctacggcaaggtgtacaagaagatcaactcctgccccaactgcctgctcgccagccaccccttcacgtcctgcccgaagatctgcatctgcgggagccggttcagctgcaccgaggccctgaaggtgcaccgcatgggcaaggactgcctggggtacaagtccctcagcaaggcgcggcagatgtgcaagtccaagagctggtccttcaccgccgccatcctgaccggcctgatcctcatggagttcatcagccccatcgccggcgagcgcatgtacaagctggaggagctggccgacgagttcatcaagctcacggagcaggtcaacatcctggagcgggagatggaggtgctgaagcagtccatcatcgtgatgttcgcgatcatcctcgtcctgctgctgttcgagaacatgatcttcaaccgcctgttccggatcttctaccgcagctgctccatgtgcgggctgatccactaccggcccggcctcaagatcgacctgaccaagaccaaccgctgcgggagctgcatctgcggcttcgacgagcagcagtccagcgggttcgagtacgagatcttcctgaaggacatgcacgtgcagaaggagtcctgcaagttcagcccccgggtgaaccacttccgcaacatcaaggccctcctgttcgccctggtcatctgcgccaccatctacacggtgtacgccgacgaggactgcctctccaaggacatcaagatcacctaccaggagctgcacaactgcatcggcccgaagatcatgggcgacacgtgcgtcagcaagtccgagctgtacagcgacctcttctccaagaacctggtgaccgagtacgacaagaagtacttcgagcccgacaccgtgaacgaccagttcaacaagatcgagttcgcgcaggacgcccaccggatgatcctgctggagcgcatcctctacaagaccgagtgcgagatgctgagcctgaagaagaacagcgggccctacaacgtcgcctggcggacctacttcaagaaccacaacatcgacctctgctcccgccacaactacaagatgatctgccagtgcatcaacacccacagcatgtgcaagaacacggacatcgactacaacaaggagatcgagacctactacaagtccaacgccgccgcgtaccgcgccgacctgaacaccatcatggacaccctgaagacggccttccggggcctcaccaaggtgctgatcgagaactacatcgagaaggacgacagcgacgccctgaaggccctcttctccaacatcaccgacagcgtgcaggacaactaccagatgatcgggatcctgaagttcgcgtccaagctgctcgacatcaacctgggccgcagcacccggtccgcccaccacagcatcatgaccaacgagatccccaagtccaacccgttcacggactacagctactccaacctgaacatcaaggagtgcatgagccccgagtccctcaagtgcttcaagaagcgcgacagcacgccccacaccaaccacctcctgtgcaagatcgacaacaagtacaaggccttcgactggcccgagatcgagaccatccagaaggggcagaagctctgcctgggcgactcccactgcaacctggagttcaccgccatcaccgcggacaagatcatgagcctcaccaactgctacaaggagagcttcaccgcccagccggccgacatgcaggccggcatcaagaagtgctccgccgacgagatcggggagtgcacgaccctggaggacaagacctggcccatcatcttctgcggcgggaagtactactacagcgactccaaggagcacgcgaaggacggcagcatcaacaactactgcctgaccaacaagtgctccgagcagcggttccccatccacgagaactggttcaagaagtgcaactgggacaagacgcacaaggagttcagcaccatgcgccagatcaactacaacgacatcacctcctaccggaaggccatcgagagcgagatcgggaccgacctcatgacgcaccactacaagcccaccaagaacctgccgcacgtcgtgccccgctaccactccatcgacgtgcagggcaccgagagcaccgagggcatcatcaacgggttcatccagaacacgatccccgccatctccggcctgggggtcggctaccacctcaacttcaagggcaaccagctgttcgacatcgtgatcttcgtgaagaaggccgtctacaaggcccagtaccagaaggcgtacaccaccgggcccagcatctccatcaacatcgagcacaacgagcggtgcaccggccactgcccggagaagatccccgccaaggaggggtggctgacgttcagcaaggagcacacctccagctggggctgcgaggagtacgggtgcctcgccatcgacaccggctgcctgtacggctcctgccaggacgtgatccgccccgagctggacgtgtacaagaagatcgggagcgaggtctccctcatcgagatctgcatcaccctgccgcacgagacgtactgcaacgacatggacatcctggagcccatcatcggcgacaagctcagcgccagcttccagaacacccagaccaaccagctgcccaccctgatcgcgtacaagaaggggaagatctacacgggccagatcaacgacatcgggaacaccgccctccagtgcggctccatccaggtgatcaacggcagcaccatcgggaccggctcccccaagttcgactacatctgccacgccatgcggcgcaaggacgtgatcgtccggaagtgcttcaacgacaactaccagagctgcacgcgcctggagaagcggaacgacctgatcccgtaccgcaagggggacgtgatcgaggtgtccaagaccggcagcaacatggggcagatgaccttcaagatcgagctcggcgacatcaactacaagatcttcaccaagtccatcgacctgcagatgagcggcatctgcgccgggtgcatcgactgcgccgagggcatctcctgcagcatcaacgcggaggtccccgccgagaccgtgtgccactgcaagacgaactgcgaggacttcatcaacaacatcgtgttcagcccccagatcaagaactacaacatcaaggtccactgcaagagcaaggtggagaagatcaccgcccacatctgcgggcgggacatcgacctgcagctcaccatcaagccctacaaccagaagatcgacctgtcccagctggacgagagcaactacatccgcgaggaggacctccagtgcggcacctggctgtgcaaggtgcagaaggaggggatcgacatcatcttcaagggcctgttctccggcctcgggcggtactggacgatcctgatctacagcatcatcggcgtcgtgatcatcgtgatcctggtctacatcctcctgccgatcgggcgcctgctcaaggccttcctgatccgccacgagatcgagtacgccatggagcagaagatcaagtga

SEQ ID NO: 12693 - RNA, 4263 nt, synthetic construct
  misc_feature 1..4263: note = derived and/or modified CDS sequence (opt1) from OROV(Tr9760)__AF312381.2__GP
  source 1..4263: mol_type = other RNA
atggccaacctgatcatcatcagcatggtgctctccatcgcctacggccaccccctgagcacctcccagatcggggaccgctgcttcgcgggcgggaacctgttcaaggagatgaacctcagcgtcggcctgggggagatctgcgtgaaggacgacatctccatcgtgaagtccaccacggtcttctccaagaacaagctggccctcgaggccaccaccaagttctaccggagcttcatcgtgaaggactggtccgagtgcaacccggtgctggacaagttcggcaacttcatggtcctgagcgtggacgacaacggccacaccatccccaagatgtacacgtgccgcgccgcctgcgacatccggctcaacaaggacaacgcggagatcatcctgtccagcaccaagctgaaccacttcgagatcgtggggaccacctccacgagcggctggttcaagaacaccatcaccaacaacctcgagcacacgtgcgagcacgtcacggtgaactgcgggcagaagtccgtgaagttccacgcctgcttccgccagcaccggggctgcgtccgcttcttcaaggggacctacatgccccacagcatgatcgaggccatgtgcgtgaacatcgagctgatcatcctgaccctctacatcttcgccgcgatcatcttcgccctgatcatcaccaagtcctacgtggcctacctgctcctgcccctgttctacccggccacgtggttctacggcaaggtctacaagaagatcaacagctgccccaactgcctcctggcctcccaccccttcaccagctgccccaagatctgcatctgcggcagccggttctcctgcaccgaggcgctgaaggtgcaccgcatggggaaggactgcctcggctacaagagcctgtccaaggcccggcagatgtgcaagagcaagtcctggagcttcaccgccgccatcctgacggggctcatcctgatggagttcatctccccgatcgccggcgagcgcatgtacaagctggaggagctcgcggacgagttcatcaagctgaccgagcaggtcaacatcctggagcgggagatggaggtgctcaagcagagcatcatcgtgatgttcgccatcatcctggtgctgctcctgttcgagaacatgatcttcaaccgcctgttccggatcttctaccgctcctgcagcatgtgcggcctcatccactaccggcccgggctgaagatcgacctgaccaagaccaaccgctgcggctcctgcatctgcgggttcgacgagcagcagagctccggcttcgagtacgagatcttcctcacggacatgcacgtccagaaggagagctgcaagttcagcccccgggtgaaccacttccgcaacaccaaggccctgctgttcgccctcgtgatctgcgccaccatctacaccgtctacgcggacgaggactgcctgagcaaggacatcaagatcacgtaccaggagctgcacaactgcatcgggcccaagatcatgggcgacacgtgcgtgtccaagagcgagctctactccgacctgttcagcaagaacctggtcaccgagtacgacaagaagtacttcgagccggacaccgtgaacgaccagttcaacaagatcgagttcgcccaggacgcccaccggatgatcctgctcgagcgcatcctgtacaagaccgagtgcgagatgctgagcctcaagaagaactccggcccctacaacgtggcctggcggacccacctgaagaaccacaacatcgacctgtgcagccgccacaactacaagatgatctgccagtgcatcaacgcccactccatgtgcaagaacaccgacatcgactacaacaaggagatcgagacctactacaagagcaacgcggccgcctaccgcgccgggctcaacacgatcatggacaccctgaagaccgcgttccggggcctgaccaaggtcctcatcgagaactacatcgagaaggacgactccgacgccctgaaggccctgttcagcaacatcaccgactccgtgcaggacaactaccagatgatcgggatcctcaagttcgccagcaagctgctggacatcaacctcggccgctccacgcggagcgcccaccactccatcatgaccaacgagatccccaagagcaaccccttcaccgactactcctacagcaacgtgaacatcaaggagtgcatgtccccggagagcctgaagtgcttcaagaagcgcgactccacgccccacaccaaccacctcctgtgcaagatcgacaacaagtacaaggcgttcgactggcccgagatcgagaccatccagaaggggcagaagctgtgcctgggcgacagccactgcaacctcgagttcaccgccatcaccgccgaccggatcatgagcctgacgaactgctacaaggagtccttcaccgcccagcccgccgacatgcaggcgggcatcaagaagtgcagcgccgacgagatcggggagtgcaccaccctggaggacaagacgtggccgatcgtcttctgctccggcaagtactactacagcgactccaaggagcacgccaaggacgggagcatcaacaactactgcctcaccaacaagtgctccgagcagcgcttccccatccacgagaactggttcaagaagtgcaactgggacaagacccacaaggagttccggccctacgagaccaacaactacaacgacatcacgagctaccgcaaggccatcgagtccgagatcggcaccgacctgatgacccaccactacaagcccaccaagaacctgccgcacgtggtgccccggtaccacagcatcgacgtccaggggacggagtccaccgagggcatcatcaacggcttcatccagaacaccatccccgccatcagcgggctcgacgtgggctaccacctgaacttcaaggggaaccagctgttcgacatcgtgatcttcgtcaagaaggcggtgtacaaggcccagtaccagaaggcctacaccacgggcccctccatcagcatcaacatcgagcacaacgagcgctgcaccggccactgcccggagaagatccccgccaaggaggggtggctcaccttctccaaggagcacaccagctcctggggctgcgaggagtacgggtgcctggcgatcgacacgggctgcctgtacgggagctgccaggacgtgatccggcccgagctcgacgtctacaagaagatcggctccgaggccagcctgatcgagatctgcatcaccctgccgcacgagacctactgcaacgacatggacatcctcgagcccatcatcggcgacaagctgagcgcctccttccagaacacccagacgaaccagctgcccaccctcatcgcctacaagaaggggaagatctacaccggccagatcaacgacatcgggaacaccgccctgcagtgcggcagcatccaggtgatcaacgggtccacgatcggcaccggcagccccaagttcgactacatctgccacgcgatgcgccggaaggacgtgatcgtccgcaagtgcttcaacgacaactaccagtcctgcacccggctggagaagcgcaacgacctcatcccgtaccggaagggggacgtgatcgaggtgagcaagaccggctccaacatggggcagatgaccttcaagatcgagctgggcgacatcaactacaagatcttcaccaagagcgtcgacctgcagatgtccgggatctgcgccggctgcatcgactgcgccgagggcatcagctgctccatcaacgccgaggtgcccgccgagaccgtgtgccactgcaagaccaactgcgaggacttcatcaacaacatcgtcttcagcccccagatcaagaactacaacatcaaggtgcactgcaagtccaaggtggagaagatcaccgcgcacatctgcgggcgcgacatcgacctccagctgacggtcaagccctacaaccagaagatcgacctgagccagctcgacgagtccaactacatccgggaggaggacctgcagtgcggcacctggctgtgcaaggtgcagaaggaggggatcgacatcatgttcaagggcctcttcagcgggctgggccgctactggaccatcctgatctactccatcatcggcgtggtcatcatcgtgatcctcgtgtacatcctgctgccgatcgggcgcctcctgaaggccttcctgatccggcacgagatcgagtacgccatggagcagaagatcaagtga

SEQ ID NO: 12694 - RNA, 4263 nt, synthetic construct
  misc_feature 1..4263: note = derived and/or modified CDS sequence (opt1) from OROV(TRVL-9760)__KC759123.1__GP
  source 1..4263: mol_type = other RNA
atggccaacctgatcatcatcagcatggtgctctccatcgcctacggccaccccctgagcacctcccagatcggggaccgctgcttcgcgggcgggaacctgttcaaggagatgaacctcagcgtcggcctgggggagatctgcgtgaaggacgacatctccatcgtgaagtccaccacggtcttctccaagaacaagctggccctcgaggccaccaccaagttctaccggagcttcatcgtgaaggactggtccgagtgcaacccggtgctggacaagttcggcaacttcatggtcctgagcgtggacgacaacggccacatcatccccaagatgtacacgtgccgcgccgcctgcgacatccggctcaacaaggacaacgcggagatcatcctgtccagcaccaagctgaaccacttcgagatcgtggggaccacctccaccagcggctggttcaagaacacgatcaccaacaacctcgagcacacgtgcgagcacgtcaccgtgaactgcgggcagaagtccgtgaagttccacgcctgcttccgccagcaccggggctgcatccgcttcttcaaggggacctacatgccctacagcatgatcgaggccatgtgcgtcaacatcgagctgatcatcctgaccctctacatcttcgccgcgatcatcttcgccctgatcatcaccaagtcctacgtggcctacctgctcctgcccctgttctacccggccacctggttctacggcaaggtgtacaagaagatcaacagctgccccaactgcctcctggcctcccaccccttcacgagctgccccaagatctgcatctgcggcagccggttctcctgcaccgaggcgctgaaggtccaccgcatggggaaggactgcctcggctacaagagcctgtccaaggcccggcagatgtgcaagagcaagtcctggagcttcaccgccgccatcctgaccgggctcatcctgatggagttcatctccccgatcgccggcgagcgcatgtacaagctggaggagctcgcggccgagttcatcaagctgacggagcaggtcaacatcctggagcgggagatggaggtgctcaagcagagcatcatcgtgatgttcgccatcatcctggtgctgctcctgttcgagaacatgatcttcaaccgcctgttccggatcttctaccgctcctgcagcatgtgcggcctcatccactaccggcccgggctgaagatcgacctgaccaagaccaaccgctgcggctcctgcatctgcgggttcgacgagcagcagagctccggcttcgagtacgagatcttcctcaaggacatgcacgtgcagaaggagagctgcaagttcagcccccgggtcaaccacttccgcaacaccaaggccctgctgttcgccctcgtgatctgcgcgacgatctacaccgtgtacgccgacgaggactgcctgagcaaggacatcaagatcacctaccaggagctgcacaactgcatcgggcccaagatcatgggcgacacgtgcgtctccaagagcgagctctactccgacctgttcagcaagaacctggtgaccgagtacgacaagaagtacttcgagccggacaccgtcaacgaccagttcaacaagatcgagttcgcccaggacgcccaccggatgatcctgctcgagcgcatcctgtacaagaccgagtgcgagatgctgagcctcaagaagaactccggcccctacaacgtggcctggcggacctacctgaagaaccacaacatcgacctgtgcagccgccacaactacaagatgatctgccagtgcatcaacgcgcactccatgtgcaagaacacggacatcgactacaacaaggagatcgagacctactacaagagcaacgccgccgcctaccgcgcggacctcaacaccatcatggacaccctgaagacggccttccgggggctgaccaaggtgctcatcgagaactacatcgagaaggacgactccgacgccctgaaggccctgttcagcaacatcaccgactccgtccaggacaactaccagatgatcggcatcctcaagttcgccagcaagctgctggacatcaacctcgggcgctccacccggagcgcgcaccactccatcatgaccaacgagatccccaagagcaaccccttcacggactactcctacagcaacgtgaacatcaaggagtgcatgtccccggagagcctgaagtgcttcaagaagcgcgactccacgccccacaccaaccacctcctgtgcaagatcgacaacaagtacaaggccttcgactggcccgagatcgagaccatccagaagggccagaagctgtgcctgggggacagccactgcaacctcgagttcaccgccatcaccgccgaccggatcatgagcctgaccaactgctacaaggagtccttcaccgcccagcccgcggacatgcaggccggcatcaagaagtgcagcgccgacgagatcggcgagtgcacgaccctggaggacaagacctggccgatcgtgttctgctccgggaagtactactacagcgactccaaggagcacgccaaggacggcagcatcaacaactactgcctcaccaacaagtgctccgagcagcgcttccccatccacgagaactggttcaagaagtgcaactgggacaagacgcacaaggagttcagcaccatgcggcagatcaactacaacgacatcacctcctaccgcaaggccatcgagagcgagatcgggaccgacctgatgacgcaccactacaagcccaccaagaacctgccccacgtcgtgccgcggtaccactccatcgacgtgcagggcaccgagagcaccgaggggatcatcaacggcttcatccagaacacgatccccgcgatctccggcctcggggtcggctaccacctgaacttcaaggggaaccagctgttcgacatcgtgatcttcgtgaagaaggccgtctacaaggcccagtaccagaaggcctacaccaccggccccagcatctccatcaacatcgagcacaacgagcgctgcaccggccactgccccgagaagatcccggcgaaggaggggtggctcacgttcagcaaggagcacacctccagctggggctgcgaggagtacgggtgcctggccatcgacaccggctgcctgtacgggtcctgccaggacgtgatccggcccgagctcgacgtgtacaagaagatcggcagcgaggccagcctgatcgagatctgcatcaccctgccccacgagacgtactgcaacgacatggacatcctcgagccgatcatcggcgacaagctgtccgccagcttccagaacacccagaccaaccagctgcccaccctcatcgcctacaagaaggggaagatctacacgggccagatcaacgacatcgggaacaccgcgctgcagtgcggctccatccaggtcatcaacgggagcaccatcggcaccggctcccccaagttcgactacatctgccacgccatgcgccggaaggacgtgatcgtgcgcaagtgcttcaacgacaactaccagagctgcacgcggctggagaagcgcaacgacctcatcccctaccggaagggggacgtcatcgaggtgtccaagaccggcagcaacatggggcagatgaccttcaagatcgagctgggcgacatcaactacaagatcttcaccaagtccgtggacctgcagatgagcgggatctgcgccggctgcatcgactgcgccgagggcatctcctgcagcatcaacgccgaggtcccggcggagaccgtgtgccactgcaagacgaactgcgaggacttcatcaacaacatcgtgttcagcccccagatcaagaactacaacatcaaggtccactgcaagtccaaggtggagaagatcaccgcccacatctgcgggcgcgacatcgacctccagctgaccgtgaagccctacaaccagaagatcgacctgtcccagctcgacgagagcaactacatccgggaggaggacctgcagtgcggcacctggctgtgcaaggtccagaaggaggggatcgacatcatgttcaagggcctcttctccgggctgggccgctactggacgatcctgatctacagcatcatcggcgtggtgatcatcgtcatcctcgtgtacatcctgctgcccatcgggcgcctcctgaaggccttcctgatccggcacgagatcgagtacgccatggagcagaagatcaagtga

SEQ ID NO: 12695 - RNA, 4263 nt, synthetic construct
  misc_feature 1..4263: note = derived and/or modified CDS sequence (opt1) from OROV(TVP-19244/DEI-216)__KP795073.1__GP
  source 1..4263: mol_type = other RNA
atggccaacctgatcatcatcagcatgatcctcggcatcgcctacgggcaccccctgtccaccagccagatcggcgaccgctgcttcgccgggggcatcctgttcaaggagatgaacctctccgtggggctgggcgagatctgcgtcaaggacgacatcagcatcgtgaagtccaccacggccttcagcaagaacgccctggccctcgaggccaccaccaagttctaccggtccttcatcgtgaaggactggagcgagtgcaacccggtcctggacaagttcggcaacttcatggtgctgaacgtggacgacaacgggcacctcgtccccaagatgtacacgtgccgcgcggcctgcgacatccggctgaacaaggacaacgccgagatcatcctgtccagcaccaagctcaaccacttcgagatcgtgggcaccacctccaccagcgggtggttcaagaacacgatcaccaacaacctggagcacacgtgcgagcacgtgaccgtcaactgcggccagaagtccgtgaagttccacgcctgcttccgccagcaccgggggtgcatccgcttcttcaagggcacctacatgccctacagcatgatcgaggcgatgtgcgtgaacatcgagctgatcatcctcaccctgtacatcttcgccgccatcatcttcgccctgatcatcaccaagtcctacatcgcctacctcctgctgcccctcttctacccggtcacctggctgtacggcaaggtgtacaagcggatcaacagctgccccaactgcctgctcgcgtcccaccccttcacgagctgccccaagatctgcatctgcgggtcccgcttcagctgcaccgaggccctgaaggtgcaccggatgggcaaggactgcctggggtacaagagcctctccaaggcccgccagatgtgcaagagcaagtcctggagcttcaccgccgccatcctgaccggcctgatcctcatggagttcgtctccccgatcgcgggcgagcggatgtacaagctggaggagctggccgacgactacatcgagctcacggagcaggtcaacatcctggggaaggagatcaagatcctgaagcagagcatcatcgtgatgctcgccatcatcctgatcctgctcctgtccgagaacatcatcttcaactacctgttcagcaccctctaccgctcctgcagcatgtgcggcctgatccactaccggcccgggctgaaggtggactccaccaagaccaacaagtgcggcagctgcatctgcgggttcgacgagcagcagtccagcggcttcgagtacgaggtgttcctcaaggacatgcacgtgcagcgcgagtcctgcaagttcggcccccgggtcaaccacttccgcaacacgaagatcctgctgttcaccgtggccatctgcaccagcttctacaccgtgtacgccgacgaggactgcctctccaagaacatccggatcacgtaccaggagctgcacaactgcatcgggccccacatcatgggcgacacgtgcatgagcaagtccgagctgtacagcgacctgctcagcaagaacctgatcaccgagtacgacaagaagtacttcgagccggacaccgtcaacgaccagttcaacaagatcgagttcgcgcaggacgcccaccgcatgatcctgctcgagcggatcctgtacaagaccgagtgcgagatgctgtccctcaagaagaacagcgggccctacaacgtggcctggcgcacctacctgaagaaccacaacatcgacctgtgctcccggcacaactacaagatgatctgccagtgcatcaacacccacagcatgtgcaagaacaccgacatcgacttcaacaaggagatcgagacgtactacaaggccaacgccgcggcctaccgctccgacttcaacaccatcatcgacaccctcaagaccgccttccgcggcctgaccaaggtcctgatcgagaactacatcgagaaggacgacagcgacgccctcaaggcgctgttctccaacatcacggacagcgtgcaggacaactaccagatggtgggggtcctgaagttcgcctccaagctcctgaacatcagcctgggccggaccacccgctccgcccagcacagcatcatgaccaacgagatccccaagtccaaccccttcacggactacagctactccagcgtgaacatcaaggagtgcatgtccccggagagcctcaagtgcttcaagaagcgggacagcgcgccccacatgaaccacctcctgtgcaagatggacaacaagtacaaggccttcgactggcccgagatcgagaccgtgcagaagggccagaagctgtgcctgggggactcccactgcaacctggagttcaccgcgatcaccgccgacaagatcatgagcctcacgaactgctacaaggagtccttcaccgcccagcccgccgacatgcagaccggcatcaagaagtgcagcgccgacgagatcggggagtgcatcaccctggaggacaagtcctggccgatcgtcttctgcggcgacaagtactactacagcgacgggaaggagcacgcgaaggacggctccatcaacaactactgcctggccaacaagtgcagcgagcagcgcttccccatccacaagaactggttcaagaagtgcaactgggacaagacgcacaaggagttcaccaccatgcggcagatcaactacaacgacatcacctcctaccgcaaggccatcgagagcgagatcggcacggacctcatgacccaccactacaagcccaccaagaacctgccccacgtggtgccgcggtaccactccatcgacgtccaggggaccgagagcacggagggcatcatcaacgggttcatccagaacaccatccccgccatctccggcctgggcgtggggtaccacctcggcttcaaggggaaccagctgttcgacatcgtgatcttcgtcaagaaggccgtgtacaaggcgcagtaccagaaggtgtacaccaccggccccagcatctccatcaacatcgagcacaacgagaagtgcacggggcactgccccgagaagatcccggccaaggagggctggctgaccttcagcaaggagcacacctccagctggggctgcgaggagtacgggtgcctcgccatcgacaccggctgcctgtacgggtcctgccaggacgtcatccgccccgagctggacatctacaagaagatcggcagcgaggccagcctcatcgagatctgcatcacgctgccccacgagacctactgcaacgacatggacatcctggagccgatcatcggggacaagctctccgcgagcttccagaacacccagaccaaccagctgcccaacctgatggcctacaagaagggcaaggtgtacacgggccagatcaacgacgtggggaacaccgccctccagtgcggctccatccaggtcgtgaacgggagcaccatcggctccgggaaccccaagttcgactacatctgccacgccatgcggcgcaaggacgtgatcgtccggaagtgcttcaacgacaactaccagagctgcacccgcctgaacccccggaacgacctgatcccgtaccgcaagggcgacatcatcgagatctccaagacgggcagcaacatggggcagatgaccttcaagatcgagctcggcgacatcaactacaagatcttcaccaagtccgtggacctgcagatgagcgggatctgcgccggctgcatcgactgcgcggaggggatctcctgcagcatcaacgccgacgtgtccgccgagaccgtctgccactgcaagaccaactgcgaggacttcatcagcaacatcgtgatcagcccccagatcaagacgtacaacatcaaggtgcactgcaagtccaaggtcaagaagatcaccgccaacatctgcggccggaacatcgacctgcagctcaccgtgaagccctacaaccagaagatcgacctgtcccagctggacgagagcaactacatcaaggaggaggacctccagtgcggcacctggctgtgcaaggtgcagaaggaggggatcgacatcgtcttcaagggcctgttctccgggctcggcaagtactgggccatcctgatctacagcatcatcggcatcatcgtggtgatcctgctcatctacgtcctgctgcccatcgggcgcctcctgaaggcgttcctgatcaagaacgagatcgagtacacgatggagcagaagatcaagtga

SEQ ID NO: 12696 - RNA, 4263 nt, synthetic construct
  misc_feature 1..4263: note = derived and/or modified CDS sequence (opt1) from OROV(TVP-19249/GML-444672)__KP795076.1__GP
  source 1..4263: mol_type = other RNA
atggccaacctgatcatcttcagcatcatcctcggcatcgcctacgggcaccccctgtccaccagccagatcggcgaccgctgcttcgccgggggctccctgttcaaggagatgaacctcagcgtggggctgggcgagatctgcgtcaaggacgacatctccatcgtcaagagcaccacggcgttctccaagaacaccctggccctcgaggccaccaccaagttctaccggagcttcatcgtgaaggactggtccgagtgcaacccggtgctggacaagctgggcaacttcatggtgctcaacgtggacgacaacgggcacctggtcccccgcatgtacacgtgccgggccgcgtgcgacatccgcctgaacaaggacaacgccgagatcatcctcagctccaccaagctgaaccacttcgagatcgtgggcaccaccagcacgtccgggtggttcaagaacaccatcaccaacaacctggagcacacgtgcgagcacgtgaccgtcaactgcggccagaagtccgtgaagttccacgcctgcttccggcagcaccgcgggtgcatccggttcttcaagggcacctacatgccctactccatgatcgaggccatgtgcatcaacatcgagctcatcatcctgaccctgtacatcttcgcggccatcatcttcgccctcatcatcaccaagagctacatcgcctacctgctgctccccctgttctacccggtgacgtggctgtacggcaaggtctacaagcgcatcaactcctgcagcaactgcctcctggcctcccaccccttcaccagctgccccaagatctgcatctgcgggagccggttctcctgcaccgaggcgctgaaggtgcaccgcatgggcaaggactgcctcgggtacaagagcctgtccaaggcccggcagatgtgcaagagcaagtcctggagcttcaccgccgccatcctgacgggcctcatcctgatggagttcgtgtcccccatcgccggcgagcgcatgtacaagctggaggagctcgcggacgactacatcgagatggccgagcgggtcgggatgctggagaaggagatcaaggtgctgaagcagttcaccatcgtgatgctcgtcatcatcctgatcctgctcctgttcgagaacaccatcttcaactacctgttcaacaccctctaccgcagctgctccatgtgcggcctgatccactaccggccggggctgaaggtggacctcacgaagaccaacaagtgcggcagctgcatctgcgggttcgacgagcagcagtccagcggcttcgagtacgaggtgttcctgaaggacatgcacatccagcgcgagtcctgcaagttcggcccccgggtcaaccacttccgcaacaccaagatcctgctgttcaccatcgccatctgcacgagcttctacaccgtgtacgccgacgaggactgcctgtccaagaacatcaagatcacctaccaggagctgcacaactgcatcgggccctacatcatgggcgacacgtgcgtgagcaagtccgagctgtacagcgacctcctgtccaagaacctgatcaccgagtacgacaagaagtacttcgagcccgacaccgtcaacgaccagttcaacaagatcgagttcgcccaggacgcgcaccggatgatcctcctggagcgcatcctgtacaagaccgagtgcgagatgctcagcctgaagaagaacagcgggccgtacaacgtggcctggcggacctacctgaagaaccacaacatcgacctctgctcccgccacaactacaagatgatctgccagtgcatcaacatgcacagcatgtgcaagaacacggacatcgacttcaacaacgagatcgagacctactacaaggccaacgccgccgcgtaccgctccgacttctacaccatcatcgacaccctgaagaccgccttccggggcctgacgaaggtcctcatcgagaactacatcgagaaggacgacagcgacgccctgaaggccctgttctccaacatcaccaacagcgtgcaggacaactaccagatggtgggggtcctcaagttcgcgtccaagctgctgaacatcagcctcggccgctccacccggagcgcccagcactccatcatgaccaacgagatccccaagagcaaccccttcacggactactcctacagctccgtgaacatcaaggagtgcatgagccccgagtccctgaagtgcttcaagaagcgcgacagcgtgccgcacaccaaccacctcctctgcaagatggacaacaagtacaaggccttcgactggcccgagatcgagaccgtccagaagggccagaagctgtgcctgggggacagccactgcaacctcgagttcaccgccatcacggccgacaagatcatgtccctgaccaactgctacaaggagagcttcaccgcgcagcccgccgacatgcagaccggcatcaagaagtgctccgccgacgagatcggggagtgcatcacgctggaggacaaggcctggcccatcgtggtgtgcggcgacaagtactactacagcgacgggaaggagcacgccaaggacggctccatcaacaactactgcctcgcgaacaagtgcagcgagcagcggttcccgatccacaagaactggttcaagaagtgcaactgggacaagacccacaaggagttcaccaccatgcgccagatcaactacaacgacatcacgtcctaccggaaggccatcgagagcgagatcggcaccgacctgatgacccaccactacaagcccaccaagaacctgccccacgtcgtgccccgctaccactccatcgacgtgcaggggacggagagcaccgagggcatcatcaacgggttcatccagaacaccatcccggccatctccggcctcggcgtcgggtaccacctgggcttccgggggaaccagctgttcgacatcgtgatcttcgtgaagaaggccgtctacaaggcccagtaccagaaggtgtacaccacgggccccagcatctccatcaacatcgagcacaacgagaagtgcaccgggcactgccccgagaagatccccgcgaaggagggctggctcaccttcagcaaggagcacacctccagctggggctgcgaggagtacgggtgcctggccatcgacacgggctgcctgtacgggtcctgccaggacgtgatccgcccggagctcgacatctacaagaagatcggcagcgaggcctccctgatcgagatctgcatcaccctgccccacgagacctactgcaacgacatggacatcctcgagcccatcatcggggacaagctgagcgccagcttccagaacacccagacgaaccagctgccggtcctcatggcgtacaagaagggcaaggtgtacaccggccagatcaacgacgtggggaacaccgccctgcagtgcggctccatccaggtcgtgaacgggagcaccatcggctccgggaaccccaagttcgactacatctgccacgccatgcggcgcaaggacgtgatcgtccggaagtgcttcaacgacaactaccagagctgcacgcgcctggacgcccggaacgacctcatcccctaccgcaagggcgacatcatcgagatctccaagaccggcagcaacatggggcagatgaccttcaagatcgagctgggcgacatcaactacaagatcttcaccaagtccgtggacctgcagatgagcgggatctgcgccggctgcatcgactgcgcggaggggatctcctgcagcatcaacgccgacgtgtccgccgagaccgtctgccactgcaagacgaactgcgaggacttcatcagcaacatcgtgatcagcccccagatcaagacctacaacatcaaggtgcactgcaagagcaaggtcgagaagatcaccgccaacatctgcggccggaacatcgacctccagctgaccgtgaagccgtacaaccagaagatcgacctgtcccagctcgacgagagcaactacatcaaggaggaggacctgcagtgcggcacgtggctgtgcaaggtgcagaaggaggggatcgacatcgtcttcaagggcctcttctccgggctgggcaagtactggaccatcctgatctacagcatcatcggcatcatcgtgatcgtgctcctgatctacgtcctgctccccatcgggcgcctgctgaaggccttcctcatcaagaacgagatcgagtacaccatggagcagaagatcaagtga

SEQ ID NO: 12697 - RNA, 4263 nt, synthetic construct
  misc_feature 1..4263: note = derived and/or modified CDS sequence (opt1) from OROV(TVP-19254/GML-480914)__KP795082.1__GP
  source 1..4263: mol_type = other RNA
atggccaacctgatcatcatcagcatggtgctctccgtcgcctacggccaccccctgagcacctcccagatcggggaccgctgcttcgcgggcgggaacctgttcaaggagatgaacctcagcgtgggcctgggggagatctgcgtgaaggacgacatctccatcgtcaagagcaccacggccttctccaagaacaagccggccctggaggccaccaccaagttctaccggagcttcatcgtgaaggactggtccgagtgcaaccccgtgctcgacaagttcggcaacttcatggtcctgagcgtggacgacaacggccacatcatccccaagatgtacacgtgccgcgccgcgtgcgacatccggctgaacaaggacaacgccgagatcatcctctccagcaccaagctgaaccacttcgagatcgtggggaccacctccaccagcggctggttcaagaacacgatcaccaacaacctggagcacacgtgcgagcacgtcaccgtgaactgcgggcagaagtccgtgaagttccacgcctgcttccgccagcaccggggctgcatccgcttcttcaaggggacctacatgccctacagcatgatcgaggccatgtgcgtcaacatcgagctcatcatcctgaccctgtacatcttcgcggccatcatcttcgccctcatcatcaccaagtcctacgtggcctacctgctgctcccgctgttctaccccgtgacctggttctacggcaaggtctacaagaagatcaacagctgccccaactgcctgctcgcctcccaccccttcacgagctgcccgaagatctgcatctgcggcagccggttctcctgcaccgaggcgctgaaggtgcaccgcatggggaaggactgcctgggctacaagagcctctccaaggcccggcagatgtgcaagagcaagtcctggagcttcaccgccgccatcctgaccgggctgatcctcatggagttcatctcccccatcgccggcgagcgcatgtacaagctggaggagctggcggacgagttcatcaagctcacggagcaggtcaacatcctggagcgggagatggaggtgctgaagcagagcgtgatcgtgatgctcgccatcatcctggtcctgctcctgttcgagaacatgatcttcaaccgcctgttccggatcttctaccgctcctgcagcatgtgcggcctcatccactaccggcccgggctgaagatcgacctgaccaagaccaaccgctgcggctcctgcatctgcgggttcgacgagcagcagagctccggcttcgagtacgagatcttcctcaaggacatgcacatccagaaggagagctgcaagttcagcccccgggtgaaccacttccgcaacatcaaggccctgctgttcgccctcgtgatctgcgccaccatctacacggtctacgcggacgaggactgcctgtccaagaacatcaagatcacctaccaggagctgcacaactgcatcgggccgaagatcatgggcgacacgtgcgtgtccaagagcgagctctactccgacctgttcagcaagaacctggtcaccgagtacgacaagaagtacttcgagcccgacaccatcaacgaccagttcaacaagatcgagttcgcccaggacgcccaccggatgatcctgctcgagcgcatcctgtacaagaccgagtgcgagatgctgagcctcaagaagaactccggcccctacaacgtggcctggcggacctacctgaagaaccacaacatcgacctgtgcagccgccacaactacaagatgatctgccagtgcatcaacacccactccatgtgcaagaacacggacatcgactacaacaaggagatcgagacctactacaagagcaacgccgcggcctaccgcgccgacctcaacaccatcatcgacaccctgaagacggccttccgggggctgaccaaggtgctcatcgagaactacatcgagaaggacgactccgacgcgctgaaggccctgttcagcaacatcaccgactccgtccaggacaactaccagatgatcggcatcctcaagttcgccagcaagctgctggacatcaacctcgggcgctccacccggagcgcccaccactccatcatgaccaacgagatccccaagagcaacccgttcacggactactcctacagcaacgtgaacatcaaggagtgcatgtcccccgagagcctgaagtgcttcaagaagcgcgactccacgccccacaccaaccacctcctctgcaagatcgacaacaagtacaaggccttcgactggcccgagatcgagaccatccagaagggccagaagctgtgcctgggggacagccactgcaacctcgagttcaccgcgatcaccgccgacaagatcatgagcctgaccaactgctacaaggagtccttcaccgcccagccggccgacatgcaggccggcatcaagaagtgcagcgcggacgagatcggcgagtgcacgaccctggaggacaagacctggcccatcgtgttctgcgggggcaagtactactactccgacagcaaggagcacgccaaggacgggtccatcaacaactactgcctcaccaacaagtgcagcgagcagcggttccccatccacgagaactggttcaagaagtgcaactgggacaagacgcacaaggagttctccaccatgaagcagatcaactacaacgacatcaccagctaccgcaaggccatcgagtccgagatcggcaccgacctgatgacgcaccactacaagcccaccaagaacctgccgcacgtcgtgccccggtaccacagcatcgacgtgcaggggaccgagtccaccgagggcctcatcaacggcttcatccagaacacgatccccgccatcagcgggctgggcgtcgggtaccacctgaacttcaagggcaaccagctgttcgacatcgtgatcttcgtgaagaaggccgtctacaaggcgcagtaccagaaggcctacaccaccggcccctccatcagcatcaacatcgagcacaacgagcgctgcaccgggcactgcccggagaagatccccgccaaggagggctggctgacgttctccaaggagcacaccagctcctgggggtgcgaggagtacggctgcctggccatcgacaccgggtgcctctacggcagctgccaggacgtgatccggcccgagctggacgtgtacaagaagatcggctccgaggtcagcctgatcgagatctgcatcaccctcccgcacgagacgtactgcaacgacatggacatcctggagcccatcatcggggacaagctgagcgcgtccttccagaacacccagaccaaccagctccccaccctgatcgcctacaagaagggcaagatctacacggggcagatcaacgacatcggcaacaccgccctgcagtgcgggagcatccaggtgatcaacggctccaccatcggcaccgggagccccaagttcgactacatctgccacgccatgcgccggaaggacgtgatcgtccgcaagtgcttcaacgacaactaccagtcctgcacgcggctcgagaagcgcaacgacctgatcccgtaccggaagggcgacgtgatcgaggtgagcaagaccgggtccaacatgggccagatgaccttcaagatcgagctgggggacatcaactacaagatcttcaccaagagcatcgacctccagatgtccggcatctgcgccggctgcatcgactgcgcggaggggatcagctgctccatcaacgccgaggtcagcgccgagaccgtgtgccactgcaagacgaactgcgaggacttcatcaacaacatcgtgttcagcccccagatcaagaactacaacatcaaggtccactgcaagtccaaggtggagaagatcatcgcccacatctgcggcaaggacatcgacctgcagctgaccgtgaagccctacaaccagaagatcgacctctcccagctggacgagagcaactacatccgcgaggaggacctgcagtgcgggacctggctctgcaaggtccagaaggagggcatcgacatcatcttcaaggggctgttctccggcctgggccggtactggaccatcctcatctacagcatcatcggggtggtgatcatcgtcatcctggtgtacatcctgctccccatcggccgcctgctgaaggccttcctcatccggcacgagatcgagtacgcgatggagcagaagatcaagtga

SEQ ID NO: 12698 - RNA, 4263 nt, synthetic construct
  misc_feature 1..4263: note = derived and/or modified CDS sequence (opt1) from OROV(TVP-19256/IQE-7894)__KP795085.1__GP
  source 1..4263: mol_type = other RNA
atggccaacctgatcatcatcagcatgatcctcggcatcgcctacgggcaccccctgtccaccagccagatcggcgaccgctgcttcgccgggggctccctgttcaaggagatgaacctcagcgtggggctgggcgagatctgcgtcaaggacgacatctccatcgtcaagagcaccacggcgttctccaagaacgccctggccctcgaggccaccaccaagttctaccggagcttcatcgtgaaggactggtccgagtgcaacccggtgctggacaagttcggcaacttcatggtgctgaacgtggacgacaacgggcacctcgtccccaagatgtacacgtgccgcgcggcctgcgacatccggctgaacaaggacaacgccgaggtgatcctgagctccaccaagctcaaccacttcgagatcgtgggcaccaccagcacctccgggtggttcaagaacacgatcaccaacaacctggagcacacgtgcgagcacgtcaccgtgaactgcggccagaagtccgtgaagttccacgcctgcttccgccagcaccgggggtgcatccgcttcttcaagggcgcgtacatgccctacagcatgatcgaggccatgtgcgtcaacatcgagctgatcatcctcaccctgtacatcttcgccgccatcatcttcgccctgatcatcaccaagagctacatcgcgtacctcctgctgcccctcttctacccggtgacctggctgtacggcaaggtgtacaagcggatcaactcctgccccaactgcctgctcgccagccaccccttcacctcctgccccaagatctgcatctgcgggagccgcttcagctgcacggaggccctgaaggtccaccggatgggcaaggactgcctggggtacaagtccctcagcaaggcccgccagatgtgcaagtccaagagctggtccttcaccgccgcgatcctgaccggcctgatcctcatggagttcgtgagcccgatcgccggcgagcggatgtacaagctggaggagctggccgacgactacatcgagctcgccgagcaggtcaacatcctggggaaggagatcaagatcctgaagcagtccatcatcgtgatgctcgccatcatcctgatcctgctcctgagcgagaacatcatcttcaactacctgttcaagaccctctaccgctcctgcagcatgtgcggcctgatccactaccggcccgggctgaaggtggacctcacgaagaccaacaagtgcggctcctgcatctgcgggttcgacgagcagcagagctccggcttcgagtacgaggtgttcctgaaggacatgcacgtccagcgcgagagctgcaagttcggcccccgggtgaaccacttccgcaacaccaagatcctcctcttcaccatcgcgatctgcacgtccttctacaccgtgtacgccgacgaggactgcctgagcaagaacatccggatcacctaccaggagctgcacaactgcatcgggccccacatcatgggcgacacgtgcatgtccaagagcgagctgtactccgacctcctgagcaagaacctgatcaccgagtacgacaagaagtacttcgagccggacaccgtcaacgaccagttcaacaagatcgagttcgcccaggacgcccaccgcatgatcctcctggagcggatcctgtacaagaccgagtgcgagatgctcagcctgaagaagaactccgggccctacaacgtggcctggcgcacctacctgaagaaccacaacatcgacctctgcagccggcacaactacaagatgatctgccagtgcatcaacacgcactccatgtgcaagaacaccgacatcgacttcaacaaggagatcgagacctactacaaggcgaacgccgccgcctaccgcagcgacttcaacaccatcatcgacacgctgaagaccgcgttccgcggcctgaccaaggtcctcatcgagaactacatcgagaaggacgactccgacgccctgaaggccctgttcagcaacatcaccgactccgtgcaggacaactaccagatggtgggggtcctcaagttcgccagcaagctgctgaacatctccctcggccggaccacgcgcagcgcccagcactccatcatgaccaacgagatccccaagagcaaccccttcaccgactactcctacagctccgtgaacatcaaggagtgcatgagcccggagtccctgaagtgcttcaagaagcgggacagcgtgccccacaccaaccacctcctgtgcaagatggacaacaagtacaaggtcttcgactggcccgagatcgagacggtgcagaagggccagaagctgtgcctgggggacagccactgcaacctcgagttcaccgcgatcaccgccgacaagatcatgtccctgaccaactgctacaaggagagcttcacggcccagcccgccgacatgcagaccggcatcaagaagtgctccgccgacgagatcggggagtgcatcaccctggaggacaagagctggccgatcgtgttctgcggcgacaagtactactactccgaggggaaggagcacgcgaaggacggcagcatcaacaactactgcctcgccaacaagtgctccgagcagcgcttccccatccacaagaactggctgaagaagtgcaactgggacaagacccacaaggagttcacgaccatgcggcgcatcaactacaacgacatcaccagctaccggaaggccatcgagtccgagatcggcaccgacctgatgacgcaccactacaagcccaccaagaacctcccccacgtcgtgccgcgctaccacagcatcgacgtgcaggggaccgagtccaccgagggcatcatcaacgggttcatccagaacacgatccccgccatcagcggcctgggcgtcgggtaccacctgggcttcaaggggaaccagctgttcgacatcgtgatcttcgtgaagaaggccgtctacaaggcgcagtaccagaaggtgtacaccaccggcccctccatcagcatcaacatcgagcacaacgagaagtgcaccgggcactgccccgagaagatcccggccaaggagggctggctgacgttctccaaggagcacaccagctcctggggctgcgaggagtacgggtgcctggccatcgacaccggctgcctctacgggagctgccaggacgtgatccggcccgagctggacatctacaagaagatcggctccgaggccagcctgatcgagatctgcatcaccctcccccacgagacgtactgcaacgacatggacatcctggagccgatcatcggggacaagctgagcgcgtccttccagaacacccagaccaaccagctccccaacctgatggcctacaagaagggcaaggtctacaccggccagatcaacgacgtggggaacacggccctgcagtgcggcagcatccaggtggtcaacgggtccaccatcggcagcgggaaccccaagttcgactacatctgccacgccatgcgccggaaggacgtgatcgtgcgcaagtgcttcaacgacaactaccagtcctgcacccggctcgacccccgcaacgacctgatcccgtaccggaagggcgacatcgtcgagatcagcaagaccggctccaacatggggcagatgacgttcaagatcgagctgggcgacatcaactacaagatcttcaccaagagcgtggacctccagatgtccgggatctgcgccggctgcatcgactgcgcggaggggatcagctgctccatcaacgccgacgccagcgccgagaccgtgtgccactgcaagaccaactgcgaggacttcatctccaacatcgtcatcagcccccagatcaagacctacaacatcaaggtgcactgcaagtccaaggtggagaagatcacggccaacatctgcggccgcaacatcgacctgcagctgaccgtcaagccctacaaccagaagatcgacctcagccagctggacgagtccaactacatcaaggaggaggacctgcagtgcggcacctggctctgcaaggtgcagaaggaggggatcgacatcgtgttcaagggcctgttcagcgggctgggcaagtactgggcgatcctcatctactccatcatcggcgtcatcgtggtgatcctgctgatctacgtcctcctgcccatcgggcggctgctcaaggccttcctgatcaagaacgagatcgagtacaccatggagcagaagatcaagtga

SEQ ID NO: 12699 - RNA, 4263 nt, synthetic construct
  misc_feature 1..4263: note = derived and/or modified CDS sequence (opt1) from OROV(TVP-19257/IQT-1690)__KP795088.1__GP
  source 1..4263: mol_type = other RNA
atggccaacctgatcatcatccccatgatcctcggcatcgcctacgggcacccgctgagcacctcccagatcggcgaccgctgcttcgccgggggcagcctgttcaaggagatgaacctctccgtggggctgggcgagatctgcgtcaaggacgacatcagcatcgtgaagtccaccacggccttcagcaagaacgccctggccctcgaggccaccaccaagttctaccggtccttcatcgtgaaggactggagcgagtgcaaccccgtcctggacaagttcggcaacttcatggtgctgaacgtggacgacaacgggcacctcgtccccaagatgtacacgtgccgcgcggcctgcgacatccggctgaacaaggacaacgccgagatcatcctgtccagcaccaagctcaaccacttcgagatcgtgggcaccacctccaccagcgggtggttcaagaacacgatcaccaacaacctggagcacacgtgcgagcacgtgaccgtcaactgcggccagcgctccgtgaagttccacgcctgcttccggcagcaccgcgggtgcatccggttcttcaagggcacctacatgccctacagcatgatcgaggcgatgtgcgtgaacatcgagctgatcatcctcaccctgtacatcttcgccgccatcatcttcgccctgatcatcaccaagtcctacatcgcctacctcctgctgcccctcttctaccccgtcacctggctgtacggcaaggtgtacaagcgcatcaacagctgccccaactgcctgctcgcgtcccaccccttcacgagctgcccgaagatctgcatctgcgggtcccggttcagctgcaccgaggccctgaaggtgcaccgcatgggcaaggactgcctggggtacaagagcctctccaaggcccggcagatgtgcaagagcaagtcctggagcttcaccgccgccatcctgaccggcctgatcctcatggagttcgtctcccccatcgcgggcgagcgcatgtacaagctggaggagctggccgacgactacatcgagctcgccgagcaggtcaacatcctggggaaggagatcaagatcctgaagcagagcatcatcgtgatgctcgccatcatcctgatcctgctcctgtccgagaacatcatcttcaactacctgttcaacacgctctaccggagctgctccatgtgcggcctgatccactaccgccccgggctgaaggtggacctcaccaagaccaacaagtgcggcagctgcatctgcgggttcgacgagcagcagtccagcggcttcgagtacgaggtgttcctgaaggacatgcacgtgcagcgggagtcctgcaagttcggcccccgcgtcaaccacttccggaacaccaagatcctgctgttcatcatcgccatctgcacgagcttctacaccgtgtacgcggacgaggactgcctgtccaagaacatccgcatcacctaccaggagctgcacaactgcatcgggccgcacatcatgggcgacacgtgcatgagcaagtccgagctgtacagcgacctcctgtccaagaacctgatcaccgagtacgacaagaagtacttcgagcccgacaccgtgaacgaccagttcaacaagatcgagttcgcccaggacgcccaccggatgatcctcctggagcgcatcctgtacaagaccgagtgcgagatgctcagcctgaagaagaacagcgggccctacaacgtcgcctggcggacctacctgaagaaccacaacatcgacctctgctcccgccacaactacaagatgatctgccagtgcatcaacacgcacagcatgtgcaagaacaccgacatcgacttcaacaaggagatcgagacctactacaaggccaacgcggccgcctaccgctccgacttcaacaccatcatcgacacgctgaagaccgccttccggggcctgaccaaggtgctcatcgagaactacatcgagaaggacgacagcgacgcgctgaaggccctgttctccaacatcaccgacagcgtccaggacaactaccagatggtgggggtgctcaagttcgcctccaagctgctgaacatcagcctcggccgcaccacgcggtccgcccagcacagcatcatgaccaacgagatccccaagtccaacccgttcaccgactacagctactccagcgtcaacatcaaggagtgcatgtcccccgagagcctgaagtgcttcaagaagcgcgactccgcgccccacaccaaccacctcctctgcaagatggacaacaagtacaaggcgttcgactggcccgagatcgagacggtgcagaagggccagaagctgtgcctgggggacagccactgcaacctcgagttcaccgccatcaccgccgacaagatcatgagcctgaccaactgctacaaggagtccttcacggcccagccggccgacatgcagaccggcgtgaagaagtgcagcgcggacgagatcggggagtgcatcaccctggaggacaagtcctggcccatcgtcttctgcggcgacaagtactactacagcgacgggaaggagcacgccaaggacggctccatcaacaactactgcctcgccaacaagtgcagcgagcagcggttccccatccacaagaactggttcaagaagtgcaactgggacaagacccacaaggagttcacgaccatgcgccagatcaactacaacgacatcacctcctaccggaaggccatcgagagcgagatcggcaccgacctgatgacgcaccactacaagcccaccaagaacctgccgcacgtggtgccccgctaccactccatcgacgtccaggggaccgagagcaccgagggcatcatcaacgggttcatccagaacacgatccccgccatctccggcctcggcgtggggtaccacctgggcttcaaggggaaccagctgttcgacatcgtgatcttcgtcaagaaggcggtgtacaaggcccagtaccagaaggtgtacaccaccggccccagcatctccatcaacatcgagcacaacgagaagtgcaccgggcactgcccggagaagatccccgccaaggagggctggctcacgttcagcaaggagcacacctccagctggggctgcgaggagtacgggtgcctggccatcgacaccggctgcctgtacgggtcctgccaggacgtcatccggcccgagctcgacatctacaagaagatcggcagcgaggcgtccctgctggagatctgcatcaccctcccgcacgagacgtactgcaacgacatggacatcctggagcccatcatcggggacaagctgagcgccagcttccagaacacccagaccaaccagctccccaacctgatggcctacaagaagggcaaggtgtacaccggccagatcaacgacgtggggaacacggccctgcagtgcggctccatccaggtcgtgaacgggagcaccatcggctccgggaaccccaagttcgactacatctgccacgccatgcgccggaaggacgtgatcgtccgcaagtgcttcaacgacaactaccagagctgcacccggctcgacccgcgcaacgacctgatcccctaccggaagggcgacatcatcgagatctccaagaccggcagcaacatggggcagatgacgttcaagatcgagctgggcgacatcaactacaagatcttcaccaagtccgtggacctccagatgagcgggatctgcgcgggctgcatcgactgcgccgaggggatctcctgcagcatcaacgccgacgtgtccgccgagaccgtctgccactgcaagaccaactgcgaggacttcatcagcaacatcgtgatctccccgcagatcaagacctacaacatcaaggtgcactgcaagagcaaggtcgagaagatcacggccaacatctgcggccgcaacatcgacctgcagctgaccgtgaagccctacaaccagaagatcgacctctcccagctggacgagagcaactacatcaaggaggaggacctgcagtgcggcacctggctctgcaaggtgcagaaggaggggatcgacatcgtcttcaagggcctgttctccgggctgggcaagtactgggcgatcctcatctacagcatcatcggcatcatcgtggtgatcctgctgatctacgtcctcctgccgatcgggcggctgctcaaggccttcctgatcaagaacgagatcgagtacaccatggagcagaagatcaagtga

SEQ ID NO: 12700 - RNA, 4263 nt, synthetic construct
  misc_feature 1..4263: note = derived and/or modified CDS sequence (opt1) from OROV(TVP-19258/IQT-4083)__KP795091.1__GP
  source 1..4263: mol_type = other RNA
atggccaacctgatcatcatcagcatgatcctcggcatcgcctacgggcaccccctgtccaccagccagatcggcgaccgctgcttcgccgggggctccctgttcaaggagatgaacctcagcgtggggctgggcgagatctgcgtcaaggacgacatctccatcgtcaagagcaccacggcgttctccaagaacgccctggccctcgaggccaccaccaagttctaccggagcttcatcgtgaaggactggtccgagtgcaacccggtgctggacaagttcggcaacttcatggtgctgaacgtggacaacaacgggcacctcgtccccaagatgtacacgtgccgcgcggcctgcgacatccggctgaacaaggacaacgccgagatcatcctgagctccaccaagctcaaccacttcgagatcgtgggcaccaccagcacctccgggtggttcaagaacacgatcaccaacaacctggagcacacgtgcgagcacgtgaccgtcaactgcggccagaagtccgtgaagttccacgcctgcttccgccagcaccgggcgtgcatccgcttcttcaaggggacctacatgccctactccatgatcgaggccatgtgcgtgaacatcgagctgatcatcctcaccctgtacatcttcgccgccatcatcttcgccctgatcatcaccaagagctacatcgcgtacctcctgctgcccctcttctacccggccacctggctgtacggcaaggtctacaagcggatcaactcctgccccaactgcctgctcgccagccaccccttcacgtcctgccccaagatctgcatctgcggcagccgcttcagctgcaccgaggccctgaaggtgcaccggatggggaaggactgcctgggctacaagtccctcagcaaggcccgccagatgtgcaagtccaagagctggtccttcaccgcggccatcctgaccgggctgatcctcatggagttcgtgagcccgatcgccggcgagcggatgtacaagctggaggagctggccgacgactacatcgagctcacggagcaggtcaacatcctgggcaaggagatcaagatcctgaagcagtccatcatcgtgatgctcgccatcatcctgatcctgctcctgagcgagaacatcatcttcaactacctgttcaacaccctctaccgctcctgcagcatgtgcgggctgatccactaccggcccggcctgaaggtggacctcaccaagaccaacaagtgcgggtcctgcatctgcggcttcgacgagcagcagagctccgggttcgagtacgaggtcttcctgaaggacatgcacgtgcagcgcgagagctgcaagttcggcccccgggtgaaccacttccgcaacacgaagatcctgctgttcaccatcgcgatctgcacctccttctacaccgtctacgccgacgaggactgcctgagcaagaacatccggatcacgtaccaggagctgcacaactgcatcggcccccacatcatgggggacacgtgcatgccgaagtccgagctgtacagcgacctcctgtccaagaacctgatcaccgagtacgacaagaagtacttcgagcccgacaccgtgaacgaccagttcaacaagatcgagttcgcccaggacgcccaccgcatgatcctcctggagcggatcctgtacaagaccgagtgcgagatgctcagcctgaagaagaacagcggcccctacaacgtggcctggcgcacctacctgaagaaccacaacatcgacctctgctcccggcacaactacaagatgatctgccagtgcatcaacacccacagcatgtgcaagaacaccgacatcgacttcaacaaggagatcgagacgtactacaaggcgaacgccgccgcctaccgctccgacttcaacaccatcatcgacaccctgaagaccgcgttccgcgggctgaccaaggtcctcatcgagaactacatcgagaaggacgacagcgacgccctgaaggccctgttctccaacatcacggacagcgtgcaggacaactaccagatggtcggcgtgctcaagttcgcctccaagctgctgaacatcagcctcgggcggaccacccgctccgcccagcacagcatcatgaccaacgagatccccaagtccaacccgttcacggactacagctactccagcatcaacatcaaggagtgcatgtcccccgagagcctgaagtgcttcaagaagcgggactccgcgccccacaccaaccacctcctctgcaagatcgacaacaagtacaaggccttcgactggcccgagatcgagaccgtgcagaagggccagaagctgtgcctgggcgacagccactgcaacctcgagttcaccgccatcacggccgacaagatcatgagcctgaccaactgctacaaggagtccttcaccgcccagccggcggacatgcagaccgggatcaagaagtgcagcgccgacgagatcggcgagtgcatcacgctggaggacaagtcctggcccatcatcttctgcggggacaagtactactacagcgacggcaaggagcacgccaaggacgggtccatcaacaactactgcctcgccaacaagtgcagcgagcagcgcttccccatccacaagaactggttcaagaagtgcaactgggacaagacccacaaggagttcaccaccatgcggcagatcaactacaacgacatcacgtcctaccgcaaggccatcgagagcgagatcggcaccgacctgatgacccaccactacaagcccaccaagaacctgccgcacgtcgtgccccggtaccactccatcgacgtgcagggcacggagagcaccgaggggatcatcaacggcttcatccagaacaccatccccgcgatctccgggctcggcgtcggctaccacctggggttcaagggcaaccagctgttcgacatcgtgatcttcgtgaagaaggccgtctacaaggcccagtaccagaaggtgtacaccacggggcccagcatctccatcaacatcgagcacaacgagaagtgcaccggccactgcccggagaagatccccgccaaggaggggtggctcaccttcagcaaggagcacacctccagctggggctgcgaggagtacggctgcctggcgatcgacacggggtgcctgtacggctcctgccaggacgtgatccgccccgagctcgacatctacaagaagatcgggagcgaggcctccctgatcgagatctgcatcaccctgccgcacgagacctactgcaacgacatggacatcctcgagcccatcatcggcgacaagctgagcgccagcttccagaacacccagacgaaccagctgcccaacctcatggcctacaagaaggggaaggtctacaccggccagatcaacgacgtgggcaacaccgccctgcagtgcgggtccatccaggtggtcaacggcagcaccatcgggtccggcaaccccaagttcgactacatctgccacgcgatgcggcgcaaggacgtgatcgtgcggaagtgcttcaacgacaactaccagagctgcacgcgcctggacccgcggaacgacctcatcccctaccgcaagggggacatcatcgagatctccaagaccggcagcaacatgggccagatgaccttcaagatcgagctgggggacatcaactacaagatcttcaccaagtccgtcgacctgcagatgagcggcatctgcgccgggtgcatcgactgcgccgagggcatctcctgcagcatcaacgccgacgtgtccgccgagaccgtgtgccactgcaagacgaactgcgaggacttcatcagcaacatcgtcatcagcccccagatcaagacctacaacatcaaggtgcactgcaagagcaaggtggagaagatcaccgcgaacatctgcgagcggaacatcgacctccagctgaccgtcaagccctacaaccagaagatcgacctgtcccagctcgacgagagcaactacatcaaggaggaggacctgcagtgcgggacgtggctgtgcaaggtgcagaaggagggcatcgacatcgtgttcaagggcctcttctccgggctgggcaagtactgggccatcctgatctacagcatcatcgggatcatcgtcgtgatcctcctgatctacgtgctgctcccgatcggccgcctgctgcgggccttcctcatcaagaacgagatcgagtacaccatggagcagaagatcaagtga

SEQ ID NO: 12701 - RNA, 4263 nt, synthetic construct
  misc_feature 1..4263: note = derived and/or modified CDS sequence (opt1) from OROV(TVP-19259/IQT-7085)__KP795094.1__GP
  source 1..4263: mol_type = other RNA
atggccaacctgatcatcatcagcatgatcctcggcatcgcctacgggcaccccctgtccatcagccagatcggcgaccgctgcttcgccgggggctccctgttcaaggagatgaacctcagcgtggggctgggcgagatctgcgtcaaggacgacatctccatcgtcaagagcaccaccgccttctccaagaacgccctggccctcgaggccacgaccaagttctaccggagcttcatcgtgaaggactggtccgagtgcaacccggtgctggacaagttcggcaacttcatggtgctgaacgtggacgacaacgggcacctcgtccccaagatgtacacgtgccgcgcggcctgcgacatccggctgaacaaggacaacgccgagatcatcctgagctccaccaagctcaaccacttcgagatcgtgggcaccaccagcacctccgggtggttcaagaacaccatcacgaacaacctggagcacacgtgcgagcacgtgaccgtcaactgcggccagaagtccgtgaagttccacgcctgcttccgccagcaccgggggtgcatccgcttcttcaagggcacctacatgccctacagcatgatcgaggcgatgtgcgtgaacatcgagctgatcatcctcaccctgtacatcttcgccgccatcatcttcgccctgatcatcaccaagagctacatcgcctacctcctgctgcccctcttctacccggtcacctggctgtacggcaaggtgtacaagcggatcaactcctgccccaactgcctgctcgcgagccaccccttcacctcctgccccaagatctgcatctgcgggagccgcttcagctgcacggaggccctgaaggtgcaccggatgggcaaggactgcctggggtacaagtccctcagcaaggcccgccagatgtgcaagtccaagagctggtccttcaccgccgccatcctgaccggcctgatcctcatggagttcgtcagcccgatcgcgggcgagcggatgtacaagctggaggagctggccgacgactacatcgagctcgccgagcaggtcaacatcctggggaaggagatcaagatcctgaagcagtccatcgtggtgatgctcgccatcatcctgatcctgctcctgagcgagaacatcatcttcaactacctgttcaacaccctctaccgctcctgcagcatgtgcggcctgatccactaccggcccgggctgaaggtggacctcacgaagaccaacaagtgcggctcctgcatctgcgggttcgacgagcagcagagctccggcttcgagtacgaggtgttcctgaaggacatgcacgtccagcgcgagagctgcaagttcggcccccgggtgaaccacttccgcaacaccaagatcctgctgttcaccatcgccatctgcacgtccttctacaccgtgtacgcggacgaggactgcctgagcaagaacatccggatcacctaccaggagctgcacaactgcatcgggccccacatcatgggcgacacgtgcatgtccaagagcgagctgtactccgacctcctgagcaagaacctgatcaccgagtacgacaagaagtacttcgagccggacaccgtcaacgaccagttcaacaagatcgagttcgcccaggacgcccaccgcatgatcctcctggagcggatcctgtacaagaccgagtgcgagatgctcagcctgaagaagaactccgggccctacaacgtggcctggcgcacctacctgaagaaccacaacatcgacctctgcagccggcacaactacaagatgatctgccagtgcatcaacacgcactccatgtgcaagaacaccgacatcgacttcaacaaggagatcgagacctactacaaggccaacgcggccgcctaccgcagcgacttcaacaccatcatcgacacgctgaagaccgccttccgcggcctgaccaaggtcctcatcgagaactacatcgagaaggacgactccgacgcgctgaaggccctgttcagcaacatcaccgactccgtgcaggacaactaccagatggtgggggtcctcaagttcgccagcaagctgctgaacatctccctcggccggaccacgcgcagcgcccagcactccatcatgaccaacgagatccccaagagcaaccccttcaccgactactcctacagctccgtgaacatcaaggagtgcatgagcccggagtccctgaagtgcttcaagaagcgggacagcgcgccccacaccaaccacctcctctgcaagatggacaacaagtacaaggcgttcgactggcccgagatcgagacggtgcagaagggccagaagctgtgcctgggggacagccactgcaacctcgagttcaccgccatcaccgccgacaagatcatgtccctgaccaactgctacaaggagagcttcacggcccagcccgccgacatgcagaccggcatcaagaagtgctccgcggacgagatcggggagtgcatcaccctggaggacaagagctggccgatcgtcttctgcggcgacaagtactactactccgacgggaaggagcacgccaaggacggcagcatcaacaactactgcctcgccaacaagtgctccgagcagcgcttccccatccacaagaactggttcaagaagtgcaactgggacaagacccacaaggagttcacgaccatgcggcagatcaactacaacgacatcaccagctaccgcaaggccatcgagtccgagatcggcaccgacctgatgacgcaccactacaagcccaccaagaacctgccccacgtggtgccgcggtaccacagcatcgacgtccaggggaccgagtccaccgagggcatcatcaacgggttcatccagaacacgatccccgccatcagcggcctcggcgtggggtaccacctgggcttcaaggggaaccagctgttcgacatcgtgatcttcgtcaagaaggcggtgtacaaggcccagtaccagaaggtgtacaccaccggcccctccatcagcatcaacatcgagcacaacgagaagtgcaccgggcactgccccgagaagatcccggccaaggagggctggctcacgttctccaaggagcacaccagctcctggggctgcgaggagtacgggtgcctggccatcgacaccggctgcctgtacgggagctgccaggacgtcatccgccccgagctcgacatctacaagaagatcggctccgaggcgagcctgatcgagatctgcatcaccctgccccacgagacgtactgcaacgacatggacatcctcgagccgatcatcggggacaagctgagcgcctccttccagaacacccagaccaaccagctgcccaacctcatggcctacaagaagggcaaggtgtacaccggccagatcaacgacgtggggaacacggccctgcagtgcggcagcatccaggtcgtgaacgggtccaccatcggcagcgggaaccccaagttcgactacatctgccacgccatgcggcgcaaggacgtgatcgtccggaagtgcttcaacgacaactaccagtcctgcacccgcctggacccccggaacgacctcatcccgtaccgcaagggcgacatcatcgagatcagcaagaccggctccaacatggggcagatgacgttcaagatcgagctgggcgacatcaactacaagatcttcaccaagagcgtggacctgcagatgtccgggatctgcgcgggctgcatcgactgcgccgaggggatcagctgctccatcaacgccgacgtgagcgccgagaccgtctgccactgcaagaccaactgcgaggacttcatctccaacatcgtgatcagcccccagatcaagacctacaacatcaaggtgcactgcaagtccaaggtcgagaagatcacggccaacatctgcggccggaacatcgacctccagctgaccgtgaagccctacaaccagaagatcgacctgagccagctcgacgagtccaactacatcaaggaggaggacctgcagtgcggcacctggctgtgcaaggtgcagaaggaggggatcgacatcgtcttcaagggcctcttcagcgggctgggcaagtactgggcgatcctgatctactccatcatcggcgtgatcgtggtcatcctcctgatctacgtgctgctccccatcgggcgcctgctgaaggccttcctcatcaagaacgagatcgagtacaccatggagcagaagatcaagtga

SEQ ID NO: 12702 - RNA, 4263 nt, synthetic construct
  misc_feature 1..4263: note = derived and/or modified CDS sequence (opt1) from OROV(TVP-19262/OBS-9478)__KP795100.1__GP
  source 1..4263: mol_type = other RNA
atggccaacctgatcatcatcagcatgatcctcggcatcgcctacgggcaccccctgtccaccagccagatcggcgaccgctgcttcgccgggggctccctgttcaaggagatgaacctcagcgtggggctgggcgagatctgcgtcaaggacgacatctccatcgtcaagagcaccacggccttctccaagaacgccctggccctcgaggccaccaccaagttctaccggagcttcatcgtgaaggactggtccgagtgcaacccggtgctggacaagttcggcaacttcatggtgctgaacgtggacaacaacgggcacctcatccccaagatgtacacgtgccgcgcggcctgcgacatccggctgaacaaggacaacgccgagatcatcctgagctccaccaagctcaaccacttcgagatcatcggcaccaccagcacctccgggtggttcaagaacacgatcaccaacaacctggagcacacgtgcgagcacgtcaccgtgaactgcggccagaagtccgtgaagttccacgcctgcttccgccagcaccgggggtgcatccgcttcttcaagggcacctacatgccctactccatgatcgaggcgatgtgcgtcaacatcgagctgatcatcctcaccctgtacatcttcgccgccatcatcttcgccctgatcatcaccaagagctacatcgcctacctcctgctgcccctcttctacccggcgacctggctgtacggcaaggtgtacaagcggatcaactcctgccccaactgcctgctcgccagccaccccttcacgtcctgccccaagatctgcatctgcgggagccgcttcagctgcaccgaggccctgaaggtgcaccggatgggcaaggactgcctggggtacaagtccctcagcaaggcccgccagatgtgcaagtccaagagctggtccttcaccgccgcgatcctgaccggcctgatcctcatggagttcgtcagcccgatcgccggcgagcggatgtacaagctggaggagctggccgacgactacatcgagctcacggagcaggtcaacatcctggggaaggagatcaagatcctgaagcagtccatcatcgtgatgctcgccatcatcctgatcctgctcctgagcgagaacatcatcttcaactacctgttcaacaccctctaccgctcctgcagcatgtgcggcctgatccactaccggcccgggctgaaggtggacctcaccaagaccaacaagtgcggctcctgcatctgcgggttcgacgagcagcagagctccggcttcgagtacgaggtgttcctgaaggacatgcacgtgcagcgcgagagctgcaagttcggcccccgggtcaaccacttccgcaacacgaagatcctgctgttcaccatcgccatctgcacctccttctacaccgtgtacgcggacgaggactgcctgagcaagaacatccggatcacgtaccaggagctgcacaactgcatcgggccccacatcatgggcgacacgtgcatgccgaagtccgagctgtacagcgacctcctgtccaagaacctgatcaccgagtacgacaagaagtacttcgagcccgggaccgtgaacgaccagttcaacaagatcgagttcgcccaggacgcccaccgcatgatcctcctggagcggatcctgtacaagaccgagtgcgagatgctcagcctgaagaagaacagcggcccctacaacgtcgcctggcgcacctacctgaagaaccacaacatcgacctctgctcccggcacaactacaagatgatctgccagtgcatcaacacccacagcatgtgcaagaacaccgacatcgacttcaacaaggagatcgagacgtactacaaggccaacgcggccgcctaccgctccgacttcaacaccatcatcgacaccctgaagaccgccttccgcgggctgaccaaggtgctcatcgagaactacatcgagaaggacgacagcgacgcgctgaaggccctgttctccaacatcacggacagcgtgcaggacaactaccagatggtcggcgtgctcaagttcgcctccaagctgctgaacatcagcctcggccggaccacccgctccgcccagcacagcatcatgaccaacgagatccccaagtccaacccgttcacggactacagctactccagcatcaacatcaaggagtgcatgtcccccgagagcctgaagtgcttcaagaagcgggactccgcgccccacaccaaccacctcctctgcaagatcgacaacaagtacaaggcgttcgactggcccgagatcgagaccgtccagaaggggcagaagctgtgcctgggcgacagccactgcaacctcgagttcaccgccatcacggccgacaagatcatgagcctgaccaactgctacaaggagtccttcaccgcccagccggccgacatgcagaccgggatcaagaagtgcagcgcggacgagatcggcgagtgcatcacgctggaggacaagtcctggcccatcatcttctgcggggacaagtactactacagcgacggcaaggagcacgccaaggacggctccatcaacaactactgcctcgccaacaagtgcagcgagcagcgcttccccatccacaagaactggttcaagaagtgcaactgggacaagacccacaaggagttcaccatcatgcggcagatcaactacaacgacatcacctcctaccgcaaggccatcgagagcgagatcgggacggacctgatgacccaccactacaagcccaccaagaacctgccgcacgtggtgccccggtaccactccatcgacgtccagggcaccgagagcacggaggggatcatcaacggcttcatccagaacaccatccccgccatctccggcctcggggtgggctaccacctggggttcaagggcaaccagctgttcgacatcgtgatcttcgtcaagaaggcggtgtacaaggcccagtaccagcgcgtgtacaccaccgggcccagcatctccatcaacatcgagcacaacgagaagtgcacgggccactgcccggagaagatccccgccaaggagggctggctcaccttcagcaaggagcacacctccagctgggggtgcgaggagtacggctgcctggccatcgacaccgggtgcctgtacggctcctgccaggacgtcatccggcccgagctcgacatctacaagaagatcgggagcgaggcgtccctgatcgagatctgcatcacgctgccgcacgagacctactgcaacgacatggacatcctcgagcccatcatcggcgacaagctgagcgccagcttccagaacacccagaccaaccagctgcccaacctcatggcctacaagaagggcaaggtgtacacggggcagatcaacgacgtgggcaacaccgccctgcagtgcgggtccatccaggtcgtgaacggcagcatcatcgggtccggcaaccccaagttcgactacatctgccacgccatgcgccggaaggacgtgatcgtccgcaagtgcttcaacgacaactaccagagctgcacccggctggacccgcgcaacgacctcatcccctaccggaagggcgacatcatcgagatctccaagaccgggagcaacatgggccagatgacgttcaagatcgagctgggggacatcaactacaagatcttcaccaagtccgtggacctgcagatgagcggcatctgcgcggggtgcatcgactgcgccgagggcatctcctgcagcatcaacgccgacgtgtccgccgagaccgtctgccactgcaagaccaactgcgaggacttcatcagcaacatcgtgatcagcccccagatcaagacctacaacatcaaggtgcactgcaagagcaaggtcgagaagatcacggccaacatctgcgagcgcaacatcgacctccagctgaccgtgaagccctacaaccagaagatcgacctgtcccagctcgacgagagcaactacatcaaggaggaggacctgcagtgcggcacctggctgtgcaaggtgcagaaggaggggatcgacatcgtcttcaagggcctcttctccgggctgggcaagtactgggcgatcctgatctacagcatcatcggcatcatcgtggtgatcctcctgatctacgtcctgctcccgatcgggcggctgctgcgcgccttcctcatcaagaacgagatcgagtacaccatggagcagaagatcaagtga

SEQ ID NO: 12703 - RNA, 4299 nt, synthetic construct
  misc_feature 1..4299: note = derived and/or modified CDS sequence (opt1) from OROV/FPV(Aus Ch 16129)__KF697137.1__GP
  source 1..4299: mol_type = other RNA
atgaagttcgtgagcatcctgctcttcgtctcctggctgggcgccacctaccagaaccccgtgagccaccgccagatcggggagcggtgcttcgccggcgggtccctgatcaagaccgtgaaccagacgagcggcgtctccgaggtgtgcgtgcgcgacgacatcagcatgatcaagtccatcgtccacaccaccaaggcgagcgacaccgccgtgaacaactacatccggttctaccgcgtgttcatcgtcaaggagtggcacgactgcaacccgttccccgaccccaaggggacgttcatggtgctcgacgtgtccagcaccaaccacctggagcccatcacctacacctgccggacgccgtgcgagatcaccctggacaaggactccgccgaggtcaccctcagctcccagaagatgaaccactacgagatcagcggctccaccatcaacaacggctggttcaagaacagcatctccgtgagcctggagcacacgtgcgagcacatcaccgtgtcctgcgggcagaagaccgtccgcttccacgcctgcttccggcagcaccgcagctgcacccggttcttcaagaacagcatgatgcccgcccgcatgacggagtccatctgccagaacctggagatcatcctcctgacctgcttcagcttcgtgtgcttcatcttcctgtgcatcatcaccaagacctacgtggcgtacgtcctcatccccgtgttctaccccttcacgtacatctacggccggctgtacgacaagtacttcaagctgtgcgagaactgcctcctggccgtgcacccgttcaccccctgcgagaccgtctgcgtgtgcgggtcccagtacgccaacaccgagcagctgcgcacgcaccggatgaccaacaactgcaagggctacaagagcctctccaagagccgcgccatgtgcaagtccaaggggtgcagcttcgtggtcgcgatcttctgctccatcatcttcttcagcttcatcacccccatcaactcccaggagtacaagctgagcgacctgcccgacgagttcacccggctcgaggaggagaacacgatgctgaagatccgcctgctcgtgatcaagatcaccatctccgtcatcagcgtgaccatcaccgtgacgtccctgaccgagcggaaggtcttccaggagctgttcaacgccatctaccgccactgcccgttctgcggcatgatccaccggcgccggggcctccgcgtggtgaacagcaccaccaacaagtgcgggacgtgcatctgcggctacaaggaggagaccgagcacggggtcgagtacgagatcttcctgaagaccatgcaccaggagaacgtgaactgcatgttcaagccctcccagcgccacttccggaacttcaagatcctgatcgccttcctcgccatgtgcatgatcatcaccagcgtgtccgccgacgagaagcactgcctgaagtacaaggagcccgtcaagctgagcaacctcaccgagtgccacagcctgtggctgaacatcacggagtgccagatcaaccagtccaccctcttcgagaccctgaagggcgagcagctggtgaccgacttcgacaagcccgacttcacgatcatgggccagaagtacgacatcgcgatggagcgcatcgagaacgcccagaacctccaccacatgatcctgctggagtacctccacgccaagagcaactgcctgaagtacaagcagctgaagtccaacagcgggccgtacaacatcccctggcggacctacatccacggccacgggctcgacgtgtgcggccagtactcctacaagctgatctgcaagtgcatcagcaccgggatgcactgcgagaacaccgccctggacatctacaacgagatgcgccagttctacacgaacaaccaggagaactacaacctcgacctgaacaccgtcatcaaggccatcggcctggcgatgcggggcatcgggcagatgatcatcgaggagttcttcggcgagtcccagatcgaggagctgagcaacttcctcaacatgacctccaagaacctggggaccaacaagcagctgatcggcctcatcaacttcgggctgatgctgctcgacatcaaccagacgaagaccccccagatcgaccccaagccgcgcaccctgcaggcccggagctccatccccaccggcacggagatcaccgactggaccaagggccagagcaagatcaagacctgcgccgagtactccacgctgacctgccagagctggcgcaagaccgtgaacaccaagtccttcctcatgtgcaaggtgagctccaagtggcacgtctacaactggcccgagatccccacggtggtgcggaacagcaagctgtgcctgggggactaccactgcaacatggagttcaccccgatcgacgccgacgaggccctcaagcagctgcgctgctacaagaccgagttcgtccccagccccgacggcatggacgagtccatcaagaagtgcaccctggagaagttcgggggctgcacgaccgcgaacgggcacagctggaccatcatggtgtgcaacggccggtactaccagaccaacacgcgcgagcacgccaaggacggcctcctgaactcctactgcttcgagcccaagtgccagagcgggcggcacccgatccacaagtccttcctgaacaactgcatctggaaggagagctcccgccagatcatcgagacccggaccatcgagtacaacaacatcgaggactacaagaagagcgtggagtccgacatcaagagcgacctcaccatccaccacttcaagcccacgaagaacctgcccctggtcaccccgacctacatctccgtggtggccgacggcaccatggtcagcgacgggatccagaacgcctacgtgaagggcaccatccccggcatctccggggtggccacgggcctccacgtcaagacccccgacgggatcctgctgatggacatcatcgtgtacgtgcgcaaggcgctctacaaggccaactacgagaagatctacagcaccggccccaccatcgggatcaacgtcaagcacaacgagaagtgcacgggcacctgcccggagcacatccccaaggacgagggctggctgaccttctccaaggagcacaccagcaactgggggtgcgaggagtacggctgcttcgccatcaactccgggtgcctgtacggcagctgccaggacatcatccggcccgagctcgacatctacaagcagcagggggaggagcagacgctgctggagctctgcatcaccctgccccacgagaccttctgcaacgacctggacgtgctcgagccggtgatcaccgacaagctgcagctggacttccagacgacccagtccgaccacctccccgagctggtcgccctgaagaagggcctcatcctgaccggccagctgaacgacctcgggaacaccgcggccatgtgcggcagcgtgcagctggtgaacaagacgatctacgggcagggcaaccccaagttcgacttcatctgccacgccatgcgccggaaggacgtcatcgtgcgccgctgctacgacaaccactacagcacctgcgccctgctcaagcagcggaacgacctgctgcacaaggaggtgaacgaccagatgtccatcaccgtcaacgggaagaacctcggcctgatcaacttccgcctgaacctcggcgacctgaactacaagctgttcgtgaacgagcccaacttcgagctcaccgggcagtgcgccggctgcatcagctgcgcggacgagatctcctgccagctgaacatcatcgccgaccacgagttcacgtgcaaggtgagctccagctgcaacctgtacatctccaacatgatgatcaccccggccaaccacatctacaacctcaaggtcagctgccgggagcacgtgtccaacatcgacctggccgtgtgcgggcgcagcttctccctgcacgccaccctcaagcagcacagccagaagctggacctgtccgcgctcgacgagaccaacttcgtcaaggaggaggacctgcggtgcggcacgtggctgtgcaaggtgaaggacgaggggctcagcttcctgacccgctccatcttcggcagcctgggcacctactggtcctacttcatctacgggctcatcttcatgatcctgctgttcatcgccatctacttcctctaccccctgtgcaagcggctgaagggcctcctggaggagaacgagcgcgagtacctgatcgagagcaagatgaagtga

SEQ ID NO: 12704 - RNA, 4257 nt, synthetic construct
  misc_feature 1..4257: note = derived and/or modified CDS sequence (opt1) from OROV/IQTV(IQT9924)__KF697143.1__GP
  source 1..4257: mol_type = other RNA
atggactgcatcatcttctacctgagcttcttcgccgtggtcaccgcccaccccgtgtcccaccaccaggtgggcgaccgctgcttcgccgggggcaacctcatcaaggacctgaacaagaccgtcaacatcggggaggtgtgcgtgcgggacgacatcagcatcatcaagtccacgaccgccatccagaagtccctggaccacctcagcacccgcaccaagttctaccgggtctacatcgtgaaggagtgggccgagtgcaacccgatcatcgactacgccggcaacttcatcgtgatgaacatcgacgacaacgggcacctggtcccccgcatgcacacgtgccgggccagctgcgacatccgcctgaacaagaacgacgcggagatcatcctctccagccagaagaccaaccactacgagatcatcggcaccaccacggtgtccggctggttcaagaacaccatcaacctgcccctggagcacacgtgcgagcacatcaccgtgaactgcgggcagaagtccctccggttccacgcctgcttccgcatgcaccggggctgcacccgcttcttcaagaacacctacatgcccagcaccatgatcgagcacatgtgcgtcaacctggagctgatcatcttcaccctctacatcttcacggccctggtgttcgcctacatcatcaccaagagctacatcgcgtacatcctgctcccgctgttctaccccctgacctacgtgttcgggatcatctactccaagctcaagcagtgcaagacctgcatgctggccgcccaccccttcacgaactgccccaagcggtgcgtctgcggcagccgcttcaactgcaccgaggccctgcgggtgcaccgcctcgggcgggactgccagggctacaagtccctgagcaaggcccgccagatgtgcaagtccaagagctggtccttcatcatcgcgatcttcaccggcctgatcctcatggagttcatcaccccgatccacggggagcggacgtacaagctgagcgagctggccgacgagttcatcgccatgaagaccgaggtgaccgtcatgcagcgcagcatctacaaccagaagatcctcaacatcgccctgctgaccctcgtggtgctgatcatcctgctcgagacgtacatcttcaagatcctgttctccctgctctaccggagctgctccatgtgcggcctgatccactacaaggtcgggctgaagatcaacctcctgaccaccaacaagtgcgggacctgcatctgcggcttcagcgagcagcagtccagcgggttcgagtacgaggtgttcctgaaggacatgcacaagcagcgcgagtcctgcaagtacttccccatgctcaaccacttccggaacctgaagatcctgacgaccatcctcctgctgatcctcctggccaccagcgtgtccagcgagtgcctgcagaagcccctgaagatcaagctcgaggacctgcacgagtgcatcggcgtcaacttcctggacaagcagtgctacaaccgcaagaacctctacgagtccctgcgcagcaagaacctgatctccgaggtggacaagaagtacttcgagaacgcggacctcgaggggcagttcaagcggatcgagtacgcccaggacgcccaccgcatgatcctgctggagcggatcctctacagcaccgagtgcgagatgcacacgatcctgaccaacggcggggcctacaacatcccctggcgcacctacctgaagaaccacaacctcaacctgtgcggcaagcacgtccacaagatggtgtgccagtgcgtgaacacccacacccagtgcctgtccacgggcatcgactaccaggacgagatcaccaagttctaccaggccgacggggacagctaccggtccgacctcagcatcatcctggagaccatctccaccgcgttccgcggcctgacgaaggtcctcatcgagacctacatcgagcaggacaacagcgagagcatgatcaagctgctgaacaccatccaggggaaggtgccgaacaactaccagatgctcggcatcctgaagttcgccatcaagatcatgaacatcaaccagacccggggcgtgcgctccgcccggcacacgatcgtcagcaacgacatccccatgtccgagcccttcagcaacttcgaggtgtccaacatcaacatcaagcagtgcctggagcccctcaccctgaagtgcttcaccaagcgcggcgacagcccgcactccaaccacctcctgtgcaaggagcagagcaagtacaaggtgttcgagtggcccgaggtcgagaccgtgacgaagaacaacaagctgtgcctgggcgacacccactgcaacctcaagttcaccgccaccacgtccgacgagatcatcaagctgctgaactgcttcagcgacacctacaagcccaaccccggggagatggagatcggcctcaagaagtgcaacgccgagaagatcggggagtgcgtgaccctggagaactccccgtggcccatcgtctactgcgagaacaagtactactacagcgaggcgaaggagcacgccaaggacggctccgtgaacagctactgcctgaccaacaagtgcacggaggaccggctccccatcaaccccgcctggttcaagtcctgcaactgggagaagaacatcaaggagaccgccaccatcaaggagttcgtgtacaacgacatcaagagctaccgcaagtccctggagagcgagatcaacaccgacctgatgatccaccactaccggccgacgaagaacctcccccacatcaagcccatctacaagagcctgtccatccaggggagcgagaccgtcgacggcctgcagaactccttcatcgagggcgagatgcccgcgatcagcgggctcgccaacggctaccacctgatgtacaaggggacccagctgttcgacatcgtgatcttcatccgcaaggccgtgtacaaggccaactactacaagatctacaccacgggcccgtccatcgccatcaacatggagcacaacgagcagtgcaccggccactgccccagcaagatcccctccaaggagaactggctcaccttcagccgggagcacacctccagctgggggtgcgaggagtacggctgcctggcgatcgacacggggtgcctgtacggctcctgccaggacgtcatccgcccggagatcgacgtgtacaagaagtccgggaccgagcagagcctcatcgagctgtgcatcaccagcgcccacgagaccttctgcaacgacctggacatcctcgagcccatcatcggcgagaagatctccgccagcttccagtccacgcagagcaaccagctgcccaacatcatcgccttccggaagggccagatcctgaccggggccatcaacgacctcggcaacaccgggtcccagtgcggcagcatccagctggtgaacaacaccctgctcggggagggcaacgtcaagttcgactacatctgccacgcgatgcgccggaaggacgtgatcatccgccgctgctacaacgaccacttcaccagctgcaacctgctgcagaagcggtccgacctcatcggcaacatcaacgggaaggagctgcagatcagcatgtccggccgcagcatggggtccatgaagttcaagatcgagctgggcgacatcaactacaagctctacacggagaacgccgacatcaccatccgcggggagtgcggcggctgcatcgggtgcgccgaggccgtgagctgctccctggaggtcgagagcgcctccgagatcctgtgcaaggtggagtgcaactgccagccctacatcgagaacatcctcatcaagccgcagaccaagacctacagcttcaaggcgacgtgcctggagaagtccaacaccctggacatcaagatctgcggcaagcagatcatcgcgcccctcaccatcaagagctacaaccagaagatcgacctgtccaagctggacgagagcaactacgtgaaggaggaggacctcgcctgcaacacctggctgtgcaaggtccagacggaggggttcaacttcgtgttctccggcctgttcgccgggttcggccggtactggaccatcgcgatctacatcctcatcgccgtggtcatcatcctgatcctgatctacatcctcatgcccatcttccggctgatccgcaccttcctgatcaagaacgagatcgagtacaccacggagcagaagatgcggtga

SEQ ID NO: 12705 - RNA, 4257 nt, synthetic construct
  misc_feature 1..4257: note = derived and/or modified CDS sequence (opt1) from OROV/IQTV(MIS-0397)__KJ866387.1__GP
  source 1..4257: mol_type = other RNA
atggactgcatcatcttctacctgagcttcttcgccgtggtcaccgcccaccccgtgtcccaccaccaggtgggcgaccgctgcttcgccgggggcaacctcatcaaggacctgaacaagaccgtcaacatcggggaggtgtgcgtgcgggacgacatcagcatcatcaagtccacgaccgccatccagaagtccctggaccacctcagcacccgcaccaagttctaccgggtctacatcgtgaaggagtgggccgagtgcaacccgatcatcgactacgccggcaacttcatcgtgatgaacatcgacgacaacgggcacctggtcccccgcatgcacacgtgccgggccagctgcgacatccgcctgaacaagaacgacgcggagatcatcctctccagccagaagaccaaccactacgagatcatcggcaccaccacggtgtccggctggttcaagaacaccatcaacctgcccctggagcacacgtgcgagcacatcaccgtgaactgcgggcagaagtccctccggttccacgcctgcttccgcatgcaccggggctgcacccgcttcttcaagaacacctacatgcccagcaccatgatcgagcacatgtgcgccaacctggagctgatcatcttcaccctctacatcttcacggccctggtcttcgcgtacatcatcaccaagagctacatcgcctacatcctgctcccgctgttctaccccctgacctacgtgttcgggatcatctactccaagctcaagcagtgcaagacctgcatgctggccgcccaccccttcacgaactgccccaagcggtgcgtgtgcggcagccgcttcaactgcaccgaggccctgcgggtccaccgcctcgggcgggactgccagggctacaagtccctgagcaaggcgcgccagatgtgcaagtccaagagctggtccttcatcatcgccatcttcaccggcctgatcctcatggagttcatcaccccgatccacggggagcggacgtacaagctgagcgagctggccgacgagttcatcgccatgaagaccgaggtgaccgtgatgcagcgcagcatctacaaccagaagatcctcaacatcgccctgctgaccctcgtcgtgctgatcatcctgctcgagacgtacatcttcaagatcctgttctccctgctctaccggagctgctccatgtgcggcctgatccactacaagctggggctcaagatcaacctgctgaccaccaacaagtgcgggacctgcatctgcggcttcagcgagcagcagtccagcgggttcgagtacgaggtgttcctcaaggacatgcacaagcagcgcgagtcctgcaagtacttccccatgctgaaccacttccggaacctgaagatcctcacgaccatcctgctgctcatcctgctggcgaccagcgtctccagcgagtgcctgcagaagcccctcaagatcaagctggaggacctgcacgagtgcatcggcgtgaacttcctcgaccgccagtgctacaaccgcaaggacctgtacgagtccctgcggagcaagaacctcatctccgaggtggacaagaagtacttcgagagcgccgacctgggcggccagttcaagcgcatcgagtacgcccaggacgcccaccggatgatcctgctcgagcgcatcctgtactccaccgagtgcgagatgcacacgatcctgaccaacgggggcgcctacaacatcccctggcggacctacctcaagaaccacaacctgaacctgtgcggcaagcacgtccacaagatggtgtgccagtgcgtcaacacccacacccagtgcctcagcacggggatcgactaccaggacgagatcaccaagttctaccaggcggacggcgactcctaccgcagcgacctgtccatcatcctggagaccatcagcaccgccttccgggggctcacgaaggtgctgatcgagacctacatcgagcaggacaacagcgagtccatgatcaagctgctcaacaccatccagggcaaggtgccgaacaactaccagatgctggggatcctgaagttcgccatcaagatcatgaacatcaaccagacccgcggcgtccggagcgcccgccacacgatcgtgtccaacgacatccccatgagcgagcccttctccaacttcgaggccagcaacatcaacatcaagcagtgctccgagcccctcaccctgaagtgcttcaccaagcggggcgacagcccgcactccaaccacctcctgtgcaaggagcagagcaagtacaaggtgttcgagtggcccgagatcgagaccgtcacgaagaacaacaagctgtgcctgggggacacccactgcaacctcaagttcaccgcgaccacgtccgacgagatcatcaagctgctgaactgcttcagcgacacctacaagcccaaccccggcgagatggagatcgggctcaagaagtgcaacgccgagaagatcggcgagtgcgtgaccctggagaactccccgtggcccatcgtgtactgcgagaacaagtactactacagcgaggccaaggagcacgccaaggacgggtccgtcaacagctactgcctgaccaacaagtgcacggaggaccgcctccccatcaaccccgcgtggttcaagtcctgcaactgggagaagaacatcaaggagaccgccaccatcaaggagttcgtgtacaacgacatcaagagctaccgcaagagcctggagtccgagatcaacaccgacctgatgatccaccactaccggccgacgaagaacctcccccacatcaagcccatctacaagagcctgtccatccagggcagcgagaccgtggacggcctgcagaactccttcatcgagggggagatgcccgccatcagcggcctcgccaacgggtaccacctgacctacaagggcacccagctgttcgacatcgtcatcttcatccggaaggccgtgtacaaggcgaactactacaagatctacacgaccggcccgtccatcgccatcaacatggagcacaacgagcagtgcaccgggcactgccccagcaagatcccctccaaggagaactggctcaccttcagccgcgagcacacgtccagctggggctgcgaggagtacgggtgcctggccatcgacaccggctgcctgtacgggtcctgccaggacgtgatccggccggagatcgacgtctacaagaagtccggcaacgagcagagcctcatcgagctgtgcatcaccagcgcccacgagaccttctgcaacgacctggacatcctcgagcccatcatcggcgagaagatctccgccagcttccagtccacgcagagcaaccagctgcccaacatcatcgcgttccgcaaggggcagatcctgaccggcgccatcaacgacctcgggaacaccggcagccagtgcgggtccatccagctggtgaacaacaccctgctcggcgagggcaacgtgaagttcgactacatctgccacgccatgcggcgcaaggacgtcatcatccgccggtgctacaacgaccacttcaccagctgcaacctgctgcagaagcgctccgacctcatcgggaacatcaacggcaaggagctgcagatcagcatgtccgggcggagcatgggctccatgaagttcaagatcgagctgggggacatcaactacaagctctacacggagaacgccgacatcaccatccgcggcgagtgcggcgggtgcatcggctgcgccgaggcggtgagctgctccctggaggtggagagctccagcgagatcctgtgcaaggtcgagtgcaactgccagccctacatcgagaacatcctcatcaagccgcagaccaagacctactccttcaaggccacgtgcctggagcggagcaacaccctggacatcaagatctgcgggaagcagatcatcgcgcccctcaccatcaagtcctacaaccagaagatcgacctgagcaagctggacgagtccaactacgtgaaggaggaggacctcgcctgcaacacctggctgtgcaaggtgcagacggagggcttcaacttcgtcttcagcgggctgttcgcgggcttcggccgctactggaccatcgccatctacatcctcatcgccgtggtgatcatcctgatcctgatctacatcctcatgcccatcttccggctgatccgcaccttcctgatcaagaacgagatcgagtacaccacggagcagaagatgcggtga

SEQ ID NO: 12706 - RNA, 4257 nt, synthetic construct
  misc_feature 1..4257: note = derived and/or modified CDS sequence (opt1) from OROV/MDDV(FMD 1303)__KF697145.1__GP
  source 1..4257: mol_type = other RNA
atggccttcctgctcatctacgtggtcctggccgcggccgtggccagccaccccctgtccaaccaccagatcggcgaccgctgcttcgccgggggcaacctcatccgggagctgaacaagaccgtgaacatcggggagctgtgcgtccgcgacgacatcagcatgatcaagtccaccacggccatccagaagtccgtgggccacctcagcacccggaccaagttctaccgcgtgtacatcgtcaaggagtgggcggagtgcaacccgatcatcgacttcgccgggaacttcatcatcatgaacatcgacgagaacggccacctggtgcccaagatgcacacgtgccgggccagctgcgacatccgcctgaacaaggacgacgccgagatcatcctctccagccagaagaccaaccactacgagatcatcggcaccacctccatcagcgggtggttcaagaacaccatcaacctgcccctggagcacacgtgcgagcacatcaccgtgaactgcggccagaagtccctccggttccacgcgtgcttccgcatgcaccgggggtgcacccgcttcttcaagaacacctacatgcccagcacgatgatcgagaccatgtgcgtcaacctggagctgatcatcttcaccctctacatcttctccgccgccgtgttcgcctacgtgatcaccaagagctacatcgcctacatcctgctgccggtcttctaccccatcacgtacatcctcggctccatctacagccggttcaagcagtgcaagacctgcatgctggcggcccaccccttcacctcctgccccaagaagtgcgtgtgcgggagccgcttcaactgcaccgaggccctgcgggtgcaccgcctcggcaaggactgccagggctacaagtccctgagcaaggcccggcagatgtgcaagagcaagtcctggagcttcatcatcgccgtcttcacggggctgatcctcatggagttcatcaccccgatctccggcgagcgcatgtacaagctgagcgagctggcggaggagttcatcgagatgaaggaggaggcctccgccctcaagaaggccatcaacaacctgaagctgctcaacgtgctgctgagcgccatcgcgaccctcgtggtcgtgatggagacctacatcttcaagtccctgttcaacctgctctaccggagctgctccatgtgcgggctgatccactacaagatcggcctgcgcgtgaacctcctgacgaccaaccggtgcgggacctgcatctgcgggttcaacgagcagcagagctccggcttcgagtacgagatcttcctgaaggacatgcacaagcagcgcgagagctgcaagtacttccccatgctcaaccacttccggaacgtcaagatcctgaccgtgttcctgctcctgacgatgctgaccgcctccgccagctccgagtgcctccagaagcccctgaagatcaagctggaggacctgcacgagtgcatcggggtgaacttcctcaaccgccagtgctacaacagccaggagctgtaccagtccctcaagagcaagaacctggtctccgaggtggacaagaagtacttcgacaacaagaacctggaggacctgttcaagcgcatcgagtacgcccaggacgcccaccggatgatcctcctggagcgcatcctgtacagcaccgagtgcgagatgcacaccatcctcacgaacggcggggcgtacaacatcccctggcggacctacctgaagaaccacaacctgaacctctgcggcaagcacgtccacaagatggtgtgccagtgcatcaacacccacacccagtgcctgagcacgggcatcgactaccaggacgagatcaccaagttctaccaggccgacggggactcctaccgcgccgacctgagcgtgatcctccagaccatcgccaccgcgttccggggcatgaccaaggtcctgatcgagacgtacatcgagcaggacaactccgagagcatgatcaagctgctcaacaccatcaaggagaaggtgccgaacaactaccagatgctggggatcctgaacttcgccatcaagatcatgtccgtgaaccagacccgcggcgtccggagcgcccgccacaccatcatctccaacgacatccccatgagcgagacgttctccaacttcgaggtgagcaacatcgacgtgaagcagtgcaccgaccccctcaccctgaagtgcttcaccaagcggggcgacgcgccccactccaaccacctcctgtgcaaggagcagaacaagtacaaggtcttcgagtggccggagatcgagacggtgatgaagaacaacaagctgtgcctgggcgacacccactgcaacctcaagttcgccgccatcgccagcgacgaggtgatcaagctgctgaactgcttctccgacacctacaagcccaaccccggcgagatggaggtcggggccaagaagtgcaacgccgacaagatcggcgagtgcatcaccctcgagaacaacccctggccgatcgtgtactgcgagacgaagtactactacagcgacgccaaggagcacgcgaaggacgggaacgtgaactcctactgcctgaccaacaagtgcaacgaggaccgcttccccatcaaccccacctggttcaagagctgctcctgggaccggaacgtcaaggagaccacgaccatcaaggagttcgtgcacaacgacatcagcgcctaccgcaagagcctggagtccgagatcagcaccgacctcctgatccaccactaccggcccaccaagaacctgccgcacatcatgcccgcctacaagtccctcacgatccagggcagcgagaccgtggacgggctgcagaactccttcatcgagggcgagatgcccgccatcagcggcctggccaacgggtaccacctcaagtacaagggcatcgagctgttcgacatcgtcatcttcatccgcaaggcggtgtacaaggccaactactacaagatctacaccaccgggccctccgtggccatcaacatggagcacaacgagcagtgcacgggcagctgcccgaagaagatccccgccaaggagaactggctgaccttctccaaggagcacaccagctcctggggctgcgaggagtacgggtgcctcgcgatcgacaccggctgcctgtacgggagctgccaggacgtcatccggcccgaggtggacgtgtacaagaaggcctccgccgagcagagcctgatcgagctctgcatcacgtccgcccacgagaccttctgcaacgacctggacatcctggagccgatcatcggcgacaagatcagcgccgcgttccagtccacccaggtcaaccagctccccaacatcatcgccttcaagaaggggcagatcttcaccggcgccatcaacgacctgggcaacacggggagccagtgcggctccatccagctgatcaacaacaccctcctgggggagggcaacgtgaagttcgactacatctgccacgccatgaagcgcaaggacgtgatcgtccggcgctgctacaacgaccacttcgccagctgcaacctgctccagaagcggagcgacctggtggggaccctgaacggcaaggagctccaggtgtccatgagcggccgctccatggggagcatgaagttcaaggtcgagctgggcgacatctcctacaagctgtacaccgagaacgcggacatcagcatctccggggagtgcggcgggtgcatcaactgcgccgaggccatcagctgcgccctcgagatcgactccagcacggaggtgctgtgcaagctggagtgctcctgccagccctacatccagaacatcctcatcaagccccaggtgaagaagtacagcttcaaggcgacctgcttcgagaagcgcaactccctggaggtcaccgtgtgcaagaagcagcacaccatcccgctgaccatcaagagctacaaccagaagatcgacctctcccggctggacgagagcaactacgtgcgcgaggaggacctgacgtgcaacacctggctctgcaaggtcgagaaggagggcatcggcgtgatgttctccgggctgttcgccggcttcgggaagtactggagcatcgccatctacgccctgatcgccctcgtgatcttcctgatcctgatctacatcctcgtccccatcttccggctgatccgcaccttcctgatcaagaacgaggtggagtacaccacggagcagaagatgcggtga

SEQ ID NO: 12707 - RNA, 4257 nt, synthetic construct
  misc_feature 1..4257: note = derived and/or modified CDS sequence (opt1) from OROV/MDDV(INHRR 17a-10)__KJ866390.1__GP
  source 1..4257: mol_type = other RNA
atggccttcctgctcatctacgtggtcctggccgcgaccgtggccagccaccccctgtccaaccaccagatcggcgaccgctgcttcgccgggggcaacctcatccgggagctgaacaagaccgtgaacatcggggagctgtgcgtccgcgacgacatcagcatgatcaagtccacgaccgccatccagaagtccgtgggccacctcagcacccggaccaagttctaccgcgtgtacatcgtcaaggagtgggccgagtgcaacccgatcatcgacttcgcggggaacttcatcatcatgaacatcgacgagaacggccacctggtgcccaagatgcacacgtgccgggccagctgcgacatccgcctgaacaaggacgacgccgagatcatcctctccagccagaagaccaaccactacgagatcatcggcaccacctccatcagcgggtggttcaagaacacgatcaacctgcccctggagcacacgtgcgagcacatcaccgtgaactgcggccagaagtccctccggttccacgcctgcttccgcatgcaccgggggtgcacccgcttcttcaagaacacgtacatgcccagcaccatgatcgagaccatgtgcgtcaacctggagctgatcatcttcaccctctacatcttctccgcggccgtgttcgcctacgtgatcaccaagagctacatcgcctacatcctgctgccggtcttctaccccatcacctacatcctcggctccatctacagccggttcaagcagtgcaagacctgcatgctggccgcgcaccccttcacctcctgccccaagaagtgcgtgtgcgggagccgcttcaactgcacggaggccctgcgggtgcaccgcctcggcaaggactgccagggctacaagtccctgagcaaggcccggcagatgtgcaagagcaagtcctggagcttcatcatcgccgtcttcaccgggctgatcctcatggagttcatcaccccgatctccggcgagcgcatgtacaagctgagcgagctggccgaggagttcatcgagatgaaggaggaggcgtccgccctcaagaaggccatcaacaacctgaagctgctcaacgtgctgctgagcgccatcgccaccctcgtggtcgtgatggagacgtgcatcttcaagtccctgttcaacctgctctaccggagctgctccatgtgcgggctgatccactacaagatcggcctgcgcgtgaacctcctgaccaccaaccggtgcgggacctgcatctgcgggttcagcgagcagcagtccagcggcttcgagtacgagatcttcctgaaggacatgcacaagcagcgcgagtcctgcaagtacttccccatgctcaaccacttccggaacgtcaagatcctgacggtgttcctgctcctgaccatgctgaccgcgagcgcctccagcgagtgcctccagaagcccctgaagatcaagctggaggacctgcacgagtgcatcggggtgaacttcctcaaccgccagtgctacaactcccaggagctgtaccagagcctgaagtccaagaacctcgtcagcgaggtggacaagaagtacttcgacaacaagaacctggaggacctgttcaagcgcatcgagtacgcccaggacgcccaccggatgatcctcctggagcgcatcctgtacagcaccgagtgcgagatgcacacgatcctcaccaacggcggggcctacaacatcccctggcggacctacctgaagaaccacaacctgaacctctgcggcaagcacgtccacaagatggtgtgccagtgcatcaacacccacacgcagtgcctgtccaccggcatcgactaccaggacgagatcaccaagttctaccaggcggacggggacagctaccgcgccgacctgtccatcatcctcgagaccatcgccaccgccttccggggcatgacgaaggtgctgatcgagacctacatcgagcaggacaacagcgagtccatgatcaagctgctcaacaccatcaaggagaaggtcccgaacaactaccagatgctggggatcctgaacttcgcgatcaagatcatgagcgtgaaccagacccgcggcgtgcggtccgcccgccacacgatcatcagcaacgacatccccatgtccgagaccttcaccaacttcgaggtcagcaacatcgacgtgaagcagtgcaccgaccccctcacgctgaagtgcttcaccaagcggggcgacgcgccccactccaaccacctcctgtgcaaggagcagaacaagtacaaggtgttcgagtggccggagatcgagaccgtcatgaagaacaacaagctgtgcctgggcgacacccactgcaacctcaagttcgccgccatcgccagcgacgaggtgatcaagctgctgaactgcttctccgacacgtacaagcccaaccccggcgagatggaggtggggaccaagaagtgcaacgccgacaagatcggcgagtgcatcaccctcgagaacaacccctggccgatcgtctactgcgagaccaagtactactacagcgacgccaaggagcacgccaaggacgggaacgtgaactcctactgcctgacgaacaagtgcaacgaggaccgcttccccatcaaccccacctggttcaagagctgctcctgggaccggaacgtgaaggagaccaccacgatcaaggagttcgtccacaacgacatcagcgcctaccgcaagagcctggagtccgagatcagcaccgacctcctgatccaccactaccggcccaccaagaacctgccgcacatcatgcccgcgtacaagtccctcaccatccagggcagcgagacggtggacgggctgcagaactccttcatcgagggcgacatgcccgccatcagcggcctggccaacgggtaccacctcaagtacaagggcatcgagctgttcgacatcgtgatcttcatcaagaaggccgtctacaaggccaactactacaagatctacaccaccgggccctccgtggcgatcaacatggagcacaacgagcagtgcaccggcagctgcccgaagaagatccccgccaaggagaactggctgacgttctccaaggagcacaccagctcctggggctgcgaggagtacgggtgcctcgccatcgacaccggctgcctgtacgggagctgccaggacgtgatccgccccgagatcgacgtctacaagaaggcctccgcggagcagagcctgatcgagctctgcatcacctccgcccacgagacgttctgcaacgacctggacatcctggagccgatcatcggcgacaagatcagcgccgccttccagtccacccaggtgaaccagctccccaacatcatcgccttcaagaaggggcagatcttcaccggcgcgatcaacgacctgggcaacaccgggagccagtgcggctccatccagctgatcaacaacacgctcctgggggagggcaacgtgaagttcgactacatctgccacgccatgaagcggaaggacgtcatcgtgcgccggtgctacaacgaccacttcgccagctgcaacctgctccagaagcgcagcgacctggtggggaccctgaacggcaaggagctccaggtctccatgagcggccggtccatggggagcatgaagttcaaggtggagctgggcgacatctcctacaagctgtacaccgagaacgccgacatcagcatctccggggagtgcggcgggtgcatcaactgcgccgaggcgatcagctgcgccctcgagatcgactccagcaccgaggtgctgtgcaagctggagtgctcctgccagccctacatccagaacatcctcatcaagccccaggtcaagaagtacagcttcaaggcgacctgcttcgagaagcgcaactccctggaggtgacggtgtgcaagaagcagcacaccatcccgctgaccatcaagagctacaaccagaagatcgacctctcccgcctggacgagagcaactacgtccgggaggaggacctgacctgcaacacgtggctctgcaaggtggagaaggagggcatcggcgtgatgttctccgggctgttcgccggcttcgggaagtactggagcatcgccatctacgccctgatcgccctcgtcatcttcctgatcctgatctacatcctcgtgcccatcttccgcctgatccggaccttcctgatcaagaacgaggtggagtacaccaccgagcagaagatgcgctga

SEQ ID NO: 12708 - RNA, 4257 nt, synthetic construct
  misc_feature 1..4257: note = derived and/or modified CDS sequence (opt1) from OROV/Perdoes virus(BeAn789726)__KP691625.1__GP
  source 1..4257: mol_type = other RNA
atgttcatccagttcaacctggccttcttctgcctcagcatcgtgtgcggccaccccctgaccaaggaccacatcggggaccgctgcttcgccggcgggaacctgttcaaggagatcacccagacgaccggcctctccgagatctgcatcaaggacgacatcagcatcatcaagtcccaggtcgagatcaagaagcagagctccgaggtgacctacgcggtgaagttctaccgggtctacctggtgaaggagtggagcgagtgcaacccgatccaggaccagcacgggtccatcatgatcctggacgtgaccaacacgggcctcatcgtccccaagatgtacacgtgccgcgccgcctgcgacatcaccctggacaaggacaacgccgaggtggtgttcatcagccagaagaacaacaactacgagctggccggcaccaccgtcatgcacgggtggttcaagaacgtggtgtccatcaagctcgagcacacgtgcgagcacctgaccgcgacctgcggccagaagaccgtcaagttccacgcctgcttccggcagcaccgcgcctgcgcccggttcctgaagaccacctacatgcccatcgtgatggtggagagcctctgctccaacctggagctggtcatcttcatcacctacatcttcgtgtgcctcgcgttcgccttcatcatcacgcgcacctacgtggcctacctgctgatccccgtcttctacccgttcacctacgcctacgggaagatgtacctcaagtgcgtgaagacctgccccaactgcctgctggccatgcaccccttcacgaactgcaccaacctctgcatctgcggcagccggttctccaacaccgagagcctgaaggtgcaccgcctggggaactgctacggctacaaggcgctctccggcgcccggagcatgtgcaagtccaaggtcagctccttcaccacggccatgttcttcgggatcatcatcctgagcttcatcgcgcccctgaacggcgagcgcctctacaagctgagcgagctgccggacgagtacatcgagatggagtccaccatcgaggggagcaagcagaaggagaccatcgtggacatcatcaactacaccgccctcgtgctgatcctgatcacgatcctcctgcagggcatcctggagaactacatcttccggctcaagttccgcttctgctccttctgcgacatgatccacatgaagaagaacctgaagatcttcagcaacatgaccaacaagtgcgggacctgcatctgcggcttcaaccaggagatccggtccggcttcgactacgaggtcttcatcaaggacatgcacgtgagccgcgagtcctgcaagtacaactaccacaagaactacagcttctacatcaagatgctgctcgtcgtgctgctggtgcccctcatcgggaccacggccgccgaggacaccaagtgcctgaagtacgacctgaacaagaacatcgaggacctcaaggactgctacggcctgaagctgaacatcgacaagcacgacaccgtcgagaacgcctacaagaacctcgtggaccagaagctggtgtccgagctggaccggctggacctcaacatcatgctggggagcaaggagtccatcttcgaggccatcgagaccagcatgaacatccaccagatggtcttcctggagtacctcgcctacaagacggaccccaagctgtccgagatcaagcagaacaccggcccctacaacatcgcgtggcgcaccttcatccacggcaacagcctggaggtgtgcgggaactacccgtacaagctcatctgctactgcatcaaccagaagacccactgcgagaactccaccgtggactacggcatccagatccagcccttctacaaccagcaccccaacagctacaagtccgacatggaggccctgatcaagacggtccagatcgccttccgggggatcatcaaggtgctgatccagtactacgtggagaacaacaagaccagcgagctctccaacctgctgaccgagctccgcaacgtcatgggcaacaacatccagatgaaggggatcctgaagtacctggagacctacctcaagaagcccctgctgatggcccggacgatccgcatcgccgcgaaggtggacaccagcggcgacccgtacaacaacttcagcacctccaaggagaacatcaccaagtgcatcaagatccagaagctccggtgcatcacgaagctgacccgcatcgagcacaactacatcctgtgcggcgacagcgagaagaagctctaccagtggcccgccaagcccaccatcgtggacgacaacgacgcctgcctgggggacaagcactgccacctccccttcatcccgatcggcaacgacgaggccatcaagaccgtcaactgctacgtggaggtgtacgagcagaaccccggggacatgaactcctaccagaagaagtgcgacgcgatgaacgtcggcacgtgcctcaccatcaagaacgagaactggcccatcgtgcagtgcaagaccgggaagtactactacgccgacggccgcatccacgccaaggacggcaccatcaacacgtactgcttcagcgagaagtgcaacgccgaccggtaccccatccaccaggactacatcaactcctgcaactggcaggagaccatcaaggacttccagcacgtgcgcgagttcgtccacctggacatcgagagctacaagaaggccatcgagtccgacatcaagaccgacctggtggtgcacaagttccggccggtcaagaacctcccccacgtgatccccatctacaagagcatcaccgtgcaggggacggagacctccgacggcatccagaacgcgttcatccaggggagcatgcccgccatctccggcctggccaacggctaccacctgttcaccccggacagcaagcagctgttcgacgtcgtgctgttcctgcgcaaggcctcctacaaggccgagtaccggaagatctacagcaccgggcccacgatcggcatcaacgtggagcacaacgagaagtgcaccgggtcctgccccaagaccatcgacaagaaggacaactggctcaccttcagcaaggagcacacgtcccagtggggctgcgaggagtacgggtgcctggcgatcaacaccggctgcgtcttcggcagctgccaggacatcatccgcccggagatcgacgtgtacaagatgcacggggccgagcggagcgtggtcgagctgtgcatcaccctcccccacgagacctactgcaacgacctggacgtgctggagcccatcatcggcgacaagatccaggccgccttccagacggtgcagtccaaccacatgccccgcctcatggccatcaagaacaacaaggcgttcaccgggcagatcaacgacctgggcagcaccgcctcctactgcgggagcgtccagaagttcaacgagaccatcatcggccagggcgacccgaagttcgactacgtgtgccacctcctgaagcggaaggacatcatcgtgcgccggtgctactccaacaactacgagagctgcaagctgctgacgccccgcgccgacatcatcgtcgacaagaagggggagtccctccaggccagcatcgtgggcctgaacctggggcagatgaacttcaagatcatgctcggcgacatcaactacaagcagtacaccgagtccaacaacctggaggcgaccgggcagtgcgtgggctgcgtcgactgcagcgaggacatcgtgtgcaacctgaagatcgagtcccagagcgagtccgtgtgcaacatcaagagcgactgcaacctctacctgtccagcatgctgatccagcccaccgtcggcgagtacaacctcaagatgtcctgcaacgccaagctggacaaggtgaacatcgagatctgcaagcagaagttcgtgctgcccctcaccatcaagagccacaaccagaagatcgacctgtccaagctggacgagagcaactacatccgggaggaggacctcaagtgcgacacgatgatctgcaaggtcaaggacgaggggctgagcttcatcaccaactccctgttcggcgggatcagctacttctggaagatcctcatctccagcctgatcgtgatcttcctgatcatcctcttctactacgtgggcctgccgatcctgcgcctcatcaaggactacctgaaggagaacgagctggagtacctcgccgaggggaagtga

SEQ ID NO: 12709 - RNA, 4257 nt, synthetic construct
  misc_feature 1..4257: note = derived and/or modified CDS sequence (opt1) from OROV/Perdoes virus(BeAn790177)__KP691628.1__GP
  source 1..4257: mol_type = other RNA
atgttcatccagttcaacctggccttcttctgcctcagcatcgtgtgcggccaccccctgaccaaggaccacatcggggaccgctgcttcgccggcgggaacctgttcaaggagatcacccagacgaccggcctctccgagatctgcatcaaggacgacatcagcatcatcaagtcccaggtcgagatcaagaagcagagctccgaggtgacctacgcggtgaagttctaccgggtctacctggtgaaggagtggagcgagtgcaacccgatccaggaccagcacgggtccatcatgatcctggacgtgaccaacacgggcctcatcgtccccaagatgtacacgtgccgcgccgcctgcgacatcaccctggacaaggacaacgccgaggtggtgttcatcagccagaagaacaacaactacgagctggccggcaccaccgtcatgcacgggtggttcaagaacgtggtgtccatcaagctcgagcacacgtgcgagcacctgaccgcgacctgcggccagaagaccgtcaagttccacgcctgcttccggcagcaccgcgcctgcgcccggttcctgaagaccacctacatgcccatcgtgatggtggagagcctctgctccaacctggagctggtcatcttcatcacctacatcttcgtgtgcctcgcgttcgccttcatcatcacgcgcacctacgtggcctacctgctgatccccgtcttctacccgttcacctacgcctacgggaagatgtacctcaagtgcgtgaagacctgccccaactgcctgctggccatgcaccccttcacgaactgcaccaacctctgcatctgcggcagccggttctccaacaccgagagcctgaaggtgcaccgcctggggaactgctacggctacaaggcgctctccggcgcccggagcatgtgcaagtccaaggtcagctccttcaccacggccatgttcttcgggatcatcatcctgagcttcatcgcgcccctgaacggcgagcgcctctacaagctgagcgagctgccggacgagtacatcgagatggagtccaccatcgaggggagcaagcagaaggagaccatcgtggacatcatcaactacaccgccctcgtgctgatcctgatcacgatcctcctgcagggcatcctggagaactacatcttccggctcaagttccgcttctgctccttctgcgacatgatccacatgaagaagaacctgaagatcttcagcaacatgaccaacaagtgcgggacctgcatctgcggcttcaaccaggagatccggtccggcttcgactacgaggtcttcatcaaggacatgcacgtgagccgcgagtcctgcaagtacaactaccacaagaactacagcttctacatcaagatgctgctcgtcgtgctgctggtgcccctcatcgggaccacggccgccgaggacaccaagtgcctgaagtacgacctgaacaagaacatcgaggacctcaaggactgctacggcctgaagctgaacatcgacaagcacgacaccgtcgagaacgcctacaagaacctcgtggaccagaagctggtgtccgagctggaccggctggacctcaacatcatgctggggagcaaggagtccatcttcgaggccatcgagaccagcatgaacatccaccagatggtcttcctggagtacctcgcctacaagacggaccccaagctgtccgagatcaagcagaacaccggcccctacaacatcgcgtggcgcaccttcatccacggcaacagcctggaggtgtgcgggaactacccgtacaagctcatctgctactgcatcaagcagaagacccactgcgagaactccaccgtggactacggcatccagatccagcccttctacaaccagcaccccaacagctacaagtccgacatggaggccctgatcaagacggtccagatcgccttccgggggatcatcaaggtgctgatccagtactacgtggagaacaacaagaccagcgagctctccaacctgctgaccgagctccgcaacgtcatgggcaacaacatccagatgaaggggatcctgaagtacctggagacctacctcaagaagcccctgctgatggcccggacgatccgcatcgccgcgaaggtggacaccagcggcgacccgtacaacaacttcagcacctccaaggagaacatcaccaagtgcatcaagatccagaagctccggtgcatcacgaagctgacccgcatcgagcacaactacatcctgtgcggcgacagcgagaagaagctctaccagtggcccgccaagcccaccatcgtggacgacaacgacgcctgcctgggggacaagcactgccacctccccttcatcccgatcggcaacgacgaggccatcaagaccgtcaactgctacgtggaggtgtacgagcagaaccccggggacatgaactcctaccagaagaagtgcgacgcgatgaacgtcggcacgtgcctcaccatcaagaacgagaactggcccatcgtgcagtgcaagaccgggaagtactactacgccgacggccgcatccacgccaaggacggcaccatcaacacgtactgcttcagcgagaagtgcaacgccgaccggtaccccatccaccaggactacatcaactcctgcaactggcaggagaccatcaaggacttccagcacgtgcgcgagttcgtccacctggacatcgagagctacaagaaggccatcgagtccgacatcaagaccgacctggtggtgcacaagttccggccggtcaagaacctcccccacgtgatccccatctacaagagcatcaccgtgcaggggacggagacctccgacggcatccagaacgcgttcatccaggggagcatgcccgccatctccggcctggccaacggctaccacctgttcaccccggacagcaagcagctgttcgacgtcgtgctgttcctgcgcaaggcctcctacaaggccgagtaccggaagatctacagcaccgggcccacgatcggcatcaacgtggagcacaacgagaagtgcaccgggtcctgccccaagaccatcgacaagaaggacaactggctcaccttcagcaaggagcacacgtcccagtggggctgcgaggagtacgggtgcctggcgatcaacaccggctgcgtcttcggcagctgccaggacatcatccgcccggagatcgacgtgtacaagatgcacggggccgagcggagcgtggtcgagctgtgcatcaccctcccccacgagacctactgcaacgacctggacgtgctggagcccatcatcggcgacaagatccaggccgccttccagacggtgcagtccaaccacatgccccgcctcatggccatcaagaacaacaaggcgttcaccgggcagatcaacgacctgggcagcaccgcctcctactgcgggagcgtccagaagttcaacgagaccatcatcggccagggcgacccgaagttcgactacgtgtgccacctcctgaagcggaaggacatcatcgtgcgccggtgctactccaacaactacgagagctgcaagctgctgacgccccgcgccgacatcatcgtcgacaagaagggggagtccctccaggccagcatcgtgggcctgaacctggggcagatgaacttcaagatcatgctcggcgacatcaactacaagcagtacaccgagtccaacaacctggaggcgaccgggcagtgcgtgggctgcgtcgactgcagcgaggacatcgtgtgcaacctgaagatcgagtcccagagcgagtccgtgtgcaacatcaagagcgactgcaacctctacctgtccagcatgctgatccagcccaccgtcggcgagtacaacctcaagatgtcctgcaacgccaagctggacaaggtgaacatcgagatctgcaagcagaagttcgtgctgcccctcaccatcaagagccacaaccagaagatcgacctgtccaagctggacgagagcaactacatccgggaggaggacctcaagtgcgacacgatgatctgcaaggtcaaggacgaggggctgagcttcatcaccaactccctgttcggcgggatcagctacttctggaagatcctcatctccagcctgatcgtgatcttcctgatcatcctcttctactacgtgggcctgccgatcctgcgcctcatcaaggactacctgaaggagaacgagctggagtacctcgccgaggggaagtga

SEQ ID NO: 12710 - RNA, 4284 nt, synthetic construct
  misc_feature 1..4284: note = derived and/or modified CDS sequence (opt1) from OROV/UTIV(BeAn84785)__KF697155.1__GP
  source 1..4284: mol_type = other RNA
atgttcctgatcttcatcctcatccagatcgccgccagcaccccgctgtccccgcagcaggtcggcgaccgctgcttcatcgggggcagcctgatcaaggagatcaaccagtccaccgggctcggcgaggtgtgcatcaaggacgacatcagcatcatcaagtccatcaacatccagaagaagatcagcaacgaccaggtgcagaacacggtgaagttctacaagacctacatcgcgcgggagtggcacgactgcaaccccatcttcgacgagcacgggtccttcatggtcttcgacatcagcaacaccggctccatcatccccaagatgcacacgtgccgcgcccagtgcgagatcaccctgaacaaggacaacgccgaggtgatcttcaccagcgccaagaccaaccactacgaggtgtccggcaccacgaccgtcaacgggtggttcaagcagaccatcagcgtgtccctggagcacacgtgcgagcacatcatcgccagctgcggccagaagtccctcaagttccacgcgtgcttccggcagcaccgcagctgcgtgcggttcttccgcaactcctacctgccctacaagatgatcgagagcctgtgcatcaacatcgagctcatcatcatcctgtgctacgccctgctctgcttcatcttcgcctacatcatcaccaagacctacatcgcctacctgctgatccccctcttctaccccatcacctacatctacgggaagatctacaacaagtacttcaagcggtgcaagtcctgcctgctggcggtccaccccctcaccaactgcaacaagacgtgcgtgtgcggctgccgcttcaacagcaccgaggccctgaaggtgcaccggctggggaaggactgcaacggcttcaaggccctcagcaaggcccgcttcctgtgcaagtccaccggccccagcttcaccatctgcttcctgacggggatgctcatcctgtccttcatcaccccgatcaacagcgagaagctgtacaagctcgaggagctgcccgacgactacatcaacctggagaaccagctctccgagtgcaacaacaacaagcagatcacccgggccctggcggtcgcctgcatcctgggcaacatcctcttcgtgctgttcttcaagttcatctacaacaagctgatcaacaacatctaccggacctgcaacctctgcaacatggtgcaccaccgcaagaacctgaagatctacagcgagttcacgaacaagtgcgggacctgcgtctgcggcttcaacgaggagatccgctccggcttcgactacgaggtgttcatcaaggacatgcacatcttccgggacaactgcctgttcaagttctacagcaagtactccatcatctacatctgcatcatcatcctcgtgatcaacctgcagctggggatgaccctcgccgaggagaccgagacgaactgcctgaacctgcccatcagcgcccagaccctcgacatcgtcaagtgctacggcctgaacctgaacatcaccgagaacaagcagaagtccgacctcatcagcgagctgaagtcccagaagaccatcacggaccacgacatccccgacttcaacatcatcgacatgaagaccgagagcgccttcgagaagatcgagaccgcggagaacatccaccgcatggccttcctggagtacatcctgtacaagatggagtccaagctcaacaccatcaagacgaacagcgggccgtacaacgtggcctggcggacctacatcaagtaccacaacctggacgcctgcggcaagtacccccacaagaccatctgcacgtgcatcaacgcccacctgtcctgcagccagcccaccgtggactccaacagcgagatcaagaccttctacagcaaccaccagtccgcgttcaagaacgacatcaacgtcctcatcgagaccatcagcatcgccttccgcgggatcatcaaggtgtccatcaacctgctgctcaagaacaacaagatcgacgagctgaaggagctgctcaccaacatcagcaagaagctggacaccaacatccagatgaagggcatcctcctcttcacggccgagcagctgaagacccaggagaccaccgtgaagtccatgcagcagacgcggatggccatcatcgtcaagcccctggagagcatgaccggcgacaagttcgacaacttctccaccaccaaccgcaacatcacgaagtgcaaggaggccaagagcctctcctgctacatgacccggaagaacagcatcaacaagtacctgctgtgcaacctcgacgggtacaagatcttctcctggccggagaagcccaccctgagcatcaacaacaacatctgcatcggcgactcccactgcaacctgtacttcaagcccatcctcaacgacgaggcgatcaagaccatcaactgctacaagggggacttcacgcccaacccgatggacatgggcagcgccatcaagaagtgcgaggccaaggagatcggggactgcctggtgggcgacaacaacatgtggcccatcatccagtgctccaacgagaagtactactacgccgacggcaagaaccacgcgaaggagggggacatcaacagctactgcctgtccgagaagtgcaacaccgaccgcttccccatccacaacgagtggttcaagagctgcaagtggatcagcaccatcaaggagtccatcagcgtcaaggagttcgtgcacctcgacatcgagtcctacaagaagggcatcgagagcgacatccgcaccgacctgatcatccacaagttccggcccgtgaagaacctgccgcacatcgcccccaagtacaagtccatcacgatcagcgggatcctcgtcgccgacggcatccagaacgccttcgtgtccggggagatgcccgccatcagcggcctgggcatcgggtacaacctgtactcccccgacggcaccaagctgttcgacatcgtgctgttcctgcgcaaggcgatctacaagagctcctacaagctcatctacaagaccgggccgaccatcggcatcaacgtcgagcacaacgagcagtgcacgggcagctgcccctccaccatccccaagcaggaggggtggctgaccttcagcaaggagcacacctcccagtggggctgcgaggagttcgggtgcctggccatcgacacgggctgcctctacgggagctgccaggacatcatccggccggagatgtccatctacaagatgctgggcgaggagatgaccagcatcgagatctgcctgaccacccccaaggagacgtactgcaacgacctcgacctgctggagcccctcatcggcgacaagatcgaggtgtccttccagaccgtgcagagcagccacatgcccaagatcatcgccgtcaagaacaacaaggtgtacaccgggcagatcaacgacatcggcaacaccgccaacatctgcgggtccgtgcagatcatcaacaagacggtcatcggccaggggaacccgaagttcgactacctgtgccacgccatgaagcgcaaggacgtgatcgtgcggaagtgctacgacaaccacttcgagacctgcaagctgctcgaggagcgcagcgagatcctgatcaaccagcagtccgacaccatcgcggccagcatgtccggcaagaacctgggcatcatgaacttcaagttcgccctcggggacatcgactacaagaccttcaccgaggacgccagcttcgacatcaagggccagtgcgtcgggtgcatcaactgcatcgaggagatcgtgtgcgagctgaacatcgtgtccacgagctccatcctgtgcaccatcaagaccccctgcgagaactaccacaacagcctcgagatcaaccccgccaccacgaagtaccacatcaagatgtcctgcccccacaacatcgacaagatgaagatcaccatctgcagcaaggacctggagatgccgctgaccctcaagcagcacgaccagaagatcgacctgtccaagctggacgagagcaactacatcaaggaggaggacctccggtgctccacctggctgtgcaaggtcaaggaggagggcatcgggttcatcttcagcggcatcttcggcaacttcgggaagtactggacgatcttcctgatcgtgctcgtgatcctggcgaccggcctgctcgggatcttcgtcatctacccctgctgcaagcgcctgcggggcttcctggagatcaacgacatcgcctacctcgccgagcagaagatgaagtga

SEQ ID NO: 12711 - RNA, 3231 nt, synthetic construct
  misc_feature 1..3231: note = derived and/or modified CDS sequence (opt1) from HRTV(TN)__KJ740147.1__GP
  source 1..3231: mol_type = other RNA
atgatcgtgcccatcgtcctgttcctcaccctgtgcccgagcgagctgtccgcctggggcagccccggggaccccatcgtgtgcggcgtgcgcaccgagacgaacaagtccatccagatcgagtggaaggaggggcggagcgagaagctctgccagatcgaccgcctgggccacgtcacctcctggctgcggaaccacagctccttccaggggctcgtgggccaggtgaagggccgccccagcgtctcctacttcccggagggggccagctacccccggtggtccggcctgctgagcccctgcgacgcggagtggctcgggatgatcgccgtgtccaaggccggcgacaccgacatgatcgtgcccgggccgacctacaagggcaagatcttcgtcgagcgccccacgtacaacggctacaaggggtggggctgcgccgacggcaagagcctgtcccacagcgggacctactgcgagaccgactccagcgtgtccagcggcctgatccagggggaccgggtgctctgggtcggcgaggtggtgtgccagcgcgggacccccgtccccgaggacgtgttcagcgagctggtgtccctgagccagtccgagttcccggacgtctgcaagatcgacggcgtggccctcaaccagtgcgagcaggagagcatcccccagcccctggacgtggcgtggatcgacgtcgggcggtcccacaaggtgctgatgcgcgagcacaagacgaagtgggtgcaggagagctccgccaaggacttcgtctgcttcaaggtgggccagggcccctgcagcaagcaggaggaggacgactgcatgtccaaggggaactgccacggcgacgaggtcttctgccggatggccgggtgcagcgcccgcatgcaggacaaccaggagggctgccggtgcgagctcctgcagaagccgggggagatcatcgtgaactacggcggcgtgtccgtccgcccgacctgctacgggttcagccggatgatggcgaccctggaggtgcacaagcccgaccgcgagctcaccggctgcacggggtgccacctggagtgcatcgagggcggggtgaagatcgtcaccctgacctccgagctccggagcgccaccgtgtgcgcctcccacttctgcgccagcgccaagggcggctccaagacgaccgacatcctgttccacaccggggcgctggtgggccccaacagcatccgcatcaccgggcagctcctggacggctccaagttcagcttcgacggccactgcatcttccccgacgggtgcatggccctggactgcacgttctgcaaggagttcctccggaacccccagtgctaccccgtcaagaagtggctgttcctggtggtggtcatcatgtgctgctactgcgccctcatgctgctgaccaacatcctccgcgccatcggcgtgtgggggacctgggtgttcgcccccatcaagctggcgctggccctcggcctgcggctggccaagctcagcaagaaggggctggtcgccgtggtgacccgcggccagatgatcgtcaacgacgagctgcaccagatccgcgtggagcggggcgagcagaacgaggggcgccagggctacgggccgcggggccccatccgccactggctctactcccccgccctgatcctgatcctcacgaccagcatctgctccgggtgcgacgagctggtgcacgcggagagcaagtccatcacgtgcaagagcgcctccggcaacgagaaggagtgcagcgtcaccggccgggccctgctgcccgccgtgaacccggggcaggaggcctgcctccacttctccatgcccggcagccccgactccaagtgcctgaagatcaaggtcaagagcatcaacctgcgctgcaagcaggcgtccagctactacgtgccggaggccaaggcccggtgcacctccgtgcgccggtgccgctgggccggggactgccagagcggctgccccacctacttctccagcaacagcttctccgacgactgggcgaaccggatggaccgcgccgggctcggcatgagcggctgctccgacgggtgcggcggggccgcctgcggctgcttcaacgccgcgcccagctgcatcttctggcggaagtgggtggagaacccctccaaccgcgtctggaaggtgagcccgtgcgcctcctgggtgctggccgccaccatcgagctgaccctccccagcggggaggtcaagacgctggagcccgtgaccggccaggccacccagatgttcaagggcgtggcgatcacctacctggggtccagcatcgagatcgtcggcatgacgcggctctgcgagatgaaggagatggggaccggcatcatggccctggccccctgcaacgacccgggccacgccatcatggggaacgtgggcgagatccagtgctccagcatcgagtccgccaagcacatccgcagcgacgggtgcatctggaacgcggacctggtgggcatcgagctccgggtcgacgacgccgtgtgcttctccaagctgaccagcgtggaggccgtcgccaacttctccaagatccccgcgaccatcagcggggtgcgcttcgaccagggcaaccacggcgagtcccggatctacgggagccccctggacatcacccgcgtgagcggcgagttctccgtcagcttccgcgggatgcggctcaagctgtccgagatcagcgcctcctgcacgggcgagatcaccaacgtgagcgggtgctactcctgcatgaccggcgccagcgtgtccatcaagctgcacagctccaagaacaccacgggccacctcaagtgcgacagcgacgagaccgccttctccgtcatggaggggacccacacctaccgcccccacatgagcttcgacaaggccgtgatcgacgaggagtgcgtgctgaactgcggcgggcactccagcaagctgctcctgaagggctccctggtcttcatggacgtgccgcggttcgtggacgggagctacgtccagacgtaccactccaaggtgcccgcgggcggccgcgtccccaaccccgtggactggctcaacgccctgttcggggacggcatcacccggtggatcctggggatcatcggcgtgctcctggcctgcgtcatgctgttcgtggtggtcgtggccatcacccgccggctcatcaagggcctgacccagcgcgccaaggtggcgtga

SEQ ID NO: 12712 - RNA, 3231 nt, synthetic construct
  misc_feature 1..3231: note = derived and/or modified CDS sequence (opt1) from HRTV(Patient2)__JX005844.1__GP
  source 1..3231: mol_type = other RNA
atgatcgtgcccatcgtcctgttcctcaccctgtgcccgagcgagctgtccgcctggggcagccccggggaccccatcgtgtgcggcgtgcgcaccgagacgaacaagtccatccagatcgagtggaaggaggggcggagcgagaagctctgccagatcgaccgcctgggccacgtcacctcctggctgcggaaccacagctccttccaggggctcatcggccaggtgaagggccgccccagcgtgtcctacttcccggagggggccagctacccccggtggtccggcctgctgagcccctgcgacgcggagtggctcgggctgatcgccgtctccaaggccggcgacaccgacatgatcgtgcccgggccgacctacaagggcaagatcttcgtggagcgccccacgtacaacggctacaaggggtggggctgcgccgacggcaagagcctgtcccacagcgggacctactgcgagaccgactccagcgtctccagcggcctcatccagggggaccgggtgctgtgggtgggcgaggtcgtgtgccagcgcgggacccccgtgcccgaggacgtcttcagcgagctggtgtccctcagccagtccgagttcccggacgtgtgcaagatcgacggcgtcgccctgaaccagtgcgagcaggagagcatcccccagcccctggacgtggcgtggatcgacgtggggcggtcccacaaggtcctcatgcgcgagcacaagacgaagtgggtgcaggagagctccgccaaggacttcgtgtgcttcaaggtcggccagggcccctgcagcaagcaggaggaggacgactgcatgtccaaggggaactgccacggcgacgaggtgttctgccggatggccgggtgcagcgcccgcatgcaggacaaccaggagggctgccggtgcgagctgctgcagaagccgggggagatcatcgtcaactacggcggcgtgtccgtgcgcccgacctgctacgggttcagccggatgatggcgaccctcgaggtccacaagcccgaccgcgagctgaccggctgcacggggtgccacctggagtgcatcgagggcggggtgaagatcgtgaccctcacctccgagctgcggagcgccaccgtctgcgcctcccacttctgcgccagcgccaagggcggctccaagacgaccgacatcctgttccacaccggggcgctcgtgggccccaacagcatccgcatcaccgggcagctgctggacggctccaagttcagcttcgacggccactgcatcttccccgacgggtgcatggccctcgactgcacgttctgcaaggagttcctgcggaacccccagtgctaccccgtgaagaagtggctgttcctcgtcgtggtgatcatgtgctgctactgcgccctgatgctgctcaccaacatcctgcgcgccatcggcgtctgggggacctgggtgttcgcccccatcaagctggcgctcgccctgggcctgcggctcgccaagctgagcaagaaggggctggtggccgtcgtgacccgcggccagatgatcgtgaacgacgagctccaccaggtccgcgtggagcggggcgagcagaacgaggggcgccagggctacgggccgcggggccccatccgccactggctgtactcccccgccctgatcctcatcctgacgaccagcatctgctccgggtgcgacgagctggtgcacgcggagagcaagtccatcacgtgcaagagcgcctccggcaacgagaaggagtgcagcgtcaccggccgggccctgctccccgccgtgaacccggggcaggaggcctgcctgcacttctccgtgcccggcagccccgactccaagtgcctgaagatcaaggtcaagagcatcaacctccgctgcaagcaggcgtccagctactacgtgccggaggccaaggcccggtgcacctccgtgcgccggtgccgctgggccggggactgccagagcggctgccccacctacttctccagcaacagcttctccgacgactgggcgaaccggatggaccgcgccgggctgggcatgagcggctgctccgacgggtgcggcggggccgcctgcggctgcttcaacgccgcgcccagctgcatcttctggcggaagtgggtcgagaacccctccaaccgcgtgtggaaggtgagcccgtgcgcctcctgggtcctggccgccaccatcgagctcaccctgcccagcggggaggtgaagacgctggagcccgtgaccggccaggccacccagatgttcaagggcgtcgcgatcacctacctcgggtccagcatcgagatcgtgggcatgacgcggctgtgcgagatgaaggagatggggaccggcatcatggccctggccccctgcaacgacccgggccacgccatcatggggaacgtgggcgagatccagtgctccagcatcgagtccgccaagcacatccgcagcgacgggtgcatctggaacgcggacctcgtcggcatcgagctgcgggtggacgacgccgtgtgcttctccaagctgaccagcgtcgaggccgtggccaacttctccaagatccccgcgaccatcagcggggtgcgcttcgaccagggcaaccacggcgagtcccggatctacgggagccccctcgacatcacccgcgtcagcggcgagttctccgtgagcttccgcgggatgcggctgaagctgtccgagatcagcgcctcctgcacgggcgagatcaccaacgtgagcgggtgctactcctgcatgaccggcgccagcgtctccatcaagctccacagctccaagaacaccacgggccacctgaagtgcgacagcgacgagaccgccttctccgtgatggaggggacccacacctaccgcccccacatgagcttcgacaaggccgtgatcgacgaggagtgcgtcctgaactgcggcgggcactccagcaagctcctgctgaagggctccctcgtgttcatggacgtgccgcggttcgtcgacgggagctacgtgcagacgtaccactccaaggtccccgcgggcggccgcgtgcccaaccccgtggactggctgaacgccctgttcggggacggcatcacccggtggatcctcgggatcatcggcgtcctgctggcctgcgtgatgctgttcgtggtcgtggtggccatcacccgccggctcatcaagggcctgacccagcgcgccaaggtcgcgtga

SEQ ID NO: 12713 - RNA, 3231 nt, synthetic construct
  misc_feature 1..3231: note = derived and/or modified CDS sequence (opt1) from HRTV(Patient1)__JX005845.1__GP
  source 1..3231: mol_type = other RNA
atgatcgcccccgtggtcctgttcttcaccctctgcccgagccagctgtccgcctggggcagccccggggaccccatcgtgtgcggcgtgcgcaccgagacgaacaagtccatccagatcgagtggaaggaggggcggagcgagaagctgtgccagatcgaccgcctcggccacgtcacctcctggctgcggaaccacagctccttccaggggctgatcggccaggtgaagggccgccccagcgtgtcctacttcccggagggggcgagctacccccggtggtccggcctcctgagcccctgcgacgccgagtggctggggctcatcgccgtctccaaggccggcgacaccgacatgatcgtgcccgggccgacctacaagggcaagatcttcgtggagcgccccacgtacaacggctacaaggggtggggctgcgccgacggcaagagcctgtcccacagcgggacctactgcgagaccgactccagcgtctccagcggcctgatccagggggaccgggtgctctgggtgggcgaggtcgtgtgccagcgcgggacccccgtgcccgaggacgtcttcagcgagctgatctccctgagccagtccgagttcccggacgtgtgcaaggtggacggcgtcgcgctcaaccagtgcgagcaggagagcatcccccagcccctggacgtggcctggatcgacgtggggcggtcccacaaggtcctgatgcgcgagcacaagacgaagtgggtgcaggagagctccgccaaggacttcgtgtgcttcaaggtcggccagggcccctgcagcaagcaggaggaggacgactgcatgtccaaggggaactgccacggcgacgaggtgttctgccggatggccgggtgcagcgcgcgcatgcaggacaaccaggagggctgccggtgcgagctcctgcagaagccgggggagatcatcgtcaactacggcggcgtgtccgtgcgcccgacctgctacgggttcagccggatgatggccaccctggaggtccacaagcccgaccgcgagctcaccggctgcacggggtgccacctggagtgcatcgagggcggggtgaagatcgtgaccctgacctccgagctccggagcgccaccgtctgcgcctcccacttctgcgccagcgcgaagggcggctccaagacgaccgacatcctgttccacaccggggccctggtgggccccaagagcatccgcatcaccgggcagctcctggacggctccaagttcagcttcgacggccactgcatcttccccgacgggtgcatggccctggactgcacgttctgcaaggagttcctccggaacccccagtgctaccccgtgaagaagtggctgttcctggtcgtggtggtcatgtgctgctactgcgccctcatgctgctgaccaacatcctccgcgccatcggcgtgtgggggacctgggtgttcgcgcccatcaagctggtcctggccctcggcctgcggctggccaagctcagcaagaaggggctggtggccgtggtcacccgcggccagatgatcgtgaacgacgagctgcaccagatccgcgtggagcggggcgagcagaacgaggggcgcctcggccacgggccgcggggccccgtccgccactggctgtactcccccgccctgatcctcatcctgacgaccagcatctgctccgggtgcgacgagctggtgcacgcggagagcaagtccatcacgtgcaagagcgcctccggcaacgagaaggagtgcagcgtgaccggccgggccctgctccccgccgtcaacccggggcaggaggcctgcctgcacttctccatgcccggcagccccgactccaagtgcctgaagatcaaggtcaagagcatcaacctccgctgcaagcaggcgtccagctactacgtgccggaggccaaggcccggtgcacctccgtgcgccggtgccgctgggccggggactgccagagcggctgccccacctacttctccagcaacagcttctccgacgactgggcgaaccggatggaccgcgccgggctgggcatgagcggctgctccgacgggtgcggcggggccgcctgcggctgcttcaacgccgcgcccagctgcatcttctggcggaagtgggtggagaacccctccaaccgcgtgtggaaggtcagcccgtgcgcctcctgggtgctggccgccatcatcgagctcaccctgcccagcggggaggtgaagaccctggagcccgtcacgggccaggccacccagatgttcaagggcgtggcgatcacctacctcgggtccagcatcgagatcgtgggcatgacccggctgtgcgagatgaaggagatggggacgggcatcatggccctggccccctgcaacgacccgggccacgccatcatggggaacgtcggcgagatccagtgctccagcatcgagtccgccaagcacatccgcagcgacgggtgcatctggaacgcggacctcgtgggcatcgagctgcgggtggacgacgccgtctgcttctccaagctgaccagcgtggaggccgtggccaacttctccaagatccccgcgatcatcagcggggtccgcttcgaccagggcaaccacggcgagtcccggatctacgggagccccctcgacatcaccaaggtgagcggcgagttctccgtgagcttccgcgggatgcgcctgaagctgtccgagatcagcgcctcctgcaccggcgagatcaccaacgtcagcgggtgctactcctgcatgacgggcgccagcgtgtccatcaagctccacagctccaagaacaccaccggccacctgaagtgcgacagcgacgagaccgccttctccgtgatggaggggacgcacacctaccggccccacatgagcttcgacaaggccgtcgtggacgaggagtgcgtgctgaactgcggcgggcactccagcaagctcctgctgaagggctccctcgtcttcatggacgtgccgcgcttcgtcgacgggagctacgtgcagacctaccactccaaggtgcccgcgggcggccgggtccccaaccccgtggactggctgaacgccctgttcggggacggcatcacccgctggatcctcgggatcatcggcgtgctgctggcctgcgtcctcctgttcgtggtggtcgtggccatcacgcggcgcctgatcaagggcctcacccagcgggccaaggtggcgtga

SEQ ID NO: 12714 - RNA, 3942 nt, synthetic construct
  misc_feature 1..3942: note = derived and/or modified CDS sequence (opt1) from PTV(PAN472868)__NC_027201.1__GP
  source 1..3942: mol_type = other RNA
atgatcttcaccatcctgaacgtgctcacccgcgccatgctggtcatgagcatgtactccctgacgacctgggacagcacctcccggaacgacatgtgcttcagcaacgacagccccctcgagggcctggtgtactactgggagacccacagcaagaagcacgactacaagaagcaggagtcccagcgctgccgggtgggggacagcgacaagaagatgatcacgaacgtcaccatcatctccctgatcagcgagatccagaagtccatcagcgagctctccctgagctgcggcaacgacgacaactccaccggccaggtgctgaccttcaacgggctcgaggacacgatccagggggactacatcgtggactgcgtcaccggcctgtaccagagcgacatcggcgtgggggtgggcctggggaagacccaccacgaccaccagcaggtcaagaacaaggccgtggtgatcgacgagaaggagcgcatgatctccttcctcgagacccagcagagcgagaacgacatcaagatgcaggtcctgatgtccgagatcgagcagctgaagaaccagctcagcaagaagcggaacgagcgcggccaggagaagcgggacgcggagaaggtgatgagcgacctgatggcccgcaactccgacctgcggaagcacaacgacatcctcacggccgagatcagccagatggagaacaacaacaccatccagcgcaacaagaacgtgatgtccaccaccgtcgtgccggccatcctgagcgtggccctgctctccagctccatcgcgcccatcatggccgccagccccgactcccccatgatcaacccgtggccccacgccaagaaccgggtcgggacgggcatgtacaagtacgacgagaacgacgacagcggctgccgccccatccggtacggggtgtcctgcatcggcttcgacttcatgctgaagatggacaagtaccccttcttcaacgcgttcatcgggcacaagaccccgctggagagcttcgccgacaagatcatcgagaaggaggaggagacctgcgagatcggcaccaacaaggagttcaagtgcttcgaggagcgcgcctacatcaagggcacgtgccccaccaacatcaacgccgtgcactacatcgacaacaaggggaagctccggtacgtcaagtgcaaggagaacctggagatgaccgaggactgcgccttctgccgcaagatcaagaagaaggcgggccagtccatccaggtgcagaagaccagcgtgcccctgcaggacgccatctgccaggagaactccgacacgtacagcgggcccaagatcccgttcaagggcgtctgcaagatcgggctcatcaagtacaaggagtgcaagttcaagacctccagctacgagaccgtgtccttcatcaccctgaaggagaagggcaagatctacatcgagcacctgatgctcaagaacatcgaggtcgtgacgaacgtgagcttcgtctgctacgagcacgccggccaggacgagcaggaggtggagcaccgggccctgaagcgcgtgagcgtcaacgactgcaagatcgtggacaactccaagcagaagatctgcaccggggaccacatcttctgcgagaagtacgactgcagcacctcctaccccgacgtgacctgcatccacgcccccggcagcgggcccctgtacatcaacctcatgggctcctggatcaagccgcagtgcgtcgggtacgagcgggtgctggtggaccgcgaggtcaagcagcccctgctcgcgcccgagcagaactgcgacacgtgcgtgagcgagtgcctggacgagggcgtgcacatcaagtccaccggcttcgagatcaccagcgccgtcgcctgctcccacgggagctgcatctccgcccaccaggaggccagcacctccgtgatcgtgccctacccgggcctgctcgcgagcgtcgggggccggatcgggatccacctgtcccacacgagcgactccgccagcgtgcacatggtggtcgtgtgcccgccccgcgacagctgcgccgcccacaactgcctgctctgctaccacggcatcctgaactaccagtgccactccaccctgagcgccatcctcacctccttcctgctgatcctcttcatctacaccgtgttcagcgtcaccacgaacatgctgtacgtgctgcgcctgatccccaagcagctcaagtcccccgtgggctggctgcggctgttcatcaactggctcctgaccgcgctgcgcatcaagacccggaacgtcatggggcgcatcaaccagcggatcggctgggtggaccaccacgacgtggagcgcccccggcaccgcgagcccatgcggcgcttcaagaccacgctcctgctgaccctcatcatgatgaccgggggcaacgcctgcagcaacaccgtcgtggccaactccaagcagacgcggtgcgtgcaggagggcagctccaccaagtgcagcatcaccgccaccatcacgctgcgcgcgggggtcatcggcgccgagtcctgcttcatcatcaaggggcccatggagaaccagcagaagaccatcagcatcaagaccatctccagcgagaccgtgtgccgggagggctccagcttctggacgtccctgtacatcccgagctgcctctccagccgccggtgccacctggtgggggactgcgtcggcaacaagtgccagagctggcgcgacgaccagctgtcccgggagttcagcggcgtgaaggacaaccacatcatgaacgagaacaagtgcttcgagcagtgcggggccatcggctgcgggtgcttcaacatcaacccctcctgcctctacgtgcacgcctacctgaagtccgcccgcaacgaggcggtccgggtgttctcctgcagcgactgggtgcaccgcgtctccttcgaggtgaagggccccgacggggagaccgagctggtgaccctcggcagcctgggcaccaagttcctgaactgggggacgctctccctgagcctggacgccgagggcatctccgggaccaacagcatctccttcctcgagagctccaagggcgggttcgccctgtacgacgagggctacagcgagatcccgcgcgagggcttcctgggggagatccggtgctccagcgagtccgccgccatcagcgcgcacaagagctgcatccgcgcccccggcctcatcaagtacaagcccatgaccgaccagatcgagtgcaccgcctccctggtcgaccccttcgccatcttcctgaaggggagcctcccgcagacgcggaacggccagaccttcacctccaccaaggacaagaagacggtgcaggccttcaccaacggggcgatcaaggccctgctgagcatcaacctcgacgaccacgagatcgtgttcatcaacaaggtccgctcctgcgacgccaccttcctgaacgtgagcggctgctactcctgcgactacggcgcccacgtgtgcgtcaaggtcaagagctccgagagcgcggacttcttcgccgagtccgaggacaagaccacggtgctgagcttccccatccagtccgggacccacgactactgccaggtgctccacttccagaagcccctggtggacgagcggctgagctactcctgcggcagcgagcccaagctcatcgtcatcaaggggaccctggtgtacatgggcgtgtacgacttccgcaacaagaccggcgggtccagcacggtcgtgaacccgtccgagggcgcctggagcatcagcaactggttctccgggctgctcgactggctgggcgggcccatgaaggccatcctgaagatcctcggcttcatcgccatcggcatcgtgtgcttcatcctgttcatgatcctgatccggatcgcggtcaacagcatcaacatcaagaagaagaactga

SEQ ID NO: 12715 - RNA, 3942 nt, synthetic construct
  misc_feature 1..3942: note = derived and/or modified CDS sequence (opt1) from PTV(Adames)__KR912209.1__GP
  source 1..3942: mol_type = other RNA
atgatcttcaccatcctgaacgtgctcacccgcgccatgctggtcatgagcatgtactccctgacgacctgggacagctccagccggaacgacatctgcttctccaacgacagccccctcgagggcctggtgtactactgggagacccactccaagaagcacgactacaagaagcaggggagccagaagtgccgcgtgggcgactccgacaagaagatgatcagcaacgtcaccatcatctccctgatcagcgagatccagaagtccatcagcgagctctccctgagctgcgggaacaacgacaactccacgggccaggtgctgaccttcaacgggctcgaggacaccatccggggcgactacatcgtggactgcgtcaccggcctgtaccagagcgacatcggggtgggcgtggggctgggccgcatcaaccacgaccaccagcaggtcaagaacaaggccgtggtgatcgacgagaaggagaagatgatctccctcctggagacgcagcagagcgagaacgacatcaagacccaggtcctgatgagcgagatcgagcagctcaagaaccagctgtccaagcggcgcaacgagcgggggcaggagaagcgcgacgcggagaagctgatgagcgacctcatggcccggaactccgacctgcgcaaccacaacgtgatcctgaccgacgagatcagccagatcaagaacaacatcaccatccaccggaaccgcaacatgatgtccacgaccgtggtcccggccatcctcagcgtggccctgctgtccagctccgtgggccccatcaccgccgcgccgcccgacagcaccatgatcaacccctggccccacgccaagaaccgggtcggcacggggatgtacaagtacgacgagaacgacgagtccggctgccgccccatccggtacggggtgagctgcatcggcttcgacttcatgctcaagatggacaagtaccccttcttcaacgccttcatcggccacaagaccccgctggagtccttcgccgacaagatcatcgagaaggaggaggagacctgcgagatcgggaccaacaaggagttcaagtgcttcgaggagcgcgcgtacatcaagggcacgtgccccaccaacatcaacgccgtgcactacatcgacaacaaggggaagctgcggtacgtcaagtgcaaggagaacctcgagatgaccgaggactgcgccttctgccgcaagatcaagaagaaggccggccagagcgtccaggtgcagaagacctccgtgcccctgcaggacgccatctgccaggagaacagcgacatctactccgggcccaagatcccgttcaagggcgtgtgcaagatcggcctgatcaagtacaaggagtgcaagttcaagacgagctcctacgagaccatcagcttcatcaccctcaaggggaagggcaagatctacatcgagcacctgatgctgaagaacatcgaggtcgtgaccaacgtgagcttcgtctgctacgagcacgcggggcaggacgagcaggaggtggagcaccgggccctcaagcgcgtgtccgtcaacgactgcaagatcgtggacaacagcaagcagaagatctgcacgggcgaccacatcttctgcgagaagtacgactgctccaccagctaccccgacgtgacctgcatccacacccccgggtccggccccctgtacatcaacctgatgggcagctggatcaagccgcagtgcgtcgggtacgagcgggtgctcgtggaccgcgaggtcaagcagcccctgctggtgcccgagcagaactgcgacacgtgcgtgtccgagtgcctcgacgagggcgtccacatcaagagcaccgggttcgagatcacctccgccgtggcctgcagccacggctcctgcatcagcgcccaccaggaggcgtccaccagcgtgatcatcccctacccggggctgctggcctccgtcggcggccgcatcgggatccacctcagccacacgtccgacagcgccagcgtgcacatggtggtcgtgtgcccgccccgggactcctgcgccgcccacaactgcctgctgtgctaccacggcatcctcaactaccagtgccacagcaccctgtccgcgatcctgaccagcttcctcctgatcctgttcatctacaccgccttctccgtgaccacgaacgtcctgtacgtgctccgcctgatccccaagcagctcaagagccccgtggggtggctgaagctgttcgtcaactggctgctcaccgccctgcggatcaagacccgccgggtgatgggccgcatcaaccagcggatcggctgggtggaccaccacgacgtcgagcgcccccggcaccgcgagcccatgcggcgcttcaagaccacgctgctcctgaccctgatcatggtgaccgggggcaacgcctgctccaacaccgtggtcgccaacagcaagcagacgcggtgcgtgcaggaggggtccaacaccaagtgcagcatcaccgcgaccatcacgctccgcgccggcgtgatcggggccgagtcctgcttcatcatcaagggccccatggagaaccagcagaagaccatcagcatcaagaccatctccagcgagaccgtctgccgggagggctccagcttctggacgtccctgtacatcccgagctgcctgtccagccgccggtgccacctcgtgggggactgcgtgggcaacaagtgccagagctggcgcgacgaccagctgtcccgggagttcagcggggtcaaggacaaccacatcatgaacgagaacaagtgcttcgagcagtgcggcgccatcgggtgcggctgcttcaacatcaacccctcctgcctgtacgtgcacgcgtacctcaagagcgcccgcaacgaggccgtgcgcgtcttctcctgcagcgactgggtgcaccgggtgtccttcgaggtcaagggccccgacggggagatggagctggtgaccctgggcagcctcgggaccaagttcctgaactggggcaccctgtccctcagcctggacgccgaggggatctccggcacgaacagcatctccttcctggagagctccaagggcgggttcgccctctacgacgagggctacagcgagatcccgcgcgaggggttcctgggcgagatccggtgctccagcgagtccgcggccatcagcgcccacaagagctgcatccgcgcccccgggctgatcaagtacaagcccatgaccgaccagatcgagtgcaccgcctccctcgtggaccccttcgcgatcttcctgaagggcagcctgccgcagacccggaacggccagacgttcacctccaccaaggacaagaagaccgtccaggccttcacgaacggggccatcaaggccctcctgagcatcaacctggacgaccacgagatcatcttcatcaacaaggtgaagtcctgcgacgccaccttcctcaacgtgagcggctgctactcctgcgactacggggcgcacgtctgcgtgaaggtcaagagctccgagagcgccgacttcttcgccgagtccgaggacaagaccaccgtgctgagcttccccatccagtccggcacgcgcgactactgccaggtgctgcacttccagaagcccctcgtcgacgagcggctgagctactcctgcggcagcgagcccaagctgatcgtgatcaaggggaccctcgtgtacatgggcgtctacgacttccgcgacaagaccgggggctccagcaccgtgatcaacccgtccgaggggacgtggagcatcagcaactggttctccggcctgctggactggctcggcgggcccatgaaggccatcctgaagatcctgggcttcatcgcgatcgggatcgtgtgcttcatcctcttcatgatcctgatccggatcgccgtcaacagcatcaacatcaagaagaagaactga

SEQ ID NO: 12716 - RNA, 3942 nt, synthetic construct
  misc_feature 1..3942: note = derived and/or modified CDS sequence (opt1) from PTV(Balliet)__KR912213.1__GP
  source 1..3942: mol_type = other RNA
atgatcttcaccatcctgaacgtgctcacccgcgccatgctggtcatgagcatgtactccctgacgacctgggacagcacctcccggaacgacatgtgcttcagcaacgacagccccctcgagggcctggtgtactactgggagacccacagcaagaagcacgactacaagaagcaggagtcccagcgctgccgggtgggggacagcgacaagaagatgatcacgaacgtcaccatcatctccctgatcagcgagatccagaagtccatcagcgagctctccctgagctgcggcaacgacgacaactccaccggccaggtgctgaccttcaacgggctcgaggacacgatccgcggggactacatcgtggactgcgtcaccggcctgtaccagagcgacatcggcgtgggggtgggcctggggcggacccaccacggccaccagcagatgaagaacaaggccgtcgtgatcgacgagaaggagcgcatgatctccctcctggagacccagcagagcgagaacgacatcaagatgcaggtcctgatgtccgagatcgagcagctcaagaaccagctgagcaagaagcggaacgagcgcgggcaggagaagcgggacgcggagaaggtgatgagcgacctgatggcccgcaactccgacctccggaagcacaacgacatcctgacggccgagatcagccagatgaagaacaagaacaccatccagcgcaacaagaacaccgtgtccaccacggtggtcccggccatcctgagcgtggccctcctgtccagctccgtggcgcccatcatcgccgccccgcccgacagccccatgatcaacccctggccccacgccaagaaccgggtcggcaccggcatgtacaagtacgacgagaacgacgactccgggtgccgccccatccggtacggcgtgagctgcatcgggttcgacttcatgctgaagatggacaagtacccgttcttcaacgcgttcatcggccacaagacgcccctcgagtccttcgccgacaagatcatcgagaaggaggaggagacctgcgagatcggcaccaacaaggagttcaagtgcttcgaggagcgcgcctacatcaaggggacctgccccaccaacatcaacgccgtgcactacatcgacaacaagggcaagctgcggtacgtcaagtgcaaggagaacctggagatgaccgaggactgcgccttctgccgcaagatcaagaagaaggcggggcagagcgtccaggtgcagaagacgtccgtgcccctccaggacgccatctgccaggagaacagcgacacctactccggcccgaagatccccttcaagggggtgtgcaagatcggcctgatcaagtacaaggagtgcaagttcaagaccagctcctacgagaccgtcagcttcatcacgctgaaggagaagggcaagatctacatcgagcacctcatgctgaagaacatcgaggtggtgaccaacgtctccttcgtgtgctacgagcacgtggggcaggacgagcaggaggtcgagcaccgggccctgaagcgcgtgagcgtgaacgactgcaagatcgtcgacaacagcaagcagaagatctgcaccggcgaccacgtgttctgcgagaagtacgactgctccaccagctaccccgacgtgacgtgcatccacgcccccgggtccggcccgctctacatcaacctgatggggagctggatcaagccccagtgcgtcggctacgagcgggtgctggtggaccgcgaggtcaagcagcccctcctggcccccgagcagaactgcgacacgtgcgtgtccgagtgcctggacgagggcgtgcacatcaagagcaccgggttcgagatcacctccgcggtcgcctgcagccacggctcctgcatcagcgcccaccaggagccgtccaccagcgtgatcgtgccctaccccgggctcctggcctccgtcggcgggcgcatcggcatccacctgagccacacctccgacagcgcctccgtgcacatggtggtcgtgtgcccgccccgggacagctgcgcggcccacaactgcctcctgtgctaccacggcatcctgaactaccagtgccacagcaccctctccgccatcctgaccagcttcctgctcatcctgttcatctacaccgtgttctccgtcacgaccaacatcctgtacgtgctgcgcctcatccccaagcagctgaagtcccccgtggggtggctgaagctgttcatcaactggctgctgaccgccctccggatcaagacccgcaacgtcatgcggcgcatcaaccagcggatcggctgggtggaccaccacgacgtggagcgcccccggcaccgcgagccgatgcggcgcttcaagacgaccctgctgctcaccctgatcatgatgaccgggggcaacgcctgctccaacacggtcgtggcgaacagcaagcagacccggtgcgtgcaggagggctccaacaccaagtgcagcatcaccgccacgatcaccctgcgcgccggggtcatcggcgccgagtcctgcttcatcatcaaggggcccatggagaaccagcagaagaccatcagcatcaagaccatctccagcgagacggtgtgccgggagggctccagcttctggacctccctctacatccccagctgcctgtccagccgccggtgccacctggtgggggactgcgtcggcaacaagtgccagtcctggcgcgacgaccagctcagccgggagttcagcggcgtgaaggacaaccacatcatgaacgagaacaagtgcttcgagcagtgcggggcgatcggctgcgggtgcttcaacatcaacccgtcctgcctgtacgtgcacgcctacctcaagagcgcccgcaacgaggccgtccgcgtgttctcctgcagcgactgggtgcaccgggtctccttcgaggtgaagggccccgacggggagaccgagctcgtgaccctgggcagcctgggcacgaagttcctcaactgggggaccctgtccctgagcctcgacgccgagggcatctccgggaccaacagcatctccttcctggagagctccaagggcgggttcgcgctgtacgacgagggctacaacgagatcccccgcgagggcttcctcggggagatccggtgcagctccgagagcgccgccatctccgcccacaagagctgcatccgcgcccccggcctgatcaagtacaagccgatgaccgaccagatcgagtgcacggcgtccctggtcgaccccttcgccatcttcctcaaggggagcctgccccagacccggaacggccagaccttcaccagcacgaaggacaagaagaccgtgcaggccttcaccaacggggccatcaaggccctgctctccatcaacctggacgaccacgagatcgtgttcatcaacaaggtcaagaactgcgacgcgaccttcctgaacgtgagcggctgctactcctgcgactacggcgcccacgtctgcgtgaaggtcaagagctccgagagcgccgacttcttcgccgagtccgaggacaagacgaccgtgctcagcttccccatccagtccgggacccacgactactgccaggtgctgcacttccagaagccgctggtggacgagcgcctcagctactcctgcggcagcgagcccaagctgatcgtcatcaaggggaccctggtgtacatgggcgtgtacgacttccggaacaagacgggcgggtccagcaccgtcgtgaacccctccgagggcgcgtggagcatctccaactggttcagcgggctcctggactggctgggcgggcccatgaaggccatcctcaagatcctgggcttcatcgccatcggcatcgtgtgcttcgtcctgttcatgatcctcatccgcatcgccgtgaactccatcaacatcaagaagaagaactga

SEQ ID NO: 12717 - RNA, 3942 nt, synthetic construct
  misc_feature 1..3942: note = derived and/or modified CDS sequence (opt1) from PTV(PaAR2381)__KP272005.1__GP
  source 1..3942: mol_type = other RNA
atgatcttcaccatcctgaacatcctcacccgcgccatgctggtgatgagcatgtactccctgacgacctgggacagcacctcccggaacgacatgtgcttcagcaacgactcccccctcgagggcctggtctactactgggagacccacagcaagaagcacgactacaagaagcaggagtcccagaagtgccgcgtgggggacagcgacaagaagatgatctccaacgtgacgatcatcagcctgatctccgagatccagaagagcatctccgagctcagcctgtcctgcggcaacgacgacaacagcaccgggcaggtcctgaccttcaacggcctcgaggacaccatccggggggactacatcgtggactgcgtgacgggcctgtaccagtccgacatcggcgtcggggtgggcctggggcgcacccaccacgaccaccaccaggtgaagaacaaggccgtcgtgatcgacgagaaggagcggatgatcagcctcctggagacccagcagtccgagaacgacatcaagatgcaggtgctgatgagcgagatcgagcagctcaagaaccagctgagccgcaagcggaacgagcgcggccaggagaagcgggacgcggagaaggtcatgtccgacctgatggcccgcaacagcgacctccggaagcacaacgacatcctgaccgccgagatctcccagatgaagtacaacaacacgatccagcgcagcaagaacgtgatgtccaccaccgtggtcccggccatcctgagcgtggccctcctgtccagctccgtggcgcccatcatggccgccccccccgacagcccgatgatcaacccctggccccacgccaagaaccgggtcgggaccggcatgtacaagtacgacgacaacgacgactccggctgccgccccatccggtacggggtgagctgcatcggcttcgacttcatgctgaagatggacaagtacccgttcttcaacgcgttcatcgggcacaagacgcccctcgagtccttcgccgacaagatcatcgagaaggaggaggagacctgcgagatcggcaccaacaaggagttcaagtgcttcgaggagcgcgcctacatcaagggcacctgccccacgaacatcaacgccgtgcactacatcgacaacaaggggaagctgcggtacgtcaagtgcaaggagaacctggagatgaccgaggactgcgccttctgccgcaagatcaagaagaaggcgggccagagcgtgcaggtgcagaagacctccgtccccctccaggacgccatctgccaggagaacagcgacaactactccgggccgaagatccccttcaagggcgtgtgccggatcgggctgatcaagtacaaggagtgcaagttcaagaccagctcctacgagacggtcagcttcatcaccctgaaggagaagggcaagatctacatcgagcacctcatgctgaagaacatcgaggtggtgaccaacgtcagcttcgtgtgctacgagcacgccggccaggacgagcaggaggtggagcaccgcgccctgaagcgggtctccgtgaacgactgcaagatcgtggacaacagcaagcagaagatctgcaccggggaccacgtcttctgcgagaagtacgactgctccacgagctaccccgacgtgacctgcatccacgcccccggctccgggccgctctacatcaacctgatgggcagctggatcaagccccagtgcgtggggtacgagcgcgtcctggtggaccgcgaggtgaagcagcccctcctggcgcccgagcagaactgcgacacctgcgtctccgagtgcctggacgagggcgtgcacatcaagagcaccggcttcgagatcacgtccgccgtggcctgcagccacgggtcctgcatcagcgcccaccaggaggcctccaccagcgtcatcgtgccgtaccccggcctcctggcgtccgtggggggccggatcgggatccacctgagccacacctccgacagcgccagcgtccacatggtggtggtctgccccccccgcgactcctgcgaggcccacaactgcctcctgtgctaccacggcatcctgaactaccagtgccacagcaccctctccgccatcctgacgagcttcctgctcatcctgttcatctacaccgtgttctccgtgaccaccaacatgctgtacgtcctgcggctcatcccgaagcagctgaagagccccgtgggctggctgaagctcttcatcaactggctgctgaccgccctccgcatcaagacgcggaacgtgatggggcgcatcaaccagcggatcggctgggtcgaccaccacgacgtggagcgcccccggcaccgcgagcccatgcggcgcttcaagaccaccctgctgctcaccctgatcatgatgacggggggcaacgcgtgctccaacaccgtggtcgccaacagcaagcagacccggtgcgtgcaggagggctccaacaccaagtgcagcatcacggccaccatcaccctgcgcgccggggtgatcggcgcggagtcctgcttcatcatcaaggggccgatggagaaccagcagaagaccatcagcatcaagacgatctccagcgagaccgtctgccgggagggctccagcttctggacctccctctacatccccagctgcctgtccagccgccggtgccacctggtgggggactgcgtgggcaacaagtgccagagctggcgcgacgaccagctctcccgggagttcagcggcgtcaaggacaaccacatcatgaacgagaacaagtgcttcgagcagtgcggggccatcggctgcgggtgcttcaacatcaacccctcctgcctgtacgtgcacgcctacctgaagagcgcccgcaacgaggccgtgcgcgtcttctcctgcagcgactgggtgcaccgggtgtccttcgaggtcaagggcccggacggggagaccgagctcgtgacgctgggcagcctgggcaccaagttcctcaactgggggaccctgtccctgagcctcgacgcggagggcatctccgggaccaacagcatctccttcctggagagctccaagggcgggttcgccctgtacgacgagggctacagcgagatcccccgcgagggcttcctcggggagatccggtgctccagcgagtccgccgccatcagcgcccacaagagctgcatccgcgcgcccggcctgatcaagtacaagcccatgacggaccagatcgagtgcaccgcctccctggtggacccgttcgccatcttcctcaaggggagcctgccccagacccggaacggccagaccttcacgtccaccaaggacaagaagaccgtccaggccttcaccaacggggccatcaaggcgctgctcagcatcaacctggacgaccacgagatcgtgttcatcaacaaggtgaagtcctgcgacgccacgttcctgaacgtcagcggctgctactcctgcgactacggcgcccacgtgtgcgtcaaggtgaagagctccgagagcgccgacttcttcgcggagtccgaggacaagaccaccgtgctcagcttccccatccagtccgggacccacgactactgccaggtcctgcacttccagaagcccctggtggacgagcgcctcagctactcctgcggcagcgagccgaagctgatcgtgatcaaggggacgctggtctacatgggcgtgtacgacttccggaacaagaccggcgggtccagcaccgtggtcaacccctccgagggcgcctggagcatcagcaactggttctccgggctcctggactggctgggcgggcccatgaaggccatcctcaagatcctgggcttcatcgccatcggcatcgtgtgcttcatcctgttcatgatcatgatccgcatcgccgtgaacagcatcaacatcaagaagaagaactga

SEQ ID NO: 12718 - RNA, 3942 nt, synthetic construct
  misc_feature 1..3942: note = derived and/or modified CDS sequence (opt1) from PTV(PAN483391)__KP272008.1__GP
  source 1..3942: mol_type = other RNA
atgatcttcaccatcctgaacatcctcacccgcgccatgctggtgatgagcatgtactccctgacgacctgggacagcacctcccggaacgacatgtgcttcagcaacgacagccccctcgagggcctggtctactactgggagacccactccaagaagcacgactacaagaagcaggagtcccagcgctgccgggtgggggacagcgacaagaagatgatcacgaacgtgaccatcatctccctgatcagcgagatccagaagtccatcagcgagctctccctgagctgcggcaacgacgacaactccaccgggcaggtcctgaccttcaacggcctcgaggacacgatccgcggggactacatcgtggactgcgtgaccggcctgtaccagagcgacatcggcgtcggggtgggcctggggcggacccaccacgaccaccagcaggtcaagaacaaggccgtcgtgatcgacgagaaggagcgcatgatctccctcctggagacccagcagagcgagaacgacatcaagatgcaggtcctgatgtccgagatcgagcagctcaagaaccagctgagcaagaagcggaacgagcgcggccaggagaagcgggacgcggagaaggtgatgagcgacctgatggcccgcaactccgacctccggaagcacaacgacatcctgacggccgagatcagccagatgaagtacgacaacaccatccagcgcaacaagaacgtgatgtccaccaccgtggtcccggccatcctgagcgtggccctcctgtccagctccatcgcgcccatcatggccgccagccccgactcccccatgatcaacccgtggccccacgccaagaaccgggtggggacgggcatgtacaagtacgacgagaacgacgacagcggctgccgccccatccggtacggggtctcctgcatcggcttcgacttcatgctgaagatggacaagtaccccttcttcaacgcgttcatcgggcacaagaccccgctcgagagcttcgccgacaagatcatcgagaaggaggaggagacctgcgagatcggcaccaacaaggagttcaagtgcttcgaggagcgcgcctacatcaagggcacgtgccccaccaacatcaacgccgtgcactacatcgacaacaaggggaagctgcggtacgtgaagtgcaaggagaacctggagatgaccgaggactgcgccttctgccgcaagatcaagaagaaggcgggccagtccgtccaggtgcagaagaccagcgtgcccctccaggacgccatctgccaggagaactccgacacgtacagcgggcccaagatcccgttcaagggcgtctgcaagatcgggctgatcaagtacaaggagtgcaagttcaagacctccagctacgagaccgtgtccttcatcaccctgaaggagaagggcaagatctacatcgagcacctcatgctgaagaacatcgaggtcgtgacgaacgtgagcttcgtctgctacgagcacgccggccaggacgagcaggaggtggagcaccgggccctgaagcgcgtgagcgtcaacgactgcaagatcgtggacaactccaagcagaagatctgcaccggggaccacgtgttctgcgagaagtacgactgcagcacctcctaccccgacgtgacctgcatccacgcccccggcagcgggcccctctacatcaacctgatgggctcctggatcaagccgcagtgcgtggggtacgagaaggtgctggtcgaccgggaggtgaagcagcccctcctggcgcccgagcagaactgcgacacgtgcgtgagcgagtgcctggacgagggcgtccacatcaagtccaccggcttcgagatcaccagcgccgtggcctgctcccacgggagctgcatctccgcccaccaggaggccagcacctccgtgatcgtcccctacccgggcctcctggcgagcgtcgggggcaagatcgggatccacctgtcccacacgagcgactccgccagcgtgcacatggtggtggtgtgcccgccccgcgacagctgcgccgcccacaactgcctcctgtgctaccacggcatcctgaactaccagtgccactccaccctcagcgccatcctgacctccttcctgctcatcctgttcatctacaccgtcttcagcgtgaccacgaacatgctgtacgtgctgcgcctcatccccaagcagctgaagtcccccgtcggctggctgcgcctcttcatcaactggctgctgaccgcgctccggatcaagacccggaacgtgatggggcgcatcaaccagcggatcggctgggtggaccaccacgacgtcgagcgcccccggcaccgcgagcccatgcggcgcttcaagaccacgctgctgctcaccctgatcatgatgaccgggggcaacgcctgcagcaacaccgtggtggccaactccaagcagacgcggtgcgtccaggagggcagcaacaccaagtgctccatcaccgccaccatcacgctgaaggcgggggtgatcggcgccgagagctgcttcatcatcaaggggcccatggagaaccagcagaagaccatctccatcaagaccatcagctccgagaccgtgtgccgcgagggcagctccttctggacgagcctctacatcccgtcctgcctgagctcccggcgctgccacctggtcggggactgcgtgggcaacaagtgccagagctggcgggacgaccagctcagccgcgagttctccggcgtgaaggacaaccacatcatgaacgagaacaagtgcttcgagcagtgcggggccatcggctgcgggtgcttcaacatcaaccccagctgcctgtacgtccacgcctacctgaagtccgcccggaacgaggcggtgcgcgtgttcagctgctccgactgggtccaccgggtgagcttcgaggtgaagggccccgacggggagaccgagctcgtcaccctgggctccctgggcaccaagttcctcaactgggggacgctgagcctgtccctcgacgccgagggcatcagcgggaccaactccatcagcttcctggagtccagcaagggcgggttcgccctgtacgacgagggctactccgagatcccgcgcgagggcttcctcggggagatccgctgcagctccgagagcgccgccatctccgcgcacaagagctgcatccgggcccccggcctgatcaagtacaagcccatgaccgaccagatcgagtgcaccgccagcctggtggaccccttcgccatcttcctcaaggggtccctgccgcagacgcgcaacggccagaccttcaccagcaccaaggacaagaagacggtgcaggccttcaccaacggggcgatcaaggccctgctctccatcaacctggacgaccacgagatcgtcttcatcaacaaggtgcggagctgcgacgccaccttcctgaacgtgtccggctgctacagctgcgactacggcgcccacgtctgcgtgaaggtcaagtccagcgagtccgcggacttcttcgccgagagcgaggacaagaccacggtgctctccttccccatccagagcgggacccacgactactgccaggtgctgcacttccagaagcccctggtcgacgagcgcctctcctacagctgcggctccgagcccaagctgatcgtgatcaaggggaccctggtgtacatgggcgtctacgacttccggaacaagaccggcgggagctccacggtggtgaacccgagcgagggcgcctggtccatcagcaactggttcagcgggctcctggactggctgggcgggcccatgaaggccatcctcaagatcctgggcttcatcgccatcggcatcgtctgcttcatcctgttcatgatcctcatccgcatcgcggtgaactccatcaacatcaagaagaagaactga

SEQ ID NO: 12719 - RNA, 3942 nt, synthetic construct
  misc_feature 1..3942: note = derived and/or modified CDS sequence (opt1) from PTV(GML902876)__KP272011.1__GP
  source 1..3942: mol_type = other RNA
atgatcttcaccatcctgaacgtgctcacccgcgccatgctggtcatgagcatgtactccctgacgacctgggacagcacctcccggaacgacatgtgcttcagcaacgacagccccctcgagggcctggtgtactactgggagacccacagcaagaagcacgactacaagaagcaggagtcccagaagtgccgcgtgggggacagcgacaagaagatgatctccaacgtcacgatcatcagcctgatctccgagatccagaagtccatctccgagctcagcctgtcctgcggcaacgacgacaacagcaccggccaggtgctgaccttcaacggcctcgaggacaccatccgcggggactacatcgtggactgcgtcacgggcctgtaccagtccgacatcggcgtgggggtgggcctggggcggacccaccacgaccaccaccaggtcaagaacaaggccgtggtgatcgacgagaaggagcggatgatcagcctcctggagacccagcagtccgagaacgacatcaagatgcaggtcctgatgagcgagatcgagcagctcaagaaccagctgagccgcaagcggaacgagcgcggccaggagaagcgggacgcggagaaggtgatgtccgacctgatggcccgcaacagcgacctccggaagcacaacgacatcctgaccgccgagatctcccagatggagaacaacaacacgatccagcgcaacaagaacgtgatgagcaccaccgtcgtgccggccatcctgtccgtggccctcctgagctccagcatcgcgcccatcatggccgcctcccccgacagccccatgatcaacccgtggccccacgccaagaaccgggtcgggaccggcatgtacaagtacgacgagaacgacgactccggctgccgccccatccggtacggggtgagctgcatcggcttcgacttcatgctgaagatggacaagtaccccttcttcaacgcgttcatcgggcacaagacgccgctcgagtccttcgccgacaagatcatcgagaaggaggaggagacctgcgagatcggcaccaacaaggagttcaagtgcttcgaggagcgcgcctacatcaaggggacctgccccacgaacatcaacgccgtgcactacatcgacaacaaggggaagctgcggtacgtcaagtgcaaggagaacctggagatgaccgaggactgcgccttctgccgcaagatcaagaagaaggcgggccagagcatccaggtgcagaagacctccgtgcccctccaggacgccatctgccaggagaacagcgacacctactccgggcccaagatcccgttcaagggcgtctgcaagatcgggctgatcaagtacaaggagtgcaagttcaagacgagctcctacgagaccgtgagcttcatcaccctgaaggagaagggcaagatctacatcgagcacctcatgctgaagaacatcgaggtcgtgaccaacgtgagcttcgtctgctacgagcacgccggccaggacgagcaggaggtggagcaccgggccctgaagcgcgtgtccgtcaacgactgcaagatcgtggacaacagcaagcagaagatctgcacgggggaccacatcttctgcgagaagtacgactgctccaccagctaccccgacgtgacctgcatccacgcccccggctccgggcccctctacatcaacctgatgggcagctggatcaagccgcagtgcgtcgggtacgagcgggtgctggtggaccgcgaggtcaagcagcccctcctggcgcccgagcagaactgcgacacgtgcgtgtccgagtgcctggacgagggcgtgcacatcaagagcaccggcttcgagatcacctccgccgtcgcctgcagccacgggtcctgcatcagcgcccaccaggaggcctccaccagcgtgatcgtgccctacccgggcctcctggcgtccgtcgggggccgcatcgggatccacctgagccacacctccgacagcgccagcgtgcacatggtggtcgtgtgcccgccccgggactcctgcgccgcccacaactgcctcctgtgctaccacggcatcctgaactaccagtgccacagcacgctctccgccatcctgaccagcttcctgctcatcctgttcatctacaccgtgttctccgtcaccaccaacatgctgtacgtgctgcgcctcatccccaagcagctcaagagccccgtgggctggctgcggctgttcatcaactggctgctgacggcgctccgcatcaagacccggaacgtcatggggcgcatcaaccagcggatcggctgggtggaccaccacgacgtggagcgcccccggcaccgcgagcccatgcggcgcttcaagaccaccctgctgctcacgctgatcatgatgaccgggggcaacgcctgctccaacaccgtcgtggccaacagcaagcagacccggtgcgtgcaggagggctccagcacgaagtgctccatcaccgccaccatcaccctgcgcgcgggggtcatcggcgccgagagctgcttcatcatcaaggggcccatggagaaccagcagaagacgatctccatcaagaccatcagctccgagaccgtgtgccgggagggcagctccttctggaccagcctctacatcccgtcctgcctgagcagccgccggtgccacctggtgggggactgcgtcggcaacaagtgccagtcctggcgcgacgaccagctcagccgggagttctccggcgtgaaggacaaccacatcatgaacgagaacaagtgcttcgagcagtgcggggccatcggctgcgggtgcttcaacatcaaccccagctgcctgtacgtgcacgcctacctgaagtccgcccgcaacgaggcggtccgcgtgttcagctgctccgactgggtgcaccgggtcagcttcgaggtgaagggccccgacggggagacggagctcgtggccctgggctccctgggcaccaagttcctcaactgggggaccctgagcctgtccctcgacgccgagggcatcagcgggaccaactccatcagcttcctggagtccagcaagggcgggttcgccctgtacgacgagggctactccgagatcccgcgcgagggcttcctcggggagatccggtgcagctccgagagcgccgcgatcagcgcccacaagtcctgcatccgcgcccccggcctgatcaagtacaagcccatgacggaccagatcgagtgcaccgccagcctggtcgaccccttcgccatcttcctcaaggggtccctgccgcagacccggaacggccagaccttcacgagcaccaaggacaagaagaccgtgcaggcgttcaccaacggggccatcaaggccctgctctccatcaacctggacgaccacgagatcgtgttcatcaacaaggtcaagagctgcgacgccacgttcctgaacgtgtccggctgctacagctgcgactacggcgcgcacgtgtgcgtcaaggtgaagtccagcgagtccgccgacttcttcgccgagagcgaggacaagaccaccgtcctctccttccccatccagagcgggacccacgactactgccaggtgctgcacttccagaagcccctggtggacgagcgcctctcctacagctgcggctccgagcccaagctgatcgtcatcaaggggacgctggtgtacatgggcgtgtacgacttccggaacaagaccggcgggagctccaccgtcgtgaacccgagcgagggcgcctggagcatctccaactggttcagcgggctcctggactggctgggcgggcccatgaaggccatcctcaagatcctgggcttcatcgcgatcggcatcgtgtgcttcatcctgttcatgatcatgatccgcatcgccgtcaactccatcaacatcaagaagaagaactga

SEQ ID NO: 12720 - RNA, 3942 nt, synthetic construct
  misc_feature 1..3942: note = derived and/or modified CDS sequence (opt1) from PTV(PAN479603)__KP272014.1__GP
  source 1..3942: mol_type = other RNA
atgatcttcaccatcctgaacatcctcacccgcgccatgctggtgatgagcatgtactccctgacgacctgggacagcacctcccggaacgacatgtgcttcagcaacgacagccccctcgagggcctggtctactactgggagacccacagcaagcgccacgactacaagaagcaggagtcccagaagtgccgggtgggggacagcgacaagaagatgatctccaacgtgacgatcatcagcctgatctccgagatccagaagtccatctccgagctcagcctgtcctgcggcaacgacgacaacagcaccgggcaggtcctgaccttcaacggcctcgaggacaccatccgcggggactacatcgtggactgcgtgacgggcctgtaccagtccgacatcggcgtcggggtgggcctggggcggacccaccacgaccaccaccaggtgaagaacaaggccgtcgtgatcgacgagaaggagcgcatgatcagcctcctggagacccagcagtccgagaacgacatcaagatgcaggtcctgatgagcgagatcgagcagctcaagaaccagctgagccggaagcgcaacgagcggggccaggagaagcgcgacgcggagaaggtgatgtccgacctgatggcccggaacagcgacctccgcaagcacaacgacatcctgaccgccgagatctcccagatgaagtacgacaacacgatccagcggaacaagaacgtgatgagcaccaccgtggtcccggccatcctgtccgtggccctcctgagctccagcgtggcgcccatcatcgccgccccgcccgactcccccatgatcaacccctggccccacgccaagaaccgcgtcgggaccggcatgtacaagtacgacgacaacgacgacagcggctgccggcccatccgctacggggtgtcctgcatcggcttcgacttcatgctgaagatggacaagtacccgttcttcaacgcgttcatcgggcacaagacgcccctcgagagcttcgccgacaagatcatcgagaaggaggaggagacctgcgagatcggcaccaacaaggagttcaagtgcttcgaggagcgggcctacatcaaggggacctgccccacgaacatcaacgccgtgcactacatcgacaacaaggggaagctgcgctacgtcaagtgcaaggagaacctggagatgaccgaggactgcgccttctgccggaagatcaagaagaaggcgggccagtccgtccaggtgcagaagaccagcgtgcccctccaggacgccatctgccaggagaactccgacacctacagcgggccgaagatccccttcaagggcgtgtgcaagatcgggctgatcaagtacaaggagtgcaagttcaagacgtccagctacgagaccgtctccttcatcaccctgaaggagaagggcaagatctacatcgagcacctcatgctgaagaacatcgaggtggtgaccaacgtcagcttcgtgtgctacgagcacgccggccaggacgagcaggaggtggagcaccgcgccctgaagcgggtcagcgtgaacgactgcaagatcgtggacaactccaagcagaagatctgcacgggggaccacgtcttctgcgagaagtacgactgcagcacctcctaccccgacgtgacctgcatccacgcccccggcagcgggccgctctacatcaacctgatgggctcctggatcaagccccagtgcgtggggtacgagcgcgtcctggtggaccgcgaggtgaagcagcccctcctggcgcccgagcagaactgcgacacgtgcgtcagcgagtgcctggacgagggcgtgcacatcaagtccaccggcttcgagatcaccagcgccgtggcctgctcccacgggagctgcatctccgcccaccaggaggccagcacctccgtcatcgtgccgtaccccggcctcctggcgagcgtgggcggccggatcgggatccacctgtcccacaccagcgactccgccagcgtccacatggtggtggtctgcccgccccgcgacagctgcgccgcccacaactgcctcctgtgctaccacggcatcctgaactaccagtgccactccacgctcagcgccatcctgacctccttcctgctcatcctgttcatctacaccgtgttcagcgtgaccaccaacatgctgtacgtcctgcggctcatccccaagcagctgaagtcccccgtgggctggctgaagctgttcatcaactggctcctgacgaccctccgcatcaagacccggaacgtgatggggcgcatcaaccagcggatcggctgggtcgaccacttcgacgtggagcgcccccggcaccgcgagcccatgcggcgcttcaagaccacgctgctgctcaccctgatcatgatgaccgggggcaacgcgtgcagcaacaccgtggtcgccaactccaagcagacgcggtgcgtgcaggagggcagcaacaccaagtgctccatcaccgccaccatcacgctgcgcgccggggtgatcggcgcggagagctgcttcatcatcaaggggccgatggagaaccagcagaagaccatctccatcaagaccatcagctccgagaccgtctgccgggagggcagctccttctggacgagcctctacatcccctcctgcctgagctcccgccggtgccacctggtgggggactgcgtgggcaacaagtgccagagctggcgcgacgaccagctcagccgggagttctccggcgtcaaggacaaccacatcatgaacgagaacaagtgcttcgagcagtgcggggccatcggctgcgggtgcttcaacatcaaccccagctgcctgtacgtgcacgcctacctgaagtccgcccgcaacgaggccgtgcgcgtcttcagctgctccgactgggtgcaccgggtgagcttcgaggtcaagggcccggacggggagaccgagctcgtgaccctgggctccctgggcaccaagttcctcaactgggggacgctgagcctgtccctcgacgcggagggcatcagcgggaccaactccatcagcttcctggagtccagcaagggcgggttcgccctgtacgacgagggctactccgagatcccccgcgagggcttcctcggggagatccggtgcagctccgagagcgccgccatctccgcccacaagagctgcatccgcgcgcccggcctgatcaagtacaagcccatgaccgaccagatcgagtgcaccgccagcctggtggacccgttcgccatcttcctcaaggggtccctgccccagacgcggaacggccagaccttcaccagcaccaaggacaagaagacggtccaggccttcaccaacggggccatcaaggcgctgctctccatcaacctggacgaccacgagatcgtgttcatcaaccgcgtcaagagctgcgacgccaccttcctgaacgtgtccggctgctacagctgcgactacggcgcccacgtgtgcgtcaaggtgaagtccagcgagtccgccgacttcttcgcggagagcgaggacaagaccacggtgctctccttccccatccagagcgggacccacgactactgccaggtcctgcacttccagaagcccctggtggacgagcggctctcctacagctgcggctccgagccgaagctgatcgtgatcaaggggaccctggtctacatgggcgtgtacgacttccgcaacaagaccggcgggagctccacggtggtcaaccccagcgagggcgcctggtccatcagcaactggttcagcgggctcctggactggctgggcgggcccatgaaggccatcctcaagatcctgggcttcatcgccatcggcatcgtgtgcttcatcctgttcatgatcctcatccggatcgccgtgaactccatcaacatcaagaagaagaactga

SEQ ID NO: 12721 - RNA, 3942 nt, synthetic construct
  misc_feature 1..3942: note = derived and/or modified CDS sequence (opt1) from PTV(PAN478718)__KP272017.1__GP
  source 1..3942: mol_type = other RNA
atgatcttcaccatcctgaacgtgctcacccgcgccatgctggtcatgagcatgtactccctgacgacctgggacagctccagccggaacgacatgtgcttctccaacgacagccccctcgagggcctggtgtactactgggagacccactccaagaagcacgactacaagaagcaggagagccagcgctgccgggtgggggactccgacaagaagatgatcaccaacgtcacgatcatcagcctgatctccgagatccagaagtccatcagcgagctcagcctgtcctgcggcaacgacgacaacagcaccggccaggtgctgaccttcaacggcctcgaggacaccatccgcggggactacatcgtggactgcgtcacgggcctgtaccagtccgacatcggcgtgggggtgggcctggggcggacccaccacgaccaccagcaggtcaagaacaaggccgtggtgatcgacgagaaggagcgcatgatcagcctcctggagacccagcagtccgagaacgacatcaagatgcaggtcctgatgagcgagatcgagcagctcaagaaccagctgagcaagaagcggaacgagcgcggccaggagaagcgggacgcggagaaggtgatgtccgacctgatggcccgcaacagcgacctccggaagcacaacgacatcctgaccgccgagatctcccagatgaagtacaacaacacgatccagcgcaacaagaacatcatgagcaccaccgtggtcccggccatcctgtccgtggccctcctgagctccagcgtggcgcccatcatggccgccccgcccgactcccccatgatcaacccctggccccacgccaagaaccgggtcgggaccggcatgtacaagtacgacgacaacgacgacagcggctgccgccccatccggtacggggtgtcctgcatcggcttcgacttcatgctgaagatggacaagtacccgttcttcaacgcgttcatcgggcacaagacgcccctcgagagcttcgccgacaagatcatcgagaaggaggaggagacctgcgagatcggcaccaacaaggagttcaagtgcttcgaggagcgcgcctacatcaaggggacctgccccacgaacatcaacgccgtgcactacatcgacaacaaggggaagctgcggtacgtcaagtgcaaggagaacctggagatgaccgaggactgcgccttctgccgcaagatcaagaagaaggcgggccagtccgtccaggtgcagaagaccagcgtgcccctccaggacgccatctgccaggagaactccgacacctacagcgggccgaagatccccttcaagggcgtgtgcaagatcgggctgatcaagtacaaggagtgcaagttcaagacgtccagctacgagaccgtctccttcatcaccctgaaggagaagggcaagatctacatcgagcacctcatgctgaagaacatcgaggtggtgaccaacgtcagcttcgtgtgctacgagcacgccggccaggacgagcaggaggtggagcaccgggccctgaagcgcgtcagcgtgaacgactgcaagatcgtggactccagcaagcagaagatctgcacgggggaccacgtcttctgcgagaagtacgactgctccaccagctaccccgacgtgacctgcatccacgcccccggctccgggccgctctacatcaacctgatgggcagctggatcaagccccagtgcgtggggtacgagcgggtcctggtggaccgcgaggtgaagcagcccctcctggcgcccgagcagaactgcgacacgtgcgtctccgagtgcctggacgagggcgtgcacatcaagagcaccggcttcgagatcacctccgccgtggcctgcagccacgggtcctgcatcagcgcccaccaggaggcctccaccagcgtcatcgtgccgtaccccggcctcctggcgtccgtcgggggccgcatcgggatccacctgagccacacctccgacagcgccagcgtgcacatggtggtggtctgcccgccccgggactcctgcgccgcccacaactgcctcctgtgctaccacggcatcctgaactaccagtgccacagcacgctctccgccatcctgaccagcttcctgctcatcctgttcatctacaccgtgttctccgtgaccaccaacatgctgtacgtcctgcgcctcatccccaagcagctcaagagccccgtgggctggctgaagctgttcatcaactggctgctgacggcgctccggatcaagacccgcaacgtgatggggcggatcaaccagcgcatcggctgggtcgaccaccacgacgtggagcggccccgccaccgggagcccatgcgccggttcaagaccaccctgctgctcacgctgatcatgatgaccgggggcaacgcctgctccaacaccgtggtcgccaacagcaagcagacccgctgcgtgcaggagggctccaacacgaagtgcagcatcaccgccaccatcaccctgcgggcgggggtgatcggcgccgagtcctgcttcatcgtcaaggggccgatggagaaccagcagaagacgatcagcatcaagaccatctccagcgagaccgtgtgccgcgagggctccagcttctggacctccctctacatccccagctgcctgtccagccggcgctgccacctggtgggggactgcgtcggcaacaagtgccagagctggcgggacgaccagctctcccgcgagttcagcggcgtgaaggacaaccacatcatgaacgagaacaagtgcttcgagcagtgcggggccatcggctgcgggtgcttcaacatcaacccctcctgcctgtacgtgcacgcctacctcaagagcgcccggaacgaggcggtccgcgtgttctcctgcagcgactgggtgcaccgcgtctccttcgaggtgaagggcccggacggggagacggagctggtgaccctgggcagcctgggcaccaagttcctcaactgggggaccctgtccctgagcctcgacgccgagggcatctccgggacgaacagcatctccttcctggagagctccaagggcgggttcgccctgtacgacgagggctacagcgagatcccccgggagggcttcctcggggagatccgctgctccagcgagtccgccgccatcagcgcgcacaagagctgcatccgggcccccggcctgatcaagtacaagcccatgaccgaccagatcgagtgcaccgcctccctggtcgacccgttcgccatcttcctcaaggggagcctgccccagacccgcaacggccagacgttcacctccaccaaggacaagaagaccgtgcaggccttcacgaacggggcgatcaaggccctgctcagcatcaacctggacgaccacgagatcgtgttcatcaacaaggtcatctcctgcgacgccaccttcctgaacgtgagcggctgctactcctgcgactacggcgcccacgtctgcgtgaaggtcaagagctccgagagcgcggacttcttcgccgagtccgaggacaagaccaccgtgctcagcttccccatccagtccgggacgcacgactactgccaggtgctgcacttccagaagcccctggtggacgagcggctcagctactcctgcggcagcgagccgaagctgatcgtcatcaaggggaccctggtgtacatgggcgtgtacgacttccgcaacaagaccggcgggtccagcaccgtcgtgaacccctccgagggcgcctggagcatcagcaactggttctccgggctcctggactggctgggcgggcccatgaaggccatcctcaagatcctgggcttcatcgccatcggcatcgtgtgcttcatcctgttcatgatcctcatccggatcgcggtcaacagcatcaacatcaagaagaagaactga

SEQ ID NO: 12722 - RNA, 3942 nt, synthetic construct
  misc_feature 1..3942: note = derived and/or modified CDS sequence (opt1) from PTV(Balliet)__KP272023.1__GP
  source 1..3942: mol_type = other RNA
atgatcttcaccatcctgaacgtgctcacccgcgccatgctggtcatgagcatgtactccctgacgacctgggacagcacctcccggaacgacatgtgcttcagcaacgacagccccctcgagggcctggtgtactactgggagacccactccaagaagcacgactacaagaagcagaagtcccagcgctgccgggtgggggacagcgacaagaagatgatcacgaacgtcaccatcatctccctgatcagcgagatccagaagtccatcagcgagctctccctgagctgcggcaacgacgacaactccaccggccaggtgctgaccttcaacgggctcgaggacacgatccgcggggactacatcgtggactgcgtcaccggcctgtaccagagcgacatcggcgtgggggtgggcctggggcggacccaccacggccaccagcagatgaagaacaaggccgtcgtgatcgacgagaaggagcgcatgatcctcctgctggagacccagcagtccgagaacgacatcaagatgcaggtcctcatgagcgagatcgagcagctgaagaaccagctgtccaagaagcggaacgagcgcgggcaggagaagcgggacgcggagaaggtgatgagcgacctcatggcccgcaacagcgacctgcggaagcacaacgacatcctgacggccgagatctcccagatgaagaacaagaacaccatccagcgcaacaagaacaccgtgagcaccacggtggtcccggccatcctctccgtggccctgctgagctccagcgtggcgcccatcatcgccgccccgcccgactcccccatgatcaacccctggccccacgccaagaaccgggtcggcaccggcatgtacaagtacgacgagaacgacgacagcgggtgccgccccatccggtacggcgtgtcctgcatcgggttcgacttcatgctcaagatggacaagtacccgttcttcaacgcgttcatcggccacaagacgcccctggagagcttcgccgacaagatcatcgagaaggaggaggagacctgcgagatcggcacgaacaaggagttcaagtgcttcgaggagcgcgcctacatcaaggggacctgccccaccaacatcaacgccgtgcactacatcgacaacaagggcaagctgcggtacgtcaagtgcaaggagaacctcgagatgaccgaggactgcgccttctgccgcaagatcaagaagaaggcggggcagtccgtccaggtgcagaagacgagcgtgcccctgcaggacgccatctgccaggagaactccgacacctacagcggcccgaagatccccttcaagggggtgtgcaagatcggcctgatcaagtacaaggagtgcaagttcaagacctccagctacgagaccgtctccttcatcacgctcaaggagaagggcaagatctacatcgagcacctgatgctgaagaacatcgaggtggtgaccaacgtcagcttcgtgtgctacgagcacgccgggcaggacgagcaggaggtggagcacaaggccctcaagcgggtctccgtgaacgactgcaagatcgtggacaacagcaagcagaagatctgcaccggcgaccacgtcttctgcgagaagtacgactgcagcacctcctaccccgacgtgacgtgcatccacgcccccgggagcggcccgctgtacatcaacctgatggggtcctggatcaagccccagtgcgtgggctacgagcgcgtcctcgtggaccgggaggtgaagcagcccctgctggcgcccgagcagaactgcgacacgtgcgtcagcgagtgcctcgacgagggcgtgcacatcaagtccaccgggttcgagatcaccagcgccgtggcctgctcccacggcagctgcatctccgcccaccaggagccgagcacctccgtcatcgtgccctaccccgggctgctggccagcgtgggcgggcgcatcggcatccacctctcccacaccagcgactccgcgagcgtccacatggtggtggtctgcccgccccgcgactcctgcgccgcccacaactgcctgctgtgctaccacggcatcctcaactaccagtgccacagcaccctgagcgccatcctgacctccttcctcctgatcctgttcatctacaccgtgttcagcgtgacgaccaacatcctgtacgtcctccggctgatccccaagcagctgaagtcccccgtggggtggctcaagctgttcatcaactggctgctcaccgccctgcgcatcaagacccggaacgtgatgggccgcatcaaccagcggatcgggtgggtcgaccaccacgacgtggagcgcccccggcaccgcgagccgatgcggcgcttcaagacgaccctgctcctgaccctgatcatgatgaccggcggcaacgcgtgcagcaacacggtggtcgccaactccaagcagacccggtgcgtgcaggaggggagcaacaccaagtgctccatcaccgccacgatcaccctccgcgccggcgtgatcggggcggagagctgcttcatcatcaagggccccatggagaaccagcagaagaccatctccatcaagaccatcagctccgagacggtctgccgggaggggagctccttctggaccagcctgtacatcccctcctgcctgagctcccgccggtgccacctcgtgggcgactgcgtgggcaacaagtgccagagctggcgcgacgaccagctgtcccgggagttcagcggggtcaaggacaaccacatcatgaacgagaacaagtgcttcgagcagtgcggcgccatcgggtgcggctgcttcaacatcaacccgagctgcctgtacgtgcacgcctacctcaagtccgcccgcaacgaggccgtgcgggtcttcagctgctccgactgggtgcaccgcgtgagcttcgaggtcaaggggcccgacggcgagaccgagctggtgaccctgggctccctcgggacgaagttcctgaactggggcaccctgagcctctccctggacgcggaggggatcagcggcaccaactccatcagcttcctggagtccagcaagggcgggttcgccctctacgacgagggctacaacgagatcccccgcgaggggttcctgggcgagatccggtgctccagcgagtccgccgccatcagcgcccacaagtcctgcatccgcgcgcccgggctgatcaagtacaagccgatgaccgaccagatcgagtgcacggccagcctcgtggaccccttcgccatcttcctgaagggctccctgccccagacccggaacgggcagaccttcaccagcacgaaggacaagaagaccgtccaggccttcaccaacggcgccatcaaggcgctcctgagcatcaacctggacgaccacgagatcgtgttcatcaacaaggtgaagaactgcgacgccaccttcctcaacgtctccggctgctacagctgcgactacggggcccacgtgtgcgtcaaggtgaagtccagcgagtccgccgacttcttcgcggagagcgaggacaagacgaccgtgctgtccttccccatccagagcggcacccacgactactgccaggtcctgcacttccagaagccgctcgtggacgagcgcctgtcctacagctgcgggtccgagcccaagctgatcgtgatcaagggcaccctcgtctacatgggcgtgtacgacttccggaacaagaccgggggcagctccaccgtggtcaaccccagcgagggggcctggtccatcagcaactggttctccggcctgctggactggctcgggggccccatgaaggccatcctgaagatcctgggcttcatcgccatcgggatcgtgtgcttcgtcctcttcatgatcctgatccgcatcgccgtgaacagcatcaacatcaagaagaagaactga

SEQ ID NO: 12723 - RNA, 3942 nt, synthetic construct
  misc_feature 1..3942: note = derived and/or modified CDS sequence (opt1) from PTV(Adames)__KP272029.1__GP
  source 1..3942: mol_type = other RNA
atgatcttcaccatcctgaacgtgctcacccgcgccatgctggtcatgagcatgtactccctgacgacctgggacagctccagccggaacgacatctgcttctccaacgacagccccctcgagggcctggtgtactactgggagacccactccaagaagcacgactacaagaagcaggggagccagaagtgccgcgtgggcgactccgacaagaagatgatcagcaacgtcaccatcatctccctgatcagcgagatccagaagtccatcagcgagctctccctgagctgcgggaacaacgacaactccacgggccaggtgctgaccttcaacgggctcgaggacaccatccggggcgactacatcgtggactgcgtcaccggcctgtaccagagcgacatcggggtgggcgtggggctgggccgcatcaaccacgaccaccagcaggtcaagaacaaggccgtggtgatcgacgagaaggagaagatgatctccctcctggagacgcagcagagcgagaacgacatcaagacccaggtcctgatgagcgagatcgagcagctcaagaaccagctgtccaagcggcgcaacgagcgggggcaggagaagcgcgacgcggagaagctgatgagcgacctcatggcccggaactccgacctgcgcaaccacaacgtgatcctgaccgacgagatcagccagatcaagaacaacatcaccatccaccggaaccgcaacatgatgtccacgaccgtggtcccggccatcctcagcgtggccctgctgtccagctccgtgggccccatcaccgccgcgccgcccgacagcaccatgatcaacccctggccccacgccaagaaccgggtcggcacggggatgtacaagtacgacgagaacgacgagtccggctgccgccccatccggtacggggtgagctgcatcggcttcgacttcatgctcaagatggacaagtaccccttcttcaacgccttcatcggccacaagaccccgctggagtccttcgccgacaagatcatcgagaaggaggaggagacctgcgagatcgggaccaacaaggagttcaagtgcttcgaggagcgcgcgtacatcaagggcacgtgccccaccaacatcaacgccgtgcactacatcgacaacaaggggaagctgcggtacgtcaagtgcaaggagaacctcgagatgaccgaggactgcgccttctgccgcaagatcaagaagaaggccggccagagcgtccaggtgcagaagacctccgtgcccctgcaggacgccatctgccaggagaacagcgacatctactccgggcccaagatcccgttcaagggcgtgtgcaagatcggcctgatcaagtacaaggagtgcaagttcaagacgagctcctacgagaccatcagcttcatcaccctcaaggggaagggcaagatctacatcgagcacctgatgctgaagaacatcgaggtcgtgaccaacgtgagcttcgtctgctacgagcacgcggggcaggacgagcaggaggtggagcaccgggccctcaagcgcgtgtccgtcaacgactgcaagatcgtggacaacagcaagcagaagatctgcacgggcgaccacatcttctgcgagaagtacgactgctccaccagctaccccgacgtgacctgcatccacacccccgggtccggccccctgtacatcaacctgatgggcagctggatcaagccgcagtgcgtcgggtacgagcgggtgctcgtggaccgcgaggtcaagcagcccctgctggtgcccgagcagaactgcgacacgtgcgtgtccgagtgcctcgacgagggcgtccacatcaagagcaccgggttcgagatcacctccgccgtggcctgcagccacggctcctgcatcagcgcccaccaggaggcgtccaccagcgtgatcatcccctacccggggctgctggcctccgtcggcggccgcatcgggatccacctcagccacacgtccgacagcgccagcgtgcacatggtggtcgtgtgcccgccccgggactcctgcgccgcccacaactgcctgctgtgctaccacggcatcctcaactaccagtgccacagcaccctgtccgcgatcctgaccagcttcctcctgatcctgttcatctacaccgccttctccgtgaccacgaacgtcctgtacgtgctccgcctgatccccaagcagctcaagagccccgtggggtggctgaagctgttcgtcaactggctgctcaccgccctgcggatcaagacccgccgggtgatgggccgcatcaaccagcggatcggctgggtggaccaccacgacgtcgagcgcccccggcaccgcgagcccatgcggcgcttcaagaccacgctgctcctgaccctgatcatggtgaccgggggcaacgcctgctccaacaccgtggtcgccaacagcaagcagacgcggtgcgtgcaggaggggtccaacaccaagtgcagcatcaccgcgaccatcacgctccgcgccggcgtgatcggggccgagtcctgcttcatcatcaagggccccatggagaaccagcagaagaccatcagcatcaagaccatctccagcgagaccgtctgccgggagggctccagcttctggacgtccctgtacatcccgagctgcctgtccagccgccggtgccacctcgtgggggactgcgtgggcaacaagtgccagagctggcgcgacgaccagctgtcccgggagttcagcggggtcaaggacaaccacatcatgaacgagaacaagtgcttcgagcagtgcggcgccatcgggtgcggctgcttcaacatcaacccctcctgcctgtacgtgcacgcgtacctcaagagcgcccgcaacgaggccgtgcgcgtcttctcctgcagcgactgggtgcaccgggtgtccttcgaggtcaagggccccgacggggagatggagctggtgaccctgggcagcctcgggaccaagttcctgaactggggcaccctgtccctcagcctggacgccgaggggatctccggcacgaacagcatctccttcctggagagctccaagggcgggttcgccctctacgacgagggctacagcgagatcccgcgcgaggggttcctgggcgagatccggtgctccagcgagtccgcggccatcagcgcccacaagagctgcatccgcgcccccgggctgatcaagtacaagcccatgaccgaccagatcgagtgcaccgcctccctcgtggaccccttcgcgatcttcctgaagggcagcctgccgcagacccggaacggccagacgttcacctccaccaaggacaagaagaccgtccaggccttcacgaacggggccatcaaggccctcctgagcatcaacctggacgaccacgagatcatcttcatcaacaaggtgaagtcctgcgacgccaccttcctcaacgtgagcggctgctactcctgcgactacggggcgcacgtctgcgtgaaggtcaagagctccgagagcgccgacttcttcgccgagtccgaggacaagaccaccgtgctgagcttccccatccagtccggcacgcgcgactactgccaggtgctgcacttccagaagcccctcgtcgacgagcggctgagctactcctgcggcagcgagcccaagctgatcgtgatcaaggggaccctcgtgtacatgggcgtctacgacttccgcaacaagaccgggggctccagcaccgtgatcaacccgtccgaggggacgtggagcatcagcaactggttctccggcctgctggactggctcggcgggcccatgaaggccatcctgaagatcctgggcttcatcgcgatcgggatcgtgtgcttcatcctcttcatgatcctgatccggatcgccgtcaacagcatcaacatcaagaagaagaactga

SEQ ID NO: 12724 - RNA, 3942 nt, synthetic construct
  misc_feature 1..3942: note = derived and/or modified CDS sequence (opt1) from PTV(GML488831)__KP272032.1__GP
  source 1..3942: mol_type = other RNA
atgatcttcaccatcctgaacgtgctcacccgcgccatgctggtcatgagcatgtactccctgacgacctgggacagcacctcccggaacgacatgtgcttcagcaacgacagccccctcgagggcctggtgtactactgggagacccacagcaagaagcacgactacaagaagcaggagtcccagcgctgccgggtgggggacagcgacaagaagatgatcacgaacgtcaccatcatctccctgatcagcgagatccagaagtccatcagcgagctctccctgagctgcggcaacgacgacaactccaccggccaggtgctgaccttcaacggcctcgaggacacgatccgcggggactacatcgtggactgcgtcaccggcctgtaccagagcgacatcggcgtgggggtgggcctggggcgggcccaccacgaccaccagcaggtcaagaacaaggcggtggtgatcgacgagaaggagcgcatgatctccctcctggagacccagcagagcgagaacgacatcaagatgcaggtcctgatgtccgagatcgagcagctcaagaaccagctgagcaagaagcggaacgagcgcggccaggagaagcgggacgccgagaaggtgatgagcgacctgatggcccgcaactccgacctccggaagcacaacgacatcctgaccgccgagatcagccagatgaagtacaacaacacgatccagcgctccaagaacgtgatgagcaccaccgtcgtgccggccatcctgtccgtggcgctcctgagctccagcgtcgcccccatcatggccgccccgcccgactcccccatgatcaacccctggccccacgcgaagaaccgggtggggaccggcatgtacaagtacgacgacaacgacgacagcggctgccgccccatccggtacggggtgtcctgcatcggcttcgacttcatgctgaagatggacaagtacccgttcttcaacgccttcatcgggcacaagacgcccctcgagagcttcgccgacaagatcatcgagaaggaggaggagacctgcgagatcggcaccaacaaggagttcaagtgcttcgaggagcgcgcctacatcaaggggacctgccccacgaacatcaacgccgtccactacatcgacaacaaggggaagctgcggtacgtgaagtgcaaggagaacctggagatgaccgaggactgcgcgttctgccgcaagatcaagaagaaggccggccagtccgtgcaggtccagaagaccagcgtgtccctccaggacgccatctgccaggagaacagcgacaactactccgggcccaagatcccgttcaagggcgtctgcaagatcgggctgatcaagtacaaggagtgcaagttcaagaccagctcctacgagacggtgagcttcatcaccctgaaggagaagggcaagatctacatcgagcacctcatgctgaagaacatcgaggtggtcaccaacgtgagcttcgtgtgctacgagcacgccggccaggacgagcaggaggtcgagcaccgggccctgaagcgcgtgtccgtgaacgactgcaagatcgtcgacaacagcaagcagaagatctgcaccggggaccacgtgttctgcgagaagtacgactgctccacgagctaccccgacgtgacctgcatccacgcgcccggctccgggcccctctacatcaacctgatgggcagctggatcaagccgcagtgcgtcgggtacgagcgggtgctggtggaccgcgaggtcaagcagcccctcctggcccccgagcagaactgcgacacgtgcgtgtccgagtgcctggacgagggcgtgcacatcaagagcaccggcttcgagatcacgtccgccgtcgcctgcagccacgggtcctgcatcagcgcccaccaggaggcgtccaccagcgtgatcgtgccctacccgggcctcctggcctccgtcgggggccgcatcgggatccacctgagccacacctccgacagcgccagcgtgcacatggtggtcgtgtgcccgccccgggactcctgcgccgcccacaactgcctcctgtgctaccacggcatcctgaactaccagtgccacagcaccctctccgcgatcctgacgagcttcctgctcatcctgttcatctacaccgtgttctccgtcaccaccaacatgctgtacgtgctgcgcctcatccccaagcagctgaagtcccccgtgggctggctgaagctgttcatcaactggctgctgaccgccctccggatcaagacgcgcaacgtcatggggcggatcaaccagcgcatcggctgggtggaccaccacgacgtggagcggccccgccaccgggagcccatgcgccggttcaagaccaccctgctgctcaccctgatcatgatgaccgggggcaacgcctgctccaacaccgtcgtggccaacagcaagcagacccgctgcgtgcaggagggctccaacaccaagtgcagcatcacggcgaccatcaccctgcgggccggggtcatcggcgccgagtcctgcttcatcatcaaggggcccatggagaaccagcagaagaccatcagcatcaagacgatctccagcgagaccgtgtgccgcgagggctccagcttctggacctccctctacatcccgagctgcctgtccagccggcgctgccacctggtgggggactgcgtcggcaacaagtgccagagctggcgggacgaccagctctcccgcgagttcagcggcgtgaaggacaaccacatcatgaacgagaacaagtgcttcgagcagtgcggggccatcggctgcgggtgcttcaacatcaacccctcctgcctgtacgtgcacgcctacctcaagagcgcgcggaacgaggccgtccgcgtgttctcctgcagcgactgggtgcaccgcgtctccttcgaggtgaagggccccgacggggagaccgagctcgtgacgctgggcagcctgggcaccaagttcctcaactgggggaccctgtccctgagcctcgacgccgagggcatctccgggaccaacagcatctccttcctggagagctccaagggcgggttcgccctgtacgacgagggctacagcgagatcccgcgggagggcttcctcggggagatccgctgctccagcgagtccgccgcgatcagcgcccacaagagctgcatccgggcccccggcctgatcaagtacaagcccatgacggaccagatcgagtgcaccgcctccctggtcgaccccttcgccatcttcctcaaggggagcctgccgcagacccgcaacggccagaccttcacgtccaccaaggacaagaagaccgtgcaggcgttcaccaacggggccatcaaggccctgctcagcatcaacctggacgaccacgagatcgtgttcatcaacaaggtccggtcctgcgacgccacgttcctgaacgtgagcggctgctactcctgcgactacggcgcgcacgtctgcgtgaaggtcaagagctccgagagcgccgacttcttcgccgagtccgaggacaagaccaccgtgctcagcttccccatccagtccgggacccacgactactgccaggtgctgcacttccagaagcccctggtggacgagcgcctcagctactcctgcggcagcgagcccaagctgatcgtcatcaaggggacgctggtgtacatcggcgtgtacgacttccggaacaagaccggcgggtccagcaccgtcgtgaacccgtccgagggcgcctggagcatcagcaactggttctccgggctcctggactggctgggcgggcccatgaaggccatcctcaagatcctgggcttcatcgcgatcggcatcgtgtgcttcatcctgttcatgatcctcatccgcatcgccgtcaacagcatcaacatcaagaagaagaactga

SEQ ID NO: 12725 - RNA, 3942 nt, synthetic construct
  misc_feature 1..3942: note = derived and/or modified CDS sequence (opt1) from PTV(GML488778)__KP272038.1__GP
  source 1..3942: mol_type = other RNA
atgatcttcaccatcctgaacgtgctcatccgcgccatgctggtcatgagcatgtactccctgaccacgtgggacagcacctcccggaacgacatgtgcttcagcaacgacagccccctcgagggcctggtgtactactgggagacccactccaagaagcacgactacaagaagcaggagtcccagcgctgccgggtgggggacagcgacaagaagatgatcaccaacgtcacgatcatctccctgatcagcgagatccagaagtccatcagcgagctctccctgagctgcggcaacgacgacaactccaccggccaggtgctgaccttcaacgggctcgaggacaccatccgcggggactacatcgtggactgcgtcacgggcctgtaccagagcgacatcggcgtgggggtgggcctggggcggacccaccacgaccaccagcaggtcaagaacaaggccgtggtgatcgacgagaaggagcgcatgatctccctcctggagacccagcagagcgagaacgacatcaagatgcaggtcctgatgtccgagatcgagcagctcaagaaccagctgagcaagaagcggaacgagcgcggccaggagaagcgggacgcggagaaggtgatgagcgacctgatggcccgcaactccgacctccggaagcacaacgggatcctgaccgccgagatcagccagatgaagtacaacaacacggtgcagcgctccaagaacgtcatgagcaccaccgtggtgccggccatcctgtccgtcgccctcctgagctccagcgtggcgcccatcatggccgccccgcccgactcccccatgatcaacccctggccccacgccaagaaccgggtgggcaccggcatgtacaagtacgacgacaacgacgacagcgggtgccgccccatccggtacggcgtctcctgcatcgggttcgacttcatgctgaagatggacaagtacccgttcttcaacgcgttcatcggccacaagacgcccctcgagagcttcgccgacaagatcatcgagaaggaggaggagacctgcgagatcggcaccaacaaggagttcaagtgcttcgaggagcgcgcctacatcaaggggacctgccccacgaacatcaacgccgtgcactacatcgacaacaagggcaagctgcggtacgtgaagtgcaaggagaacctggagatgaccgaggactgcgccttctgccgcaagatcaagaagaaggcggggcagtccgtccaggtgcagaagaccagcgtctccctccaggacgccatctgccaggagaacagcgacaactactccggccccaagatcccgttcaagggggtgtgcaagatcggcctgatcaagtacaaggagtgcaagttcaagaccagctcctacgagacggtgagcttcatcaccctgaaggagaagggcaagatctacatcgagcacctcatgctgaagaacatcgaggtcgtgaccaacgtgagcttcgtctgctacgagcacgccgggcaggacgagcaggaggtggagcaccgggccctgaagcgcgtgtccgtcaacgactgcaagatcgtggacagctccaagcagaagatctgcaccggcgaccacgtgttctgcgagaagttcgactgcagcacgtcctaccccgacgtgacctgcatccacgcccccgggagcggccccctctacatcaacctgatggggtcctggatcaagccgcagtgcgtgggctacgagcgggtgctggtcgaccgcgaggtgaagcagcccctcctggcgcccgagcagaactgcgacacgtgcgtgagcgagtgcctggacgagggcgtccacatcaagtccaccgggttcgagatcaccagcgccgtggcctgctcccacggcagctgcatctccgcccaccaggaggccagcacctccgtgatcgtcccctacccggggctcctggcgagcgtgggcgggcgcatcggcatccacctgtcccacaccagcgacagcgcctccgtgcacatggtcgtggtgtgcccgccccgggacagctgcgccgcccacaactgcctcctgtgctaccacggcatcctgaactaccagtgccactccaccctcagcgccatcctgacgtccttcctgctcatcctgttcatctacaccgtcttcagcgtgaccaccaacatgctgtacgtgctgcgcctcatccccaagcagctgaagtcccccgtcgggtggctgaagctgttcatcaactggctgctgaccgcgctccggatcaagacgcgcaacgtgatgggccggatcaaccagcgcatcgggtgggtggaccaccacgacgtcgagcggccccgccaccgggagcccatgcgccggttcaagaccaccctgctgctcaccctgatcatgatgacgggcggcaacgcctgcagcaacaccgtggtggccaactccaagcagacccgctgcgtccaggaggggagcaacaccaagtgctccatcacggccaccatcaccctgcgggcgggcgtgatcggggccgagagctgcttcatcatcaagtcccccatggagaaccagcagaagaccatcagcatcaagacgatctccagcgagaccgtgtgccgcgagggctccagcttctggacctccctctacatcccgagctgcctgagctcccggcgctgccacctggtcggggactgcgtgggcaacaagtgccagagctggcgggacgaccagctctcccgcgagttcagcggcgtgaaggacaaccacatcatgaacgagaacaagtgcttcgagcagtgcggggccatcggctgcgggtgcttcaacatcaacccctcctgcctgtacgtccacgcctacctcaagagcgcccggaacgaggcggtgcgcgtgttctcctgcagcgactgggtccaccgcgtgtccttcgaggtgaagggccccgacggggagaccgagctcgtcacgctgggcagcctgggcaccaagttcctcaactgggggaccctgtccctgagcctcgacgccgagggcatctccgggaccaacagcatctccttcctggagagctccaagggcgggttcgccctgtacgacgagggctacagcgagatcccgcgggagggcttcctcggggagatccgctgctccagcgagagcgccgccatctccgcgcacaagagctgcatccgggcccccggcctgatcaagtacaagcccatgacggaccagatcgagtgcaccgcctccctggtggaccccttcgccatcttcctcaaggggagcctgccgcagacccgcaacggccagaccttcacgtccaccaaggacaagaagaccgtgcaggccttcaccaacggggcgatcaaggccctgctcagcatcaacctggacgaccacgagatcatcttcatcaacaaggtccggtcctgcgacgccacgttcctgaacgtgagcggctgctactcctgcgactacggcgcccacgtctgcgtgaaggtcaagagctccgagagcgcggacttcttcgccgagtccgaggacaagaccaccgtcctcagcttccccatccagtccgggacccacgactactgccaggtgctgcacttccagaagcccctggtggacgagcgcctcagctactcctgcggcagcgagcccaagctgatcgtcatcaaggggacgctggtgtacatgggcgtgtacgacttccggaacaagaccggcgggtccagcaccgtcgtgaacccgagcgagggcgcctggtccatcagcaactggttctccgggctcctggactggctgggcgggcccatgaaggccatcatcaagatcctcggcttcatcgccatcggcgtggtctgcttcatcctgttcatgatcctgatccgcatcgcggtgaacagcatcaacatcaagaagaagaactga

SEQ ID NO: 12726 - RNA, 3945 nt, synthetic construct
  misc_feature 1..3945: note = derived and/or modified CDS sequence (opt1) from PTV(Adames)__DQ363407.1__GP
  source 1..3945: mol_type = other RNA
atgatcttcaccatcctgaacgtgctcacccgcgccatgctggtcatgagcatgtactccctgacgacctgggacagctccagccggaacgacatctgcttctccaacgacagccccctcgagggcctggtgtactactgggagacccactccaagaagcacgactacaagaagcaggggagccagaagtgccgcgtgggcgactccgacaagaagatgatcagcaacgtcaccatcatctccctgatcagcgagatccagaagtccatcagcgagctctccctgagctgcgggaacaacgacaactccacgggccaggtgctgaccttcaacgggctcgaggacaccatccggggcgactacatcgtggactgcgtcaccggcctgtaccagagcgacatcggggtgggcgtggggctgggccgcatcaaccacgaccaccagcaggtcaagaacaaggccgtggtgatcgacgagaaggagaagatgatctccctcctggagacgcagcagagcgagaacgacatcaagacccaggtcctgatgagcgagatcgagcagctcaagaaccagctgtccaagcggcgcaacgagcgggggcaggagaagcgcgacgcggagaagctgatgagcgacctcatggcccggaactccgacctgcgcaaccacaacgtgatcctgaccgacgagatcagccagatcaagaacaacatcaccatccaccggaaccgcaacatgatgtccacgaccgtggtcccggccatcctcagcgtggccctgctgtccagctccgtgggccccatcaccgccgcgccgcccgacagcaccatgatcaacccctggccccacgccaagaaccgggtcggcacggggatgtacaagtacgacgagaacgacgagtccggctgccgccccatccggtacggggtgagctgcatcggcttcgacttcatgctcaagatggacaagtaccccttcttcaacgccttcatcggccacaagaccccgctggagtccttcgccgacaagatcatcgagaaggaggaggagacctgcgagatcgggaccaacaaggagttcaagtgcttcgaggagcgcgcgtacatcaagggcacgtgccccaccaacatcaacgccgtgcactacatcgacaacaaggggaagctgcggtacgtcaagtgcaaggagaacctcgagatgaccgaggactgcgccttctgccgcaagatcaagaagaaggccggccagagcgtccaggtgcagaagacctccgtgcccctgcaggacgccatctgccaggagaacagcgacatctactccgggcccaagatcccgttcaagggcgtgtgcaagatcggcctgatcaagtacaaggagtgcaagttcaagacgagctcctacgagaccatcagcttcatcaccctcaaggggaagggcaagatctacatcgagcacctgatgctgaagaacatcgaggtcgtgaccaacgtgagcttcgtctgctacgagcacgcggggcaggacgacgagcaggaggtggagcaccgggccctcaagcgcgtgtccgtcaacgactgcaagatcgtggacaacagcaagcagaagatctgcacgggcgaccacatcttctgcgagaagtacgactgctccaccagctaccccgacgtgacctgcatccacacccccgggtccggccccctgtacatcaacctgatgggcagctggatcaagccgcagtgcgtcgggtacgagcgggtgctcgtggaccgcgaggtcaagcagcccctgctggtgcccgagcagaactgcgacacgtgcgtgtccgagtgcctcgacgagggcgtccacatcaagagcaccgggttcgagatcacctccgccgtggcctgcagccacggctcctgcatcagcgcccaccaggaggcgtccaccagcgtgatcatcccctacccggggctgctggcctccgtcggcggccgcatcgggatccacctcagccacacgtccgacagcgccagcgtgcacatggtggtcgtgtgcccgccccgggactcctgcgccgcccacaactgcctgctgtgctaccacggcatcctcaactaccagtgccacagcaccctgtccgcgatcctgaccagcttcctcctgatcctgttcatctacaccgccttctccgtgaccacgaacgtcctgtacgtgctccgcctgatccccaagcagctcaagagccccgtggggtggctgaagctgttcgtcaactggctgctcaccgccctgcggatcaagacccgccgggtgatgggccgcatcaaccagcggatcggctgggtggaccaccacgacgtcgagcgcccccggcaccgcgagcccatgcggcgcttcaagaccacgctgctcctgaccctgatcatggtgaccgggggcaacgcctgctccaacaccgtggtcgccaacagcaagcagacgcggtgcgtgcaggaggggtccaacaccaagtgcagcatcaccgcgaccatcacgctccgcgccggcgtgatcggggccgagtcctgcttcatcatcaagggccccatggagaaccagcagaagaccatcagcatcaagaccatctccagcgagaccgtctgccgggagggctccagcttctggacgtccctgtacatcccgagctgcctgtccagccgccggtgccacctcgtgggggactgcgtgggcaacaagtgccagagctggcgcgacgaccagctgtcccgggagttcagcggggtcaaggacaaccacatcatgaacgagaacaagtgcttcgagcagtgcggcgccatcgggtgcggctgcttcaacatcaacccctcctgcctgtacgtgcacgcgtacctcaagagcgcccgcaacgaggccgtgcgcgtcttctcctgcagcgactgggtgcaccgggtgtccttcgaggtcaagggccccgacggggagatggagctggtgaccctgggcagcctcgggaccaagttcctgaactggggcaccctgtccctcagcctggacgccgaggggatctccggcacgaacagcatctccttcctggagagctccaagggcgggttcgccctctacgacgagggctacagcgagatcccgcgcgaggggttcctgggcgagatccggtgctccagcgagtccgcggccatcagcgcccacaagagctgcatccgcgcccccgggctgatcaagtacaagcccatgaccgaccagatcgagtgcaccgcctccctcgtggaccccttcgcgatcttcctgaagggcagcctgccgcagacccggaacggccagacgttcacctccaccaaggacaagaagaccgtccaggccttcacgaacggggccatcaaggccctcctgagcatcaacctggacgaccacgagatcatcttcatcaacaaggtgaagtcctgcgacgccaccttcctcaacgtgagcggctgctactcctgcgactacggggcgcacgtctgcgtgaaggtcaagagctccgagagcgccgacttcttcgccgagtccgaggacaagaccaccgtgctgagcttccccatccagtccggcacgcgcgactactgccaggtgctgcacttccagaagcccctcgtcgacgagcggctgagctactcctgcggcagcgagcccaagctgatcgtgatcaaggggaccctcgtgtacatgggcgtctacgacttccgcgacaagaccgggggctccagcaccgtgatcaacccgtccgaggggacgtggagcatcagcaactggttctccggcctgctggactggctcggcgggcccatgaaggccatcctgaagatcctgggcttcatcgcgatcgggatcgtgtgcttcatcctcttcatgatcctgatccggatcgccgtcaacagcatcaacatcaagaagaagaactga

SEQ ID NO: 12727 - RNA, 3942 nt, synthetic construct
  misc_feature 1..3942: note = derived and/or modified CDS sequence (opt1) from PTV__M11156.1__GP
  source 1..3942: mol_type = other RNA
atgatcttcaccatcctgaacgtgctcacccgcgccatgctggtcatgagcatgtactccctgacgacctgggacagcacctcccggaacgacatgtgcttcagcaacgacagccccctcgagggcctggtgtactactgggagacccacagcaagcgccacgactacaagaagcaggagtcccagcggtgccgcgtgggggacagcgacaagaagatgatcacgaacgtcaccatcatctccctgatcagcgagatccagaagtccatcagcgagctctccctgagctgcgtgaacgacgacaactccaccggccaggtgctgaccttcaacgggctcgaggacacgatccggggcgactacatcgtcgactgcgtgaccgggctgtaccagagcgacatcggcgtgggcgtcgggctgggccgcacccaccacgggcaccagcagatgaagaacaaggccgtggtgatcgacgagaaggagcggatgatctccctcctggagacccagcagagcgagaacgacatcaagatgcaggtcctgatgtccgagatcgagcagctcaagaaccagctgagcaagaagcgcaacgagcggggccaggagaagcgcgacgcggagaaggtgatgagcgacctgatggcccggaactccgacctccgcaagcacaacgacatcctgacggccgagatcagccagatgaagaacaagaacaccatccagcggaacaagaacaccgtgtccaccacggtcgtgccggccatcctgagcgtggccctcctgtccagctccgtcgcgcccatcatcgccgccccgcccgacagccccatgatcaacccctggccccacgccaagaaccgcgtggggaccggcatgtacaagtacgacgagaacgacgactccggctgccggcccatccgctacggggtgagctgcatcggcttcgacttcatgctgaagatggacaagtacccgttcttcaacgcgttcatcgggcacaagacgcccctcgagtccttcgccgacaagatcatcgagaaggaggaggagacctgcgagatcggcaccaacaaggagttcaagtgcttcgaggagcgggcctacatcaaggggacctgccccaccaacatcaacgccgtccactacatcgacaacaaggggaagctgcgctacgtgaagtgcaaggagaacctggagatgaccgaggactgcgccttctgccggaagatcaagaagaaggcgggccagagcgtgcaggtccagaagacgtccgtgcccctccaggacgccatctgccaggagaacagcgacacctactccgggccgaagatccccttcaagggcgtctgcaagatcgggctgatcaagtacaaggagtgcaagttcaagaccagctcctacgagaccgtgagcttcatcacgctgaaggagaagggcaagatctacatcgagcacctcatgctgaagaacatcgaggtggtcaccaacgtgtccttcgtgtgctacgagcacgtcggccaggacgagcaggaggtggagcaccgcgccctgaagcgggtgagcgtcaacgactgcaagatcgtggacaacagcaagcagaagatctgcaccggggaccacgtgttctgcgagaagtacgactgctccaccagctaccccgacgtcacgtgcatccacgcccccggctccgggccgctctacatcaacctgatgggcagctggatcaagccccagtgcgtggggtacgagcgcgtgctggtcgaccgcgaggtgaagcagcccctcctggcccccgagcagaactgcgacacgtgcgtgtccgagtgcctggacgagggcgtccacatcaagagcaccggcttcgagatcacctccgcggtggcctgcagccacgggtcctgcatcagcgcccaccaggagccgtccaccagcgtgatcgtcccctaccccggcctcctggcctccgtcgggggccggatcgggatccacctgagccacacctccgacagcgcctccgtgcacatggtggtggtgtgcccgccccgcgacagctgcgcggcccacaactgcctcctgtgctaccacggcatcctgaactaccagtgccacagcaccctctccgccatcctgaccagcttcctgctcatcctgttcatctacaccgtcttctccgtgacgaccaacatcctgtacgtgctgcggctcatccccaagcagctgaagtcccccgtcggctggctgaagctgttcatcaactggctgctgaccgccctccgcatcaagacccggaacgtgatgcgccggatcaaccagcgcatcgggtgggtggaccaccacgacgtcgagcggccccgccaccgggagccgatgcgccggttcaagacgaccctgctgctcaccctgatcatgatgaccggcgggaacgcctgctccaacacggtggtggcgaacagcaagcagacccgctgcgtccaggagggctccaacaccaagtgcagcatcaccgccacgatcaccctgcgggccggcgtgatcggggccgagtcctgcttcatcatcaagggccccatggagaaccagcagaagaccatcagcatcaagaccatctccagcgagacggtgtgccgcgaggggtccagcttctggacctccctctacatccccagctgcctgtccagccggcgctgccacctggtcggcgactgcgtggggaacaagtgccagtcctggcgggacgaccagctcagccgcgagttcagcggcgtgaaggacaaccacatcatgaacgagaacaagtgcttcgagcagtgcggcgcgatcgggtgcggctgcttcaacatcaacccgtcctgcctgtacgtccacgcctacctcaagagcgcccgcaacgaggccgtgcgggtgttctcctgcagcgactgggtccaccgcgtgtccttcgaggtgaaggggcccgacggcgagaccgagctcgtcaccctggggagccccggcacgaagttcctgaactggggcaccctctccctgagcctggacgccgaggggatctccggcaccaacagcatctccttcctcgagagctccaagggcggcttcgcgctgtacgacgaggggtacaacgagatcccccgggagggcttcctgggcgagatccgctgcagctccgagagcgccgccatctccgcccacaagagctgcatccgggccccggggctcatcaagtacaagcccatgaccgaccagatcgagtgcacggcgtccctggtggaccccttcgccatcttcctgaagggcagcctcccccagacccgcaacgggcagaccttcaccagcacgaaggacaagaagaccgtgcaggccttcaccaacggcgccatcaaggccctgctgtccatcaacctcgacgaccacgagatcgtcttcatcaacaaggtgaagaactgcgacgcgaccttcctgaacgtcagcgggtgctactcctgcgactacggcgcccacgtgtgcgtgaaggtcaagagctccgagagcgccgacttcttcgccgagtccgaggacaagacgaccgtgctgagcttcccgatccagtccggcacccacgactactgccaggtgctccacttccagaagcccctggtcgacgagcggctgagctactcctgcgggagcgagcccaagctcatcgtgatcaagggcaccctggtgtgcatgggggtctacgacttccgcaacaagacgggcggctccagcaccgtggtgaacccctccgagggggcgtggagcatctccaactggttcagcggcctgctcgactggctcgggggcccgatgaaggccatcctgaagatcctggggttcatcgccatcggcatcgtctgcttcgtgctgttcatgatcctgatccggatcgccgtgaactccatcaacatcaagaagaagaactga

SEQ ID NO: 12728 - RNA, 3852 nt, synthetic construct
  misc_feature 1..3852: note = derived and/or modified CDS sequence (opt1) from Phlebovirus(CoAr170255)__HM566149.1__GP
  source 1..3852: mol_type = other RNA
atgtacaagctgatcaccaacatcctcaagctgagcgtggtctccgccatgtacagcatcatgttctgggaccccaccggcatctccaagctgtgcctcagcaacaactccccgctggaggggctggtgtactactgggagaacacgatgcgcgagggcgagttcaagcgggagaagcgcaagaagtgccggctcgggatcagcgagcccgcccccgtgtccaaccagaccatcgtcagcctgatcgaggaggtgcagaagtcccccgcggagatgatcctgatctgcgaggccaacggcaacagcaccgggtccagcctctccttcgacggcctgagcgacaacgagatcaagccgtccatcgtggactgcaccacgggcgaccgcaccagcgacctgcgggtcctcgtggggaagggcatcttcgagaagaagatgtccatgagcaacgagatcgaccgcgtggtctccctggaggaccacctccagcgggagaaggagctggtgcagaccttccaggacctgcaccacaacgagagcgagaagaacaagctgctcgagcacgagctggagaacgtgcgccagcagctgaagcgggagcgcgagagcaacaagatcaagatgtggaccacgaagcggcccgagatcaccaccatcgggctcaccacgaccatcgccaccatcctgctggcctcccagagcgtcgcctccagcgtgcccatgcccggccagctcaacacctggccgcacgcgaagaaccgcgtcgggggcggcgtgttcaaggccaacgacgacgacgaggactcctgcaagctgatcgactacgggatcgcctgccacggcttcgactacctgctccggacggacatctaccccttcttcaacgcccacgtgagccaccgctccctgctggaggcgagcaacgaggggatcatcctcaaggacgaggcctcctgcgagatcgagaccaacaaggacttcaagtgctacgaggagcgggccttcctgaagtggagctgcccccacctggtgaactccgcccacttcatcgacagcaagggcaagctccgcatcatcaagtgcaaggccgagtacgagatcaccgaggactgcacctactgccggcgcatcaagaagaaggcggcccagcagaagcaggtctacaagtccagcatcgccctgcaggacgccgtgtgccaggagaactccgactactacgacggcccccggatcacgttcaccggggtgtgcaagatcggcaccatggagtacaagaagtgcaagcacaagagctccagcttcgagaacatcgggttcatcaccatccgcgacaagggcaagtactacatcgagaacatgcggacgaagaacatcgagatggtctccaacgtgagcttcatctgctacaaccacaacgggcaggacaccgagaaggacgtgcgcctgctcaagcgcgtcaagccgggcgactgcaaggtggtcgacgacagcaagaccaagcactgcaccggcgaccacgtgttctgcgagaagtacgactgcacgaagtcctaccccgaggcgacctgcatgcacgcccccgggagcggccccatcctggtgctggtcatgggggtgtggttcaagccgcagtgcgtgggctacgagcgggtcctcgtggagcgcgaggtgaaggcccccgtcctgatccaggagaaggactgcgacacgtgcgtgttcgagtgcctggaggacaagatcctcatcaagtccaccgggttcaagatgatcagcgccgtggcctgctcccacggcagctgcgtctccagccaccagtcccccagcaccttcctgtacatcgactaccccggcctgaccgcctccgtcgggggcgagatcgggctccacctgagccacaccgacgactccgtgagcgtgcacaagaagatccactgcccggcgcgggacccctgcgaggcccactcctgcatcgtgtgctaccacggcctggtgaactaccagtgccacaccgtcctcagctactccgtggtgagcttcctgctggtctgcatgatgtacctggccttcttcatcacgagccgcctcctgttcttcctgcggatcatgccccgccggctccgcaaccccatctcctggctgaccctgctcatccggtgggtgctgcagaccctgctcgccatcctgcgcctgagcttcaagaagctctccgagaccatcgggtggaacagcccgaacaaccggcagcagatggacgtggaggccaaccgccggcccctgcgccggtaccgcaccacgttcatcctgaccctcctgttcgtcggcctgacctccgcgtgcagcaacaccgccgtgtccaacagcaagcagacgaagtgcctccagtccggcgggagcgtgaagtgctccatcaccgccaccatcaccctgaaggccggcacgatcggggcggagagctgcttcatcatcaagggcccctccgagaaccagcagaaggtcatccgggtgaagaccgtgagctccgagaccgtctgccgcgagggcagctccttctggaccgggcagttcacgcccagctgcgtgtccagccggcgctgccacctggtgggcgactgcgtcgggaaccgctgccaggcctggcgggacgaggtggtgagccgcgagttcggcaacatgaaggacaacaacgtcatgtccgagaacaagtgcttcgagcagtgcggggccgccggctgcggctgcttcaacatcaacccgagctgcctctacgtgcactccaccttcaagagcgtgcggcgcgaggccatccgggtcttcaagtgcaacgactgggtgcaccgcctgaccttcgaggtgtccgggcccagcggcgagaaggaccggatcgtcctgaactccctcagcaccaagttcctgcagtgggggacgatctccctgagcctcgacgcggagggcatctccgggaccaacagctactccttcctggagagcaacaagggcggcttcgccatccacgacgaggagttctccgagatcccccgcgaggggtacctgggcgagatccggtgcagctccgagagcgccgtgatcgccgcccacaagtcctgcatccgcgcgccgaacctcatcaagtacaagcccatgaccgaccagatcgactgcaccgccagcctggtggaccccttcgccatcttcctgaaggggagcctcccccagtcccggagcggctacacgttcacctccagcaccgacaagaagaccgtccaggccttcaactccgggagcatcaaggccctgatctccatcaacatggacgaccacgagatcgagttcctgaacgacgcggccgactgcgacgccacgttcctcaacgtgagcggctgctactcctgcaactacggcgcccaggtgtgcatcaaggtccgcagctccaagagctccatcttcagctccaacaacaacgacaacagcatcgtgatcaacttcgacgcggaccaggggacccgggactactgccgcatcatccacttcaacggcccgctggtggacgagaccctgcactactcctgcgggggcgagagcaagctcctgcagatgaaggggtccctgatcaccgtcggcccctacgacttccggaacacgaccggcggcaagagcaccatcgtgaacccccacgaggagagctggaacctcttctcctggttcagcgggctgctggactggctcgggggccccctgcgcgccatcctgaagatcgtcctcatcatcatcatcggcatcatcctgttcatcgtggtggccttcctgatccggctcgtcatcttcaacgtgctgctgaagtccaagaagaactga

SEQ ID NO: 12729 - RNA, 3873 nt, synthetic construct
  misc_feature 1..3873: note = derived and/or modified CDS sequence (opt1) from Phlebovirus(CoAr171616)__HM566154.1__GP
  source 1..3873: mol_type = other RNA
atgttccagatcatctacctgctcaccaagctgtacctggtgagctccatgtacagcatcatgttctgggagaacgagaacatctccaagctctgcctgagcaacaacagccccctggagggcctcgtctactactgggagaacgtgatgaaggagggggacttcaaggaggagaagcgcaagaagtgccggatcggcccgagcgacctgaagcgcgtgaccaaccagacgctgaccaccctcatcgaggaggtccagaagtcccccagcgagatccagctgctgtgcgaggaggacgggaacaagaccggcatctccatgttcttcgacgggctcagcgacgacatctccacgcccagcatcgtggactgcaacggcaacatccggatctccgacctgcgcgtgcaggtcggccgggggcacttcgagaaggagaacgagatccgcaagatcgaggagatcgtgaccctggaggacgacctccggcgcgagcgggacctgaacaagctgctccaggacctgaacaagaaggacgccgaggagcgccggatcatcgagcacgagctgaccaacatgcgcgagcagctccagcgggagcgcgagcggagcaagcagcagatcaaggagcacgagaagatcgaggtgaacaaccacaaggagcccgccacccacctgaacgtctccaagctgctcacgatcggcctgctggcgcagcaggtcggccaggtgatcgccaccgagccggggcagctcaacacctggatccacgccaagaaccgcatcgggaagggcctgtacaagaccgaggacacggacgaggacggctgccgggggctggactacggcgtgagctgcctcgggttcgactacctgctgcgcaccgacatctaccccttcttcaactccttcgtgagccacctctccatgctggaggccagcaccgaggacctgatcgagaaggagggcaccagctgcgagatcgagacgaacaaggagttcaagtgctacgaggagcgggccttcatcaagggctcctgcccccacctcgtgaacagcgcgcacttcctggacaacaaggggaagctgcgcatcgtcaagtgcaagaccgacttcgagatgaccgaggactgcaccttctgccggaagatcaagaagaagaactcccagcacaagcaggtcttcaagacgagcatcgccctccaggacgccgtgtgccagaacaactccgacctgtacaacggcccccgcatcgtgtacagcaacgtgtgcaagatcgggatggtgtcctacaagcagtgcaagagcaagacctccagctacgagtccgtcggcttcgtgatcctgaaggggaagggcaagttctacatcgagaacatgaagatcaagaacatcgaggtgatcgccaacgtcagcttcatctgccaccagtaccagggccaggacgggaccgagaaggagcagcgctccctcaagcggatcagcgtgggcgagtgcaagtccgtcaacccgcagaagaccaagcactgcacgggggaccacgtgttctgcgagaagtacgactgcaccaagagctaccccgaggtgacctgcctgatggcgcccggctccgggcccatcctggtccagatcatgggcagctggatcaagccgcagtgcgtgggctacgagaaggtgctcgtcgagcgcgaggtgaagtcccccaccctgacggaggagcgggactgcgacacgtgcgtgtacgagtgcctggaggacaagatcctcatcaagagcaccgggttcaagatgatcagcgccgtcgcctgctcccacggcatgtgcgtgagctcccaccaggagcccagcaccttcctgtacatcaactaccccgggatgtccgccagcatcggcggggagatcggcctgcacctgtcccacaccgacgacagcctctccctgcacaaggtgatcagctgcccgtcccgcaacccctgcgacgtccacagctgcatcatctgctaccacggcatcatcaactaccagtgccacaccgccctgtcctacaccatcgtggcgttcagcttcatctccttcctctacctgaccttcaaggtgatcagccagctgctctacacgttcaaggtcgtgcccaagaagctgaaggggcccttctactggatgggctacctgatcaagtggatcgtgaagaccatcctcggggtcgtgcggaacaccttcttcaccatgtccaaccgcatcggctgggagcggcgcgacgagatccacgaggacatcgaggccaacccgcggcgccacctccagcggttcaagaccacgttcgtgctgaccatgctgatgatcaacggcgggctgtgctgcagcaacaccctggtcagcaactccaagcagacccgctgcgtgcagagcggcaacgaggtgaagtgctccgtcagcgccacggtggtgctcaaggccggggtcatcggcgccgagtcctgcttcatcatcaaggggcccagcgagaaccagcacaagatgatctccgtgcggaccctgagctccgagaccgtgtgccgcgagggcgcgagcttctggaccggccacttctcccccagctgcgtctccagccggcgctgccacctggtgggggagtgccacggcaaccggtgccagtcctggcgcgacgaccagatcagccgggagttcgggggcgtgaaggacaacaaccgcatgtccgagaacaagtgcttcgagcagtgcgggagcatcggctgcggctgcttcaacatgaacccctcctgcctctacgtccacacgaccctgaagtccgcccgcaacgaggccgtgcgggtgttcaagtgcaacgactggatccaccgcctgaacttcgaggtcatcgggccgagcggcgagaaggacgtggtgaccctcaactccatgagcaccaagttcctgcagtgggggacgatctccctgagcctcgacgccgagggcatcaccgggaccaactcctacagcttcctggagtccagcaagggcggcttcgccatccacgacgaggagttctccgacatcccccgggaggggtacctgggcgagatccgctgcagctccgagagcgcggtcatctccgcccacagctcctgcatccgggcccccgacctcatcaagtacaagcccatgaccgaccagatcgagtgcacgagcaccctgatcgacccgttcgccatcttcatgaaggggtccctgccccagacccgcagcggctacaccttcacgtccagcaaggacaagaagaccatccaggccttcaacaccaacagcatcaaggcgctcatctccctgaacctggacgaccacgagatcgtgttcgtgagcgaccagaccaactgcgagtgcacgttcctcaacctgaccgggtgctactcctgcgactacggcgcccacgtctgcttccggatcaagagcgacaagaagggcgtgttcgtgtccaacaccgaggccaaggacatcagcttcgggttcgaggtcctgaccggcacgcacgactactgccagatccagcacttcaactcccccagcgtgtacaagaccctctcctacagctgcgggggcgagtccaagctgctggtgatcaagggcagcctcatcaccatcgggccgcacgactaccgcaacaagaccggcggggcctccacggtcgtgaaccccagcgaggagggctggtccgtgaccaactggatcgggggcttcatcagctggctgggcgggcccctgaaggcgctcctgaagatcgccgtcaccatcctggccggcgtggtcatcttcctcatcatctacttcttcctgcggctgatcgccaccaacatcctcatgaagacgaagaagaactga

SEQ ID NO: 12730 - RNA, 3852 nt, synthetic construct
  misc_feature 1..3852: note = derived and/or modified CDS sequence (opt1) from Buenaventura virus(CoAr3319)__KP272002.1__GP
  source 1..3852: mol_type = other RNA
atgtacaagctgatcaccaacatcctcaagctgagcatggtgtccgccatgtacagcatcatgttctgggaccccaccggcatctccaagctgtgcctcagcaacaactccccgctggaggggctggtctactactgggagaacacgatgcgcgagggcgagttcaagcgggagaagcgcaagaagtgccggctcgggatcagcgagcccgcccccgtgtccaaccagaccatcgtgagcctgatcgaggaggtccagaagtcccccgcggagatgatcctgatctgcgagaccagcggcaacgccaccgggtccagcctctccttcgacggcctgagcgacaacgaggtgaagccgtccatcgtggactgcgccacgggcgagcgcaccagcgacctgcgggtcctcgtggggaagggcaccttcgagaagaagatgtccatgagcaacgagatcgaccgcgtggtctccctggaggaccacctccagcgggagcgcgagctcgtgcagaccttccaggacctgcaccacaacgagagcgagaagaacaagctgctcgagcacgagctggagaacgtgcggcagcagctgcgccgggagcgcgagagcaacaaggtcaaggtgtggacgaccaagaagcccgaggtgaccaccatcgggctcacgaccaccatcgccaccatcctgctggcctcccagagcatcgcgtccagcgtccccatgcccggccagctcaacacgtggccgcacgccaagaaccgggtcgggggcggcgtgttcaaggccaacgacgacgacgaggactcctgcaagctgatcgactacgggatcgcctgccacggcttcgactacctgctccgcaccgacatctaccccttcttcaacgcgcacgtgagccaccggtccatgctggaggccagcaacgaggggatcatcctgaaggacgaggcctcctgcgagatcgagaccaacaaggacctcaagtgctacgaggagcgcgccttcctgaagtggagctgcccccacctggtgaactccgcccacttcatcgacagcaagggcaagctccggatcatcaagtgcaaggcggagtacgagatcaccgaggactgcacgtactgccgccggatcaagaagaaggccgcccagcagaagcaggtctacaagtccagcatcgccctgcaggacgccgtgtgccaggagaactccgactactacgacggcccccgcatcaccttcaccggggtgtgcaagatcggcagcatggagtacaagaagtgcaagcacaagtccagctccttcgagaacgtggggttcatcaccatccgggacaagggcaagtactacatcgagaacatgcgcatcaagaacatcgagatggtcagcaacgtgagcttcatctgctacaaccacaacgggcaggacacggagaaggacatccgcctgctcaagcgggtcaagccgtccgactgcaaggtggtggacgacagcaagtccaagcactgcaccggcgaccacatcttctgcgacaagtacgactgcaccaagagctaccccgaggcgtcctgcatgcacgcccccggcagcgggcccatcctggtcctggtgatgggcgtgtggttcaagccgcagtgcgtcgggtacgagcgcgtgctcgtggagcgggaggtcaaggtgcccgtgctgacccaggagaaggactgcgacacgtgcgtcttcgagtgccaggaggacaagatcctgatcaagtccaccggcttcaagatgatcagcgccgtggcctgctcccacgggagctgcgtgtccagccaccagtcccccagcaccttcctctacatcgactaccccggcctgaccgcctccgtcggcggggagatcggcctgcacctcagccacacggacgactccatcagcgtgcacaagaagatccactgcccggcgcgcgacccctgcgaggcccacaactgcgtgatctgctaccacgggctgatcaactaccagtgccacaccttcctgagctactccgtcgtgagcttcctcttcatctccgtgctgtacctgaccttcttcatcgtcagccggctgctcctgttcctgaagatcatgcccaagcgcctcaagaaccccatctcctggctgaccctgctcatccggtgggtgctgcagacgctgatcaccatcctccgcctgagcttcaagaagctgtccgagaccatcggctggaccaccaacgacaaccggcagcacgtggacgtcgaggccaaccgccggccgctccgccggtaccgcacgaccttcatcctgaccctgctgttcatcgggctggccagcggctgctccaacaccgccgtgagcaactccaagcagacgaagtgcctgcagagcggcgggtccgtgaagtgcagcatcaccgcgaccatcaccctcaaggccggcatcatcggggccgagtcctgcttcatcatcaagggccccagcgagaaccagcagcgggtcatccgcgtgaagacgatctccagcgagaccgtgtgccgggagggctccagcttctggaccgggctgttcacccccagctgcgtctccagccgccggtgccacctggtgggcgactgcgtggggaaccgctgccagtcctggcgcgacgaggtcgtgagccgggagttcggcaacatgaaggacaacaacgccatgtccgagaacaagtgcttcgagcagtgcggggcggccggctgcggctgcttcaacatcaaccccagctgcctctacgtgcactccgtcttcaagagcgtgcgccgggaggccatccgcgtgttcaagtgcaacgactgggtccaccggctgacgttcgaggtgtccgggccgagcggcgagaaggaccgcatcgtgctgaactccctcagcaccaagttcctgcagtgggggaccatctccctgagcctcgacgccgagggcatctccgggaccaacagctactccttcctggagagcaacaagggcggcttcgccatccacgacgaggagttctccgagatcccccgggaggggtacctgggcgagatccgctgcagcagcgagtccgcggtcatcgccgcccacaagagctgcatccgggcccccaacctcatcaagtacaagccgatgacggaccagatcgactgcaccgcctccctggtggaccccttcgcgatcttcctgaaggggagcctcccccagtcccgcagcggctacaccttcacctccagcacggacaagaagaccgtgcaggccttcaactccggggccatcaaggccctgatcagcatcaacctggacgaccacgagatcgagttcctctccgacaccgccgactgcgacgcgaccttcctgaacatcagcggctgctactcctgcaactacggcgcccaggtctgcatcaaggtgcggagctccaagagctccatcttcagctccaacaacaacgacaacagcatcgtgatcaacttcgacgccgagcaggggacgcgcgactactgccggatcatccacttcaacggccccctggtcgacgagaccctccactacagctgcgggggcgagtccaagctgctgcagatgaaggggagcctcatcaccgtgggcccgtacgacttccgcaacaccacgggcgggaagtccaccgtggtcaacccccacgaggagagctggaacctgttctcctggttcagcggcctgctcgactggctcgggggccccctgcgggccatcctgaagatcgtgctgatcgtcatcatcggcatcatcctgttcatcgtggtggtcttcctcatgcgcctggcgatcctgaacgtgctcctgaagtccaagaagaactga

SEQ ID NO: 12731 - RNA, 3942 nt, synthetic construct
  misc_feature 1..3942: note = derived and/or modified CDS sequence (opt1) from Cocle virus(GML244915)__KP272034.1__GP
  source 1..3942: mol_type = other RNA
atgatgttcacccacctggacgtgctcacccgcgccatgctggtcatgagcatgtactccctgacgacctgggacagcatccggcgcaacgacatctgcttctccaacgacagccccctcgagggcctggtgtactactgggagacccagtccaagatgcacgagtacaagaaggaggacagccagaagtgccgggtgggggactccgagaagaagatgatcagcaacgtcaccatcatctccctgatcagcgagatccagaagtccatcagcgagctctccctgagctgcggcaacgacgacaactccacgggccaggtgctgatgttcaacggcctcgaggacaccatccgcggggactacatcgtggactgcctgaccggcctgtaccagagcgacatcggcgtcggggtgggctccgggaagaccaagcacgaccacacgaagctccggaacaaggccgtgatcatcgacgagaaggagaagatgatcagcctgctggaggcgcagcagtccgagaacgacatcaagacccaggtcctcatgagcgagatcgagcagctgaagacccagctgctcaaccgccggagcgagcgcggccacgagaagcggaagaacgaggagatcgtgtccgacctgatggcccgcaacagcgacctgcggaagcacaacgacatcctcaaggacgagatggaccagatcaaggagaacctgaccatcttcaagtcccgcaacgccatcagcacgacctccgtgccggccatcatgagcatcgccctgctctccagctccgtcatgcccatcatcgcggccgtgagcgactcccccatgatcaacccctggccgcacgccaagaaccgggtggggagcggcatgtacaagtacgacgacaacgacgagtccggctgccgccccatccggtacggggtcagctgcatcggcttcgaccacatgctgaagatggacaagtaccccttcttcaacgccttcatcgggcacaagaccctgctcgagtccttcgtggacaagatcatcgagaaggaggacgagacctgcgagatcggcacgaacaaggagttcaagtgcttcgaggagcgcgcgtacatcaaggggacctgcccccacaacatcaacgccgtgcactacctggacaacaaggggaagctgcggtacgtcaagtgcaaggagaacctcgagatgaccgaggactgcgccttctgccgcaagatcaagaagaaggccggccagagcgtccaggtgcagaagacctccgtgccgctgcaggacgccatctgccaggacaacagcgacatctacacggggccccggatcccctacaagggcatgtgcaagatcgggctggtgaagtacaaggagtgcaagtccaagaccagcagctacgagaccgtgtccttcatcaccctcaagggcaagggcaagatctacatcgagcacctgatgctgaagaacatcgaggtcgtgacgaacgtcagcttcgtgtgctacgagcacgcgggccaggtggagcaggaggtcgagcaccgcgccctcaagcgggtgtccgtgaacgactgcaagatcgtcgacagctccaagcagaagatctgcaccggggaccacgtgttctgcgagaagtacgactgcagcacctcctaccccgacgtgacctgcatccaggccccggggagcggccccctgtacgtcaacctgatggggtcctggatcaagccccagtgcgtgggctacgagcgcgtgctcgtcgagcgcgaggtgaagcagcccctgctgacgccggagcagaactgcgacacgtgcgtgagcgagtgcctcgacgagggcgtccacatcaagtccaccgggttcgagatcaccagcgccgtggcctgctcccacggcagctgcatctccgcgcaccaggaggccagcacctccatcatcgtgccctaccccgggctgctggccagcgtcggcgggaagatcggcctccacctgagccacacctccgacagcgcctccgtgcacatgatcgtggtctgcccgccccgggacagctgcgccgcgcacaactgcctgctctgctaccacggcatgctgaactaccagtgccactccaccctgagcgccatcctgacctccttcctcctgatcctgttcatctacacgaccttcagcttcatcaccaacatcctctacctgctgcgcctcctgcccaagcagctgaagtcccccatcgggtggctcaagctgttcatcaactggctgttcaccatcctccggatccgcaccaagtacctgatgggccggctgaaccagcgcatcgggtgggtggagaaccacgacgtggagcggccccgcccgcgggagcccatgcgccggttcaagacgaccctcatgctgaccatgctgatgatcaccggcggctacgcctgcagcaacacggtcgtggccaactccaagcagacccgctgcgtgcaggaggggagcaacaccaagtgctccgtcaccgccacggtgaccctcaaggcgggcgtgatcggggccgagagctgcttcgtcatcaagggccccatggagaaccagcagaagaccatctccatcaagaccgtgagctccgagacggtgtgccgggaggggagctccttctggaccagcctgtacatccccagctgcctgtccagccgccggtgccacctcgtcggcgactgcgtgggcaaccgctgccagtcctggcgggaggaccagctgagccgcgagttctccggggtgaaggacaaccagatcatgaacgagaacaagtgcttcgagcagtgcggcgccatcgggtgcggctgcttcaacatcaacccgagctgcctgtacgtccacgcctacctcaagtccgcgcggaacgaggccgtgcgcgtgttcagctgctccgactgggtccaccgcgtgagcttcgaggtgaaggggcccgacggcgagaccgagctggtcaccctgggctccctcgggacgaagttcctgaactggggcaccctgagcctctccctggacgccgaggggatcaccggcaccaacagcctgtccttcctcgagagctccaagggcgggttcgccctgtacgacgagggcttcagcgagatcccccgggaggggttcctgggcgagatccgctgctccagcgagagcgccgcgatctccgcccacaagagctgcatccgggccccggggctcatcaagtacaagcccatgacggaccagatcgagtgcaccgcctccctggtggaccccttcgccatcttcctgaagggcagcctcccccagacccgcaacgggcagaccttcacgtccaccaaggacaagaagaccgtgcaggcgttcaccacgggcgccatccgggccctgctgagcatcaacctcgacgaccacgagatcaccttcatctccaagatcaagaactgcgaggccaccttcctgaacgtcagcggctgctactcctgcgactacggggcccacgtgtgcatcaagatcaagagctccgagagcgcggacttctacgccgagtccgaggacaagaccacggtgctgagcctcccggtctccagcggcacccaggactactgccaggtgctgcacttccagaagcccctggtggacgagcgcctctcctacagctgcgggtccgagcccaagctgatggtcatcaagggcaccctggtgtacatgggcgtctacgacttccggaacaagaccgggggcagcagcacggtggtgaacccctccgacgccagctggtccatcgccaactggttcagcgggctcctggactggctgggcgggccgctcaaggcgatcctgaagatcctgggcttcatcgccatgggcgtcgtgtgcttcatcctcttcatgatcctgatcaagatcgccgtgcgctccgtcaacatgaagaagaagaactga

SEQ ID NO: 12732 - RNA, 3873 nt, synthetic construct
  misc_feature 1..3873: note = derived and/or modified CDS sequence (opt1) from Campana virus(VP-334K)__KP272041.1__GP
  source 1..3873: mol_type = other RNA
atgctgcacttcatcaccatcaccacgaagttcctcgccgtggccagcatgtacaacctgctgtactgggaccccaacggcctctcccgcctgtgcctgagcaacaactccccgctcgaggggctggtctactactgggagaacctgatgaaggagagcgacttcaagaaggacaagaagaagcactgccggatcggcacctccgtggcggcccccgtgaccaacgagaccctcacgaccctgatcgaggaggtccagaagtcccccagcgagatcatcctgcagtgcgagagccgcaacaacgacaccgggaactccatctacttcgacggcctcgccgacgacatcgagagcccctccatcgtgaactgcgagagcgggaagcgggagtccgacctgcgcgtgctggtcggccagggcctcaagaaggagatcatcctgaacgagatcgccgccatcgaccggcaggcgagcctggaggagcacctccgcggggagaaggccctgacctccctgctccaggagatcagcaagcaggacgaggccgagcggaagcgcctggagcacgaggtgtccagcctgcggcagcagctcatgaacgagcgcgaggagaacaagaagcggaagaacatcccggccttcggcgtgtccagcacgaccagctccagcctgatgaacatctcccgcgtcgtgaccatcgggctgctcagccagcaggcgatcgccaacccctccctgcccggccaggtgaacacctggccccacgccaagaaccggatcgggcagggcctgtaccgcatcgacacgagcgacgaggacggctgccgggggctcaactacggcgtcatctgcctggggttcgaccacctcctgcgcatggacctgtacccgttcttcaacgcctacgtgtcccacctgagcctcctggaggcctacaccgagaacatcatccagaaggacgagaccgagtgcgagatcgagggcggcaaggagttcaagtgctacgaggagcgggcgtacatcaagggggtgtgcccccaccgcatcaagtccgcccactacctggaccagaagggcaagctccggatcatcaagtgcaaggagaacctggagctgaccgaggactgcacgtactgccgcaagatcaagaaggaccgggggcacaccaagcaggtctacaagaccagcgtgcccctccaggacgccatctgccaggacaactccgacgactacagcggccccaagatctccttcaagggggtgtgcaagatcggcatgatcgagtacaaggagtgcaagtacaagagctccagcttcgagaccgtcggcttcatcacgatcaaggagaaggggaagttctacatcgaggacatgaagctgaagaacctggaggtgaccaacaacgtggccttcatctgccaccagtacaccggccaggacgggaccacggacgaggagaaccgccacctcaagcgcatgtccgtcaaggactgcaagaacgtgaacagctccaagagcaagtactgcaccggcgaccacatcttctgccaggtgtacgactgcaccaagagctacccggaggcgacctgcttcgtcgcccccgggtccggccccgtgctggtccaggtgatgggcagctggatcaagccccagtgcgtggggtacgagaaggtcctggtggagcgggaggtgaagatgccgatcctcacggaggagcgcgactgcgacacgtgcgtctacgagtgcaaggaggaccacatcctgatcaagtccaccggcttcaacatgatcagcgccgtggcctgctcccacgggagctgcgtgtccgcccaccaggaccccagcaccttcctgaacatcgagtaccccggcatgtccgccagcgtcgggggcgagatcggcatccacatctcccacaccgacgacagcctgtccctccacaagaagatctactgccccgcgcgggacagctgcgaggcccacaactgcatcatgtgctaccacgggctgatcaactaccagtgccacaccgccctgtcctacgccgtggtgagcttcatgttcgtctccatcgcctacgtgatcttcaacgtgctccgcctggtcctggtggcgctccacgtggtcccgcggaagctcaagagccccatcgactggctgatcctgctgatcaagtgggtgttcctgctcctggccaaggtgatccgcgccttcctgacccacctcaacaccacgatcggctggcgggagcgccagaacaacttcgccgcggacctggaggcccagcggcgccccctgcagcggttcaagaccaccgtcctcctgatgatgatgctgatcagcgtggtgtccagctgctccaacagcgtcgtgtccaacagcaagcagacccgctgcatccagtccgggagcaacaccaagtgctccgtgagcgccacgatcaccctcaaggccggcgtcatcggcgccgagtcctgcttcgtgatcaaggggcccagcgagaaccagcacaagaccatcgtgatccggaccgtctccagcgagacgatctgccgcgagggctccagcttctggaccgggcacttcaccccgtcctgcctgagctcccggcgctgccacctggtgggcgactgcgtggggagccggtgccagggctggcgcgaggacgtcatcagccgggagttcggcggggtgaaggacaacaaccagatgtccgagaacaagtgcttcgagcagtgcggcgcggccgggtgcggctgcttcaacatcaaccccagctgcctctacgtgcacaccatcctgcgctccgcccgcaacgaggccgtccgggtgttcaagtgcaacgactgggtgcacaagctgacgttccacatcaaggggcccaacggcgaggaggaggacgtcgtgctcaacagcctgtccaccaagttcctgagctggggcaccatctccctcagcctggactccgaggggatcaccggcacgaacagctactccttcctggagagctccaagggcgggttcgccatccacgacgaggagttcagcgagatcccccgcgaggggttcctcggcgagatccggtgctccagcgagtccgcggtggtcagcgcccacaagtcctgcatccgcgccccgggcctgatcaagtacaagcccatgaccgaccaggtggagtgcagcgccagcctggtggaccccttcgccatcttcatcaaggggtccctcccgcagacccggagcggctacaccttcacgtccagccgcgacaagcggaccatccaggcgttcaacaacggggccatcaaggccctgctgaccctcaacctggacgaccacgaggtcatcttctccgagagcgtgatcacgtgcgagtgcaccttcctgaacatctccggctgctacagctgcaacttcggggcccaggtgtgcttcaagatcaagtccagcggcatcggcgacttcgtctccagctccgagaccgggaacatcctcttcagcttccccgtgaagtccggcaccgaggactactgccagatccagcacttcaacagccccatggtgtccgagagcctgcagtactcctgcgggggcgagagcaagctgctcctgatcaagggcagcctgatctccgtcgggccctacgactaccgcaacaagaccggcgggagctccacggtggtcaacccggcggaggacagctggtccatcttcaactggctcagcggcttcctggactggctcgggggccccctgcgggccctggtgaagatcgccctggccatcatcggcgccctcgcgctgctgttcatcaccatcatgctcgcccgctccgtgatcagcaacaccctgtcccggaagaagaagaactga

SEQ ID NO: 12733 - RNA, 3594 nt, synthetic construct
  misc_feature 1..3594: note = derived and/or modified CDS sequence (opt1) from RVFV(ZH-548)__DQ380206.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctga

SEQ ID NO: 12734 - RNA, 3594 nt, synthetic construct
  misc_feature 1..3594: note = derived and/or modified CDS sequence (opt1) from RVFV(ZS-6365)__DQ380205.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccagagcgtctccagcaagatcgtggcgcactgcccgccccaggacccctgcctcgtgcacgggtgcatcgtctgcgcccacggcctgatcaactaccagtgccacacggccctgtccgccttcgtggtggtcttcgtgttcagctccatcgccatcatctgcctcgcgatcctgtaccgcgtgctgaagtgcctcaagatcgcgccccggaaggtcctgaaccccctgatgtggatcaccgccttcatccgctggatctacaagaagatggtggcccgcgtggccgacaacatcaaccaggtcaaccgggagatcgggtggatggagggcggccagctcgtgctggggaacccggcccccatcccccgccacgcccccatcccgcggtacagcacctacctgatgctgctcctgatcgtgtcctacgccagcgcctgctccgagctgatccaggcgagctcccgcatcaccacgtgcagcaccgagggcgtcaacaccaagtgccggctctccgggaccgccctgatccgcgccggcagcgtgggggccgaggcctgcctgatgctcaagggcgtgaaggaggaccagacgaagttcctgaagatcaagaccgtcagctccgagctgagctgccgggagggccagtcctactggaccgggagcttctcccccaagtgcctcagctcccgccggtgccacctggtgggcgagtgccacgtgaaccgctgcctgagctggcgggacaacgagacctccgcggagttcagcttcgtcggggagtccaccacgatgcgcgagaacaagtgcttcgagcagtgcggcgggtggggctgcggctgcttcaacgtgaaccccagctgcctcttcgtgcacacctacctgcagtccgtccggaaggaggccctgcgcgtgttcaactgcatcgactgggtgcacaagctcaccctggagatcaccgacttcgacgggagcgtctccacgatcgacctgggcgccagctccagccggttcaccaactgggggtccgtgagcctcagcctggacgccgagggcatctccgggagcaactccttcagcttcatcgagtcccccggcaagggctacgccatcgtggacgagccgttcagcgagatcccccgccaggggttcctgggcgagatccggtgcaactccgagagctccgtcctcagcgcgcacgagtcctgcctgcgcgcccccaacctgatcagctacaagcccatgatcgaccagctcgagtgcaccaccaacctgatcgacccgttcgtggtgttcgagcgggggtccctgccccagacgcgcaacgacaagaccttcgccgccagcaagggcaaccgcggggtccaggccttctccaagggcagcgtgcaggcggacctcaccctgatgttcgacaacttcgaggtggacttcgtcggcgccgccgtgtcctgcgacgccgcgttcctgaacctcaccgggtgctacagctgcaacgccggcgcccgggtgtgcctgtccatcacgagcaccgggaccggcagcctgtccgcccacaacaaggacggcagcctccacatcgtcctgccctccgagaacgggaccaaggaccagtgccagatcctgcacttcacggtgcccgaggtcgaggaggagttcatgtacagctgcgacggcgacgagcgcccgctcctggtgaaggggaccctgatcgccatcgaccccttcgacgaccggcgcgaggcgggcggggagtccaccgtggtcaaccccaagagcggctcctggaacttcttcgactggttcagcggcctcatgtcctggttcgggggccccctgaagaccatcctgctcatctgcctgtacgtggccctgagcatcgggctgttcttcctgctgatctacctcggccggacggggctgtccaagatgtggctggccgccaccaagaaggccagctga

SEQ ID NO: 12735 - RNA, 3594 nt, synthetic construct
  misc_feature 1..3594: note = derived and/or modified CDS sequence (opt1) from RVFV(CAR-R1622)__DQ380219.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccagagcgtctccagcaagatcgtggcgcactgcccgccccaggacccctgcctcgtgcacgggtgcatcgtctgcgcccacggcctgatcaactaccagtgccacacggccctgtccgccttcgtggtggtcttcgtgttcagctccatcgccatcatctgcctcgcgatcctgtaccgcgtgctgaagtgcctcaagatcgcgccccggaaggtcctgaaccccctgatgtggatcaccgccttcatccgctgggtgtacaagaagatggtggcccgcgtcgccgacaacatcaaccaggtgaaccgggagatcgggtggatggagggcggccagctcgtgctggggaacccggcccccatcccccgccacgcccccatcccgcggtacagcacctacctgatgctgctcctgatcgtctcctacgccagcgcctgctccgagctgatccaggcgagctcccgcatcaccacgtgcagcaccgagggcgtgaacaccaagtgccggctctccgggaccgccctgatccgcgccggcagcgtgggggccgaggcctgcctgatgctcaagggcgtcaaggaggaccagacgaagttcctgaagatcaagaccgtgagctccgagctgagctgccgggagggccagtcctactggaccgggagcttctcccccaagtgcctcagctcccgccggtgccacctggtgggcgagtgccacgtcaaccgctgcctgagctggcgggacaacgagacctccgcggagttcagcttcgtgggggagtccaccacgatgcgcgagaacaagtgcttcgagcagtgcggcgggtggggctgcggctgcttcaacgtgaaccccagctgcctcttcgtccacacctacctgcagtccgtgcggaaggaggccctgcgcgtgttcaactgcatcgactgggtccacaagctcaccctggagatcaccgacttcgacgggagcgtgtccacgatcgacctgggcgccagctccagccggttcaccaactgggggtccgtgagcctcagcctggacgccgagggcatctccgggagcaactccttcagcttcatcgagtcccccggcaagggctacgccatcgtcgacgagccgttcagcgagatcccccgccaggggttcctgggcgagatccggtgcaactccgagagctccgtgctcagcgcgcacgagtcctgcctgcgcgcccccaacctgatcagctacaagcccatgatcgaccagctcgagtgcaccaccaacctgatcgacccgttcgtggtcttcgagcgggggtccctgccccagacgcgcaacgacaagaccttcgccgccagcaagggcaaccgcggggtgcaggccttctccaagggcagcgtgcaggcggacctcaccctgatgttcgacaacttcgaggtcgacttcgtgggcgccgccgtgtcctgcgacgccgcgttcctgaacctcaccgggtgctacagctgcaacgccggcgcccgggtctgcctgtccatcacgagcaccgggaccggcaccctgagcgcccacaacaaggacggctccctccacatcgtgctgcccagcgagaacgggacgaaggaccagtgccagatcctgcacttcaccgtccccgaggtggaggaggagttcatgtactcctgcgacggcgacgagcgcccgctcctggtgaaggggaccctgatcgccatcgaccccttcgacgaccggcgcgaggcgggcggggagagcaccgtcgtgaaccccaagtccggcagctggaacttcttcgactggttctccggcctcatgagctggttcgggggccccctgaagacgatcctgctcatctgcctgtacgtggccctgtccatcgggctgttcttcctgctgatctacctcggccggaccgggctgagcaagatgtggctggccgccaccaagaaggcctcctga

SEQ ID NO: 12736 - RNA, 3594 nt, synthetic construct
  misc_feature 1..3594: note = derived and/or modified CDS sequence (opt1) from RVFV(2250/74)__DQ380209.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccagagcgtctccagcaagatcgtggcgcactgcccgccccaggacccctgcctcgtgcacgggtgcatcgtctgcgcccacggcctgatcaactaccagtgccacacggccctgtccgccttcgtggtggtcttcgtgttcagctccatcgccatcatctgcctcgcgatcctgtaccgcgtgctgaagtgcctcaagatcgcgccccggaaggtcctgaaccccctgatgtggatcaccgccttcatccgctggatctacaagaagatggtggcccgcgtggccgacaacatcaaccaggtcaaccgggagatcgggtggatggagggcggccagctcgtgctggggaacccggcccccatcccccgccacgcccccatcccgcggtacagcacctacctgatgctgctcctgatcgtgtcctacgccagcgcctgctccgagctgatccaggcgagctcccgcatcaccacgtgcagcaccgagggcgtcaacaccaagtgccggctctccgggaccgccctgatccgcgccggcagcgtgggggccgaggcctgcctgatgctcaagggcgtgaaggaggaccagacgaagttcctgaagatcaagaccgtcagctccgagctgagctgccgggagggccagtcctactggaccgggagcttctcccccaagtgcctcagctcccgccggtgccacctggtgggcgagtgccacgtgaaccgctgcctgagctggcgggacaacgagacctccgcggagttcagcttcgtcggggagtccaccacgatgcgcgagaacaagtgcttcgagcagtgcggcgggtggggctgcggctgcttcaacgtgaaccccagctgcctcttcgtgcacacctacctgcagtccgtccggaaggaggccctgcgcgtgttcaactgcatcgactgggtgcacaagctcaccctggagatcaccgacttcgacgggagcgtctccacgatcgacctgggcgccagctccagccggttcaccaactgggggtccgtgagcctcagcctggacgccgagggcatctccgggagcaactccttcagcttcatcgagtcccccggcaagggctacgccatcgtggacgagccgttcagcgagatcccccgccaggggttcctgggcgagatccggtgcaactccgagagctccgtcctcagcgcgcacgagtcctgcctgcgcgcccccaacctgatcagctacaagcccatgatcgaccagctcgagtgcaccaccaacctgatcgacccgttcgtggtgttcgagcgggggtccctgccccagacgcgcaacgacaagaccttcgccgccagcaagggcaaccgcggggtccaggccttctccaagggcagcgtgcaggcggacctcaccctgatgttcgacaacttcgaggtggacttcgtcggcgccgccgtgtcctgcgacgccgcgttcctgaacctcaccgggtgctacagctgcaacgccggcgccaaggtgtgcctgtccatcacgagcaccgggaccggcagcctgtccgcccacaacaaggacggcagcctccacatcgtcctgccctccgagaacgggaccaaggaccagtgccagatcctgcacttcacggtgcccgaggtcgaggaggagttcatgtacagctgcgacggcgacgagcggccgctcctggtgaaggggaccctgatcgccatcgaccccttcgacgaccgccgggaggcgggcggggagtccaccgtggtcaaccccaagagcggctcctggaacttcttcgactggttcagcggcctcatgtcctggttcgggggccccctgaagaccatcctgctcatctgcctgtacgtggccctgagcatcgggctgttcttcctgctgatctacctcggccgcacggggctgtccaagatgtggctggccgccaccaagaaggccagctga

SEQ ID NO: 12737 - RNA, 3594 nt, synthetic construct
  misc_feature 1..3594: note = derived and/or modified CDS sequence (opt1) from RVFV(T1)__DQ380201.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccagagcgtctccagcaagatcgtggcgcactgcccgccccaggacccctgcctcgtgcacgggtgcatcgtctgcgcccacggcctgatcaactaccagtgccacacggccctgtccgccttcgtggtggtcttcgtgttcagctccatcgccatcatctgcctcgcggtgctgtaccgcgtcctgaagtgcctcaagatcgcgccccggaaggtgctgaaccccctgatgtggatcaccgccttcatccgctggatctacaagaagatggtggcccgcgtcgccgacaacatcaaccaggtgaaccgggagatcgggtggatggagggcggccagctcgtgctggggaacccggcccccatcccccgccacgcccccatcccgcggtacagcacctacctgatgctgctcctgatcgtctcctacgccagcgcctgctccgagctgatccaggcgagctcccgcatcaccacgtgcagcaccgagggcgtgaacaccaagtgccggctctccgggaccgccctgatccgcgccggcagcgtgggggccgaggcctgcctgatgctcaagggcgtcaaggaggaccagacgaagttcctgaagatcaagaccgtgagctccgagctgagctgccgggagggccagtcctactggaccgggagcttctcccccaagtgcctcagctcccgccggtgccacctggtgggcgagtgccacgtcaaccgctgcctgagctggcgggacaacgagacctccgcggagttcagcttcgtgggggagtccaccacgatgcgcgagaacaagtgcttcgagcagtgcggcgggtggggctgcggctgcttcaacgtgaaccccagctgcctcttcgtccacacctacctgcagtccgtgcggaaggaggccctgcgcgtgttcaactgcatcgactgggtccacaagctcaccctggagatcaccgacttcgacgggagcgtgtccacgatcgacctgggcgccagctccagccggttcaccaactgggggtccgtgagcctcagcctggacgccgagggcatctccgggagcaactccttcagcttcatcgagtcccccggcaagggctacgccatcgtcgacgagccgttcagcgagatcccccgccaggggttcctgggcgagatccggtgcaactccgagagctccgtgctcagcgcgcacgagtcctgcctgcgcgcccccaacctgatcagctacaagcccatgatcgaccagctcgagtgcaccaccaacctgatcgacccgttcgtggtcttcgagcgggggtccctgccccagacgcgcaacgacaagaccttcgccgccagcaagggcaaccgcggggtgcaggccttctccaagggcagcgtgcaggcggacctcaccctgatgttcgacaacttcgaggtcgacttcgtgggcgccgccgtgtcctgcgacgccgcgttcctgaacctcaccgggtgctacagctgcaacgccggcgcccgggtctgcctgtccatcacgagcaccgggaccggcagcctgtccgcccacaacaaggacggcagcctccacatcgtgctgccctccgagaacgggaccaaggaccagtgccagatcctgcacttcacggtccccgaggtggaggaggagttcatgtacagctgcgacggcgacgagcgcccgctcctggtgaaggggaccctgatcgccatcgaccccttcgacgaccggcgcgaggcgggcggggagtccaccgtcgtgaaccccaagagcggctcctggaacttcttcgactggttcagcggcctcatgtcctggttcgggggccccctgaagaccatcctgctcatctgcctgtacgtggccctgagcatcgggctgttcttcctgctgatctacctcggccggacggggctgtccaagatgtggctggccgccaccaagaaggccagctga

SEQ ID NO: 12738 - RNA, 3594 nt, synthetic construct
  misc_feature 1..3594: note = derived and/or modified CDS sequence (opt1) from RVFV(1853/78)__DQ380220.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcgtcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcgtgttcgtgttcagctccatcgccatcatctgcctcgcgatcctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgtcctggggaacccggcccccatcccccgccacgcccccatcccgcggtacagcacctacctgatgctgctcctgatcgtgtcctacgccagcgcctgctccgagctgatccaggcgagctcccgcatcaccacgtgcagcaccgagggcgtgaacaccaagtgccggctctccgggaccgccctgatccgcgccggcagcgtcggggccgaggcctgcctgatgctcaagggcgtgaaggaggaccagacgaagttcctgaagatcaagaccgtgagctccgagctgagctgccgggagggccagtcctactggaccgggagcttctcccccaagtgcctcagctcccgccggtgccacctggtcggcgagtgccacgtgaaccgctgcctgagctggcgggacaacgagacctccgcggagttcagcttcgtgggggagtccaccacgatgcgcgagaacaagtgcttcgagcagtgcggcgggtggggctgcggctgcttcaacgtcaaccccagctgcctcttcgtgcacacctacctgcagtccgtgcggaaggaggccctgcgcgtcttcaactgcatcgactgggtgcacaagctcaccctggagatcaccgacttcgacgggagcgtgtccacgatcgacctgggcgccagctccagccggttcaccaactgggggtccgtcagcctcagcctggacgccgagggcatctccgggagcaactccttcagcttcatcgagtcccccggcaagggctacgccatcgtggacgagccgttcagcgagatcccccgccaggggttcctgggcgagatccggtgcaactccgagagctccgtgctcagcgcgcacgagtcctgcctgcgcgcccccaacctgatcagctacaagcccatgatcgaccagctcgagtgcaccaccaacctgatcgacccgttcgtcgtgttcgagcgggggtccctgccccagacgcgcaacgacaagaccttcgccgccagcaagggcaaccgcggggtgcaggccttctccaagggcagcgtccaggcggacctcaccctgatgttcgacaacttcgaggtggacttcgtgggcgccgccgtctcctgcgacgccgcgttcctgaacctcaccgggtgctacagctgcaacgccggcgcccgggtgtgcctgtccatcacgagcaccgggaccggcaccctgagcgcccacaacaaggacggctccctccacatcgtcctgcccagcgagaacgggacgaaggaccagtgccagatcctgcacttcaccgtgcccgaggtggaggaggagttcatgtactcctgcgacggcgacgagcgcccgctcctggtcaaggggaccctgatcgccatcgaccccttcgacgaccggcgcgaggcgggcggggagagcaccgtggtgaaccccaagtccggcagctggaacttcttcgactggttctccggcctcatgagctggttcgggggccccctgaagacgatcctgctcatctgcctgtacgtcgccctgtccatcgggctgttcttcctgctgatctacctcggccggaccgggctgagcaagatgtggctggccgccaccaagaaggcctcctga

SEQ ID NO: 12739 - RNA, 3594 nt, synthetic construct
  misc_feature 1..3594: note = derived and/or modified CDS sequence (opt1) from RVFV(MP-12)__DQ380208.1__GP
  source 1..3594: mol_type = other RNA
atgtacgtgctgctcaccatcctgaccagcgtcctggtgtgcgaggccatcatccgcgtgtccctcagctccacgcgggaggagacctgcttcggcgacagcaccaaccccgagatgatcgagggggcctgggactccctgcgcgaggaggagatgccggaggagctgagctgctccatcagcggcatccgggaggtcaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtgcgctgcgagcggcgccgggacgccaagcagatcggccgcgagaccatggcggggatcgccatgaccgtcctgcccgccctggccgtgttcgcgctcgcccccgtggtcttcgccgaggacccccacctccggaaccgccccggcaaggggcacaactacatcgacggcatgacccaggaggacgccacgtgcaagccggtgacctacgccggggcgtgcagctccttcgacgtgctgctggagaagggcaagttccccctgttccagagctacgcccaccaccggaccctgctcgaggccgtccacgacaccatcatcgccaaggccgacccgccctcctgcgacctgctgagcgcgcacggcaacccctgcatgaaggagaagctcgtgatgaagacgcactgccccaacgactaccagtccgcccaccacctgaacaacgacgggaagatggccagcgtgaagtgcccgcccaagtacgagctgaccgaggactgcaacttctgccgccagatgaccggcgcctccctcaagaaggggagctaccccctgcaggacctgttctgccagagctccgaggacgacggcagcaagctcaagaccaagatgaagggcgtctgcgaggtgggggtgcaggccctgaagaagtgcgacggccagctgtccacggcgcacgaggtcgtgcccttcgccgtgttcaagaacagcaagaaggtctacctcgacaagctggacctgaagaccgaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcacgggcgacgccgccttctgcagcgcctacgagtgcaccgcgcagtacgccaacgcctactgctcccacgccaacgggagcggcatcgtgcagatccaggtctccggggtgtggaagaagccgctctgcgtcggctacgagcgcgtggtggtcaagcgggagctgagcgcgaagcccatccagcgcgtggagccctgcacgacctgcatcaccaagtgcgagccccacggcctggtggtccggtccaccgggttcaagatcagctccgccgtggcctgcgccagcggcgtgtgcgtcaccgggtcccagagcccgagcaccgagatcacgctcaagtaccccggcatctcccagagctccgggggcgacatcggcgtgcacatggcccacgacgaccagagcgtgtccagcaagatcgtcgcgcactgcccgccccaggacccctgcctggtgcacgactgcatcgtgtgcgcccacgggctgatcaactaccagtgccacaccgccctctccgccttcgtcgtggtgttcgtcttcagctccatcgccatcatctgcctggcgatcctgtaccgcgtgctcaagtgcctgaagatcgcgccccggaaggtgctgaaccccctcatgtggatcaccgccttcatccgctggatctacaagaagatggtcgcccgcgtggccgacaacatcaaccaggtgaaccgggagatcggctggatggagggcgggcagctggtcctgggcaacccggcgcccatcccccgccacgcccccatcccgcggtacagcacctacctgatgctcctgctgatcgtgtcctacgccagcgcctgctccgagctcatccaggcgagctcccgcatcacgacctgcagcaccgagggggtgaacaccaagtgccggctgtccggcacggccctgatccgcgccgggagcgtcggcgccgaggcctgcctcatgctgaagggggtgaaggaggaccagaccaagttcctgaagctcaagaccgtgagctccgagctgagctgccgggagggccagtcctactggaccggcagcttctcccccaagtgcctgagctcccgccggtgccacctcgtcggggagtgccacgtgaaccgctgcctgagctggcgggacaacgagacctccgcggagttcagcttcgtgggcgagtccacgaccatgcgcgagaacaagtgcttcgagcagtgcgggggctgggggtgcggctgcttcaacgtcaaccccagctgcctgttcgtgcacacctacctccagtccgtgcggaaggaggccctgcgcgtcttcaactgcatcgactgggtgcacaagctgaccctcgagatcacggacttcgacggcagcgtgtccaccatcgacctgggggccagctccagccggttcaccaactggggctccgtcagcctgagcctcgacgccgaggggatctccggcagcaactccttcagcttcatcgagtcccccgggaagggctacgccatcgtggacgagccgttcagcgagatcccccgccagggcttcctgggggagatccggtgcaactccgagagctccgtgctgagcgcgcacgagtcctgcctccgcgcccccaacctgatcagctacaagcccatgatcgaccagctggagtgcaccacgaacctcatcgacccgttcgtcgtgttcgagcggggctccctgccccagacccgcaacgacaagaccttcgccgccagcaaggggaaccgcggcgtgcaggccttctccaaggggagcgtccaggcggacctgaccctcatgttcgacaacttcgaggtggacttcgtgggcgccgccgtctcctgcgacgccgcgttcctgaacctgacgggctgctacagctgcaacgccggggcccgggtgtgcctctccatcaccagcaccggcaccgggagcctgtccgcccacaacaaggacggcagcctgcacatcgtgctcccctccgagaacggcacgaaggaccagtgccagatcctgcacttcaccgtccccgaggtggaggaggagttcatgtacagctgcgacggggacgagcgcccgctgctcgtcaagggcaccctgatcgccatcgaccccttcgacgaccggcgcgaggccgggggcgagtccaccgtggtgaaccccaagagcgggtcctggaacttcttcgactggttcagcggcctgatgtcctggttcggcgggcccctcaagacgatcctgctgatctgcctctacgtcgccctgagcatcggcctgttcttcctcctgatctacctcgggggcaccgggctgtccaagatgtggctggccgccaccaagaaggccagctga

SEQ ID NO: 12740 - RNA, 3594 nt, synthetic construct
  misc_feature 1..3594: note = derived and/or modified CDS sequence (opt1) from RVFV(ZM-657)__DQ380204.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaaggcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccagagcgtctccagcaagatcgtggcgcactgcccgccccaggacccctgcctcgtgcacgggtgcatcgtctgcgcccacggcctgatcaactaccagtgccacacggccctgtccgccttcgtggtggtcttcgtgttcagctccatcgccatcatctgcctcgcgatcctgtaccgcgtgctgaagtgcctcaagatcgcgccccggaaggtcctgaaccccctgatgtggatcaccgccttcatccgctggatctacaagaagatggtggcccgcgtggccgacaacatcaaccaggtcaaccgggagatcgggtggatggagggcggccagctcgtgctggggaacccggcccccatcccccgccacgcccccatcccgcggtacagcacctacctgatgctgctcctgatcgtgtcctacgccagcgcctgctccgagctgatccaggcgagctcccgcatcaccacgtgcagcaccgagggcgtcaacaccaagtgccggctctccgggaccgccctgatccgcgccggcagcgtgggggccgaggcctgcctgatgctcaagggcgtgaaggaggaccagacgaagttcctgaagatcaagaccgtcagctccgagctgagctgccgggagggccagtcctactggaccgggagcttctcccccaagtgcctcagctcccgccggtgccacctggtgggcgagtgccacgtgaaccgctgcctgagctggcgggacaacgagacctccgcggagttcagcttcgtcggggagtccaccacgatgcgcgagaacaagtgcttcgagcagtgcggcgggtggggctgcggctgcttcaacgtgaaccccagctgcctcttcgtgcacacctacctgcagtccgtccggaaggaggccctgcgcgtgttcaactgcatcgactgggtgcacaagctcaccctggagatcaccgacttcgacgggagcgtctccacgatcgacctgggcgccagctccagccggttcaccaactgggggtccgtgagcctcagcctggacgccgagggcatctccgggagcaactccttcagcttcatcgagtcccccggcaagggctacgccatcgtggacgagccgttcagcgagatcccccgccaggggttcctgggcgagatccggtgcaactccgagagctccgtcctcagcgcgcacgagtcctgcctgcgcgcccccaacctgatcagctacaagcccatgatcgaccagctcgagtgcaccaccaacctgatcgacccgttcgtggtgttcgagcgggggtccctgccccagacgcgcaacgacaagaccttcgccgccagcaagggcaaccgcggggtccaggccttctccaagggcagcgtgcaggcggacctcaccctgatgttcgacaacttcgaggtggacttcgtcggcgccgccgtgtcctgcgacgccgcgttcctgaacctcaccgggtgctacagctgcaacgccggcgcccgggtgtgcctgtccatcacgagcaccgggaccggcagcctgtccgcccacaacaaggacggcagcctccacatcgtcctgccctccgagaacgggaccaaggaccagtgccagatcctgcacttcacggtgcccgaggtcgaggaggagttcatgtacagctgcgacggcgacgagcgcccgctcctggtgaaggggaccctgatcgccatcgaccccttcgacgaccggcgcgaggcgggcggggagtccaccgtggtcaaccccaagagcggctcctggaacttcttcgactggttcagcggcctcatgtcctggttcgggggccccctgaagaccatcctgctcatctgcctgtacgtggccctgagcatcgggctgttcttcctgctgatctacctcggccggacggggctgtccaagatgtggctggccgccaccaagaaggccagctga

SEQ ID NO: 12741 - RNA, 3594 nt, synthetic construct
  misc_feature 1..3594: note = derived and/or modified CDS sequence (opt1) from RVFV(ZH-501-777)__DQ380202.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggaccccgggcagaccaagcgggagctcaagagcttcgacatctcccagtgcccgaagatcggcggccacgggagcaagaagtgcaccggcgacgccgccttctgctccgcctacgagtgcacggcgcagtacgccaacgcctactgcagccacgccaacgggtccggcatcgtccagatccaggtgagcggggtctggaagaagcccctgtgcgtgggctacgagcgcgtggtcgtgaagcgggagctgtccgcgaagcccatccagcgcgtggagccctgcacgacctgcatcaccaagtgcgagccgcacggcctggtcgtgcggagcaccgggttcaagatctccagcgccgtggcctgcgcctccggcgtctgcgtgaccgggagccagtcccccagcaccgagatcaccctgaagtaccccggcatcagccagtccagcgggggcgacatcggcgtgcacatggcccacgacgaccagtccgtcagctccaagatcgtggcgcactgcccgccccaggacccctgcctcgtgcacgggtgcatcgtctgcgcccacggcctgatcaactaccagtgccacacggccctgagcgccttcgtggtggtcttcgtgttctccagcatcgccatcatctgcctcgcggtgctgtaccgcgtcctgaagtgcctcaagatcgcgccccggaaggtgctgaacccgctgatgtggatcaccgccttcatccgctggatctacaagaagatggtggcccgcgtcgccgacaacatcaaccaggtgaaccgggagatcgggtggatggagggcggccagctcgtgctggggaaccccgcccccatcccccgccacgccccgatcccccggtactccacctacctgatgctgctcctgatcgtcagctacgcctccgcctgcagcgagctgatccaggcgtccagccgcatcaccacgtgctccaccgagggcgtgaacaccaagtgccggctcagcgggaccgccctgatccgcgccggctccgtgggggccgaggcctgcctgatgctcaagggcgtcaaggaggaccagacgaagttcctgaagatcaagaccgtgagcagcgagctgtcctgccgggagggccagagctactggaccgggtccttcagccccaagtgcctctccagccgccggtgccacctggtgggcgagtgccacgtcaaccgctgcctgtcctggcgggacaacgagaccagcgcggagttctccttcgtgggggagagcaccacgatgcgcgagaacaagtgcttcgagcagtgcggcgggtggggctgcggctgcttcaacgtgaacccctcctgcctcttcgtccacacctacctgcagagcgtgcggaaggaggccctgcgcgtgttcaactgcatcgactgggtccacaagctcaccctggagatcaccgacttcgacgggtccgtgagcacgatcgacctgggcgcctccagctcccggttcaccaactgggggagcgtgtccctcagcctggacgccgagggcatcagcgggtccaacagcttctccttcatcgagagcccgggcaagggctacgccatcgtcgacgagcccttctccgagatcccccgccaggggttcctgggcgagatccggtgcaacagcgagtccagcgtgctctccgcgcacgagagctgcctgcgcgcccccaacctgatctcctacaagccgatgatcgaccagctcgagtgcaccaccaacctgatcgaccccttcgtggtcttcgagcgggggagcctgccccagacgcgcaacgacaagaccttcgccgcctccaagggcaaccgcggggtgcaggccttcagcaagggctccgtgcaggcggacctcaccctgatgttcgacaacttcgaggtcgacttcgtgggcgccgccgtgagctgcgacgccgcgttcctgaacctcaccgggtgctactcctgcaacgccggcgcccgggtctgcctgagcatcacgtccaccgggaccggcagcctgagcgcccacaacaaggacggctccctccacatcgtgctgcccagcgagaacgggaccaaggaccagtgccagatcctgcacttcacggtcccggaggtggaggaggagttcatgtactcctgcgacggcgacgagcgccccctcctggtgaaggggaccctgatcgccatcgaccccttcgacgaccggcgcgaggcgggcggggagagcaccgtcgtgaaccccaagtccggcagctggaacttcttcgactggttctccggcctcatgagctggttcgggggcccgctgaagaccatcctgctcatctgcctgtacgtggccctgtccatcgggctgttcttcctgctgatctacctcggccggacggggctgagcaagatgtggctggccgccaccaagaaggcctcctga

SEQ ID NO: 12742 - RNA, 3594 nt, synthetic construct
  misc_feature 1..3594: note = derived and/or modified CDS sequence (opt1) from RVFV(OS-3)__DQ380184.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcgtcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcgtgttcgtgttcagctccgtcgccatcatctgcctcgcgatcctgtacaaggtgctgaagtgcctcaagatcgcgccccgcaaggtgctgaaccccctgatgtggatcaccgccttcatccggtgggtctacaagaagatggtggcccgcgtggccgacaacatcaaccaggtcaaccgcgagatcgggtggatggagggcggccagctcgccctggggaacccggcccccatcccccggcacgcccccatcccgcgctacagcacctacctgatgctgctcctgatcgtgtcctacgccagcgcgtgctccgagctgatccaggccagctcccggatcaccacgtgcagcaccgagggcgtgaacaccaagtgccgcctctccgggaccgccctgatccgggccggcagcgtcggggccgaggcgtgcctgatgctcaagggcgtgaaggaggaccagacgaagttcctgaagatcaagaccgtgagctccgagctgagctgccgcgagggccagtcctactggaccgggagcttctcccccaagtgcctcagctcccggcgctgccacctggtcggcgagtgccacgtgaaccggtgcctgagctggcgcgacaacgagacctccgccgagttcagcttcgtgggggagtccaccacgatgcgggagaacaagtgcttcgagcagtgcggcgggtggggctgcggctgcttcaacgtcaaccccagctgcctcttcgtgcacacctacctgcagtccgtgcgcaaggaggccctgcgggtcttcaactgcatcgactgggtgcacaagctcaccctggagatcaccgacttcgacgggagcgtgtccacgatcgacctgggcgccagctccagccgcttcaccaactgggggtccgtcagcctcagcctggacgccgagggcatctccgggagcaactccttcagcttcatcgagtcccccggcaagggctacgcgatcgtggacgagccgttcagcgagatcccccggcaggggttcctgggcgagatccgctgcaactccgagagctccgtgctcagcgcccacgagtcctgcctgcgggcccccaacctgatcagctacaagcccatgatcgaccagctcgagtgcaccaccaacctgatcgacccgttcgtcgtgttcgagcgcgggtccctgccccagacgcggaacgacaagaccttcgccgccagcaagggcaaccgcggggtgcaggcgttctccaagggcagcgtccaggccgacctcaccctgatgttcgacaacttcgaggtggacttcgtgggcgccgccgtctcctgcgacgcggccttcctgaacctcaccgggtgctacagctgcaacgccggcgcccgcgtgtgcctgtccatcacgagcaccgggaccggcaccctgagcgcccacaacaaggacggctccctccacatcgtcctgcccagcgagaacgggacgaaggaccagtgccagatcctgcacttcaccgtgcccgaggtggaggaggagttcatgtactcctgcgacggcgacgagcggccgctcctggtcaaggggaccctgatcgcgatcgaccccttcgacgaccgccgggaggccggcggggagagcaccgtggtgaaccccaagtccggcagctggaacttcttcgactggttctccggcctcatgagctggttcgggggccccctgaagacgatcctgctcatctgcctgtacgtcgccctgtccatcgggctgttcttcctgctgatctacctcggccgcaccgggctgagcaagatgtggctggccgccaccaagaaggcgtcctga

SEQ ID NO: 12743 - RNA, 3594 nt, synthetic construct
  misc_feature 1..3594: note = derived and/or modified CDS sequence (opt1) from RVFV(Sudan 86-2010)__JQ820489.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcgtgttcgtgttcagctccatcgccatcatctgcctcgcgatcctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgtcctggggaacccggcccccatcccccgccacgcccccatcccgcggtacagcacctacctgatgctgctcctgatcgtgtcctacgccagcgcctgctccgagctgatccaggcgagctcccgcatcaccacgtgcagcaccgagggcgtgaacaccaagtgccggctctccgggaccgccctgatccgcgccggcagcgtcggggccgaggcctgcctgatgctcaagggcgtgaaggaggaccagacgaagttcctgaagatcaagaccgtgagctccgagctgagctgccgggagggccagtcctactggaccgggagcttctcccccaagtgcctcagctcccgccggtgccacctggtcggcgagtgccacgtgaaccgctgcctgagctggcgggacaacgagacctccgcggagttcagcttcgtgggggagtccaccacgatgcgcgagaacaagtgcttcgagcagtgcggcgggtggggctgcggctgcttcaacgtcaaccccagctgcctcttcgtgcacacctacctgcagtccgtgcggaaggaggccctgcgcgtcttcaactgcatcgactgggtgcacaagctcaccctggagatcaccgacttcgacgggagcgtgtccacgatcgacctgggcgccagctccagccggttcaccaactgggggtccgtcagcctcagcctggacgccgagggcatctccgggagcaactccttcagcttcatcgagtcccccggcaagggctacgccatcgtggacgagccgttcagcgagatcccccgccaggggttcctgggcgagatccggtgcaactccgagagctccgtgctcagcgcgcacgagtcctgcctgcgcgcccccaacctgatcagctacaagcccatgatcgaccagctcgagtgcaccaccaacctgatcgacccgttcgtcatcttcgagcgggggtccctgccccagacgcgcaacgacaagaccttcgccgccagcaagggcaaccgcggggtgcaggccttctccaagggcagcgtgcaggcggacctcaccctgatgttcgacaacttcgaggtcgacttcgtgggcgccgccgtgtcctgcgacgccgcgttcctgaacctcaccgggtgctacagctgcaacgccggcgcccgggtctgcctgtccatcacgagcaccgggaccggcaccctgagcgcccacaacaaggacggctccctccacatcgtgctgcccagcgagaacgggacgaaggaccagtgccagatcctgcacttcaccgtccccgaggtggaggaggagttcatgtactcctgcgacggcgacgagcgcccgctcctggtgaaggggaccctgatcgccatcgaccccttcgacgaccggcgcgaggcgggcggggagagcaccgtcgtgaaccccaagtccggcagctggaacttcttcgactggttctccggcctcatgagctggttcgggggccccctgaagacgatcctgctcatctgcctgtacgtggccctgtccatcgggctgttcttcctgctgatctacctcggccggaccgggctgagcaagatgtggctggccgccaccaagaaggcctcctga

SEQ ID NO: 12744 - RNA, 3594 nt, synthetic construct
  misc_feature 1..3594: note = derived and/or modified CDS sequence (opt1) from RVFV(T-46 (228113))__DQ380199.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccaaggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccagagcgtctccagcaagatcgtggcgcactgcccgccccaggacccctgcctcgtgcacgggtgcatcgtctgcgcccacggcctgatcaactaccagtgccacacggccctgtccgccttcgtggtggtcttcgtgttcagctccatcgccatcatctgcctcgcggtgctgtaccgcgtcctgaagtgcctcaagatcgcgccccggaaggtgctgaaccccctgatgtggatcaccgccttcatccgctggatctacaagaagatggtggcccgcgtcgccgacaacatcaaccaggtgaaccgggagatcgggtggatggagggcggccagctcgtgctggggaacccggcccccatcccccgccacgcccccatcccgcggtacagcacctacctgatgctgctcctgatcgtctcctacgccagcgcctgctccgagctgatccaggcgagctcccgcatcaccacgtgcagcaccgagggcgtgaacaccaagtgccggctctccgggaccgccctgatccgcgccggcagcgtgggggccgaggcctgcctgatgctcaagggcgtcaaggaggaccagacgaagttcctgaagatcaagaccgtgagctccgagctgagctgccgggagggccagtcctactggaccgggagcttctcccccaagtgcctcagctcccgccggtgccacctggtgggcgagtgccacgtcaaccgctgcctgagctggcgggacaacgagacctccgcggagttcagcttcgtgggggagtccaccacgatgcgcgagaacaagtgcttcgagcagtgcggcgggtggggctgcggctgcttcaacgtgaaccccagctgcctcttcgtccacacctacctgcagtccgtgcggaaggaggccctgcgcgtgttcaactgcatcgactgggtccacaagctcaccctggagatcaccgacttcgacgggagcgtgtccacgatcgacctgggcgccagctccagccggttcaccaactgggggtccgtgagcctcagcctggacgccgagggcatctccgggagcaactccttcagcttcatcgagtcccccggcaagggctacgccatcgtcgacgagccgttcagcgagatcccccgccaggggttcctgggcgagatccggtgcaactccgagagctccgtgctcagcgcgcacgagtcctgcctgcgcgcccccaacctgatcagctacaagcccatgatcgaccagctcgagtgcaccaccaacctgatcgacccgttcgtggtcttcgagcgggggtccctgccccagacgcgcaacgacaagaccttcgccgccagcaagggcaaccgcggggtgcaggccttctccaagggcagcgtgcaggcggacctcaccctgatgttcgacaacttcgaggtcgacttcgtgggcgccgccgtgtcctgcgacgccgcgttcctgaacctcaccgggtgctacagctgcaacgccggcgcccgggtctgcctgtccatcacgagcaccgggaccggcagcctgtccgcccacaacaaggacggcagcctccacatcgtgctgccctccgagaacgggaccaaggaccagtgccagatcctgcacttcacggtccccgaggtggaggaggagttcatgtacagctgcgacggcgacgagcgcccgctcctggtgaaggggaccctgatcgccatcgaccccttcgacgaccggcgcgaggcgggcggggagtccaccgtcgtgaaccccaagagcggctcctggaacttcttcgactggttcagcggcctcatgtcctggttcgggggccccctgaagaccatcctgctcatctgcctgtacgtggccctgagcatcgggctgttcttcctgctgatctacctcggccggacggggctgtccaagatgtggctggccgccaccaagaaggccagctga

SEQ ID NO: 12745 - RNA, 3594 nt, synthetic construct
  misc_feature 1..3594: note = derived and/or modified CDS sequence (opt1) from RVFV(2007000094)__EU574055.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcgtgttcgtgttcagctccatcgccatcatctgcctcgcgatcctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgtcctggggaacccggcccccatcccccgccacgcccccatcccgcggtacagcacctacctgatgctgctcctgatcgtgtcctacgccagcgcctgctccgagctgatccaggcgagctcccgcatcaccacgtgcagcaccgagggcgtgaacaccaagtgccggctctccgggaccgccctgatccgcgccggcagcgtcggggccgaggcctgcctgatgctcaagggcgtgaaggaggaccagacgaagttcctgaagatcaagaccgtgagctccgagctgagctgccgggagggccagtcctactggaccgggagcttctcccccaagtgcctcagctcccgccggtgccacctggtcggcgagtgccacgtgaaccgctgcctgagctggcgggacaacgagacctccgcggagttcagcttcgtgggggagtccaccacgatgcgcgagaacaagtgcttcgagcagtgcggcgggtggggctgcggctgcttcaacgtcaaccccagctgcctcttcgtgcacacctacctgcagtccgtgcggaaggaggccctgcgcgtcttcaactgcatcgactgggtgcacaagctcaccctggagatcaccgacttcgacgggagcgtgtccacgatcgacctgggcgccagctccagccggttcaccaactgggggtccgtcagcctcagcctggacgccgagggcatctccgggagcaactccttcagcttcatcgagtcccccggcaagggctacgccatcgtggacgagccgttcagcgagatcccccgccaggggttcctgggcgagatccggtgcaactccgagagctccgtgctcagcgcgcacgagtcctgcctgcgcgcccccaacctgatcagctacaagcccatgatcgaccagctcgagtgcaccaccaacctgatcgacccgttcgtcgtgttcgagcgggggtccctgccccagacgcgcaacgacaagaccttcgccgccagcaagggcaaccgcggggtgcaggccttctccaagggcagcgtccaggcggacctcaccctgatgttcgacaacttcgaggtggacttcgtgggcgccgccgtctcctgcgacgccgcgttcctgaacctcaccgggtgctacagctgcaacgccggcgcccgggtgtgcctgtccatcacgagcaccgggaccggcaccctgagcgcccacaacaaggacggctccctccacatcgtcctgcccagcgagaacgggacgaaggaccagtgccagatcctgcacttcaccgtgcccgaggtggaggaggagttcatgtactcctgcgacggcgacgagcgcccgctcctggtcaaggggaccctgatcgccatcgaccccttcgacgaccggcgcgaggcgggcggggagagcaccgtggtgaaccccaagtccggcagctggaacttcttcgactggttctccggcctcatgagctggttcgggggccccctgaagacgatcctgctcatctgcctgtacgtcgccctgtccatcgggctgttcttcctgctgatctacctcggccggaccgggctgagcaagatgtggctggccgccaccaagaaggcctcctga

SEQ ID NO: 12746 - RNA, 3594 nt, synthetic construct
  misc_feature 1..3594: note = derived and/or modified CDS sequence (opt1) from RVFV(ZC-3349)__DQ380207.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccaggcggtcagctccaagatcgtggcccactgcccgccccaggacccctgcctcgtgcacgggtgcatcgtctgcgcccacggcctgatcaactaccagtgccacacggccctgagcgccttcgtggtggtcttcgtgttctccagcatcgcgatcatctgcctcgccatcctgtaccgcgtgctgaagtgcctcaagatcgcgccccggaaggtcctgaaccccctgatgtggatcaccgccttcatccgctggatctacaagaagatggtggcccgcgtggccgacaacatcaaccacgtcaaccgggagatcgggtggatggagggcggccagctcgtgctggggaacccggcccccatcccccgccacgcccccatcccgcggtactccacctacctgatgctgctcctgatcgtgagctacgcctccgcgtgcagcgagctgatccaggcctccagccgcatcaccacgtgctccaccgagggcgtcaacaccaagtgccggctcagcgggaccgccctgatccgcgccggctccgtgggggccgaggcgtgcctgatgctcaagggcgtgaaggaggaccagacgaagttcctgaagatcaagaccgtcagcagcgagctgtcctgccgggagggccagagctactggaccgggtccttcagccccaagtgcctctccagccgccggtgccacctggtgggcgagtgccacgtgaaccgctgcctgtcctggcgggacaacgagaccagcgccgagttctccttcgtcggggagagcaccacgatgcgcgagaacaagtgcttcgagcagtgcggcgggtggggctgcggctgcttcaacgtgaacccctcctgcctcttcgtgcacacctacctgcagagcgtccggaaggaggccctgcgcgtgttcaactgcatcgactgggtgcacaagctcaccctggagatcaccgacttcgacgggtccgtcagcacgatcgacctgggcgcctccagctcccggttcaccaactgggggagcgtgtccctcagcctggacgccgagggcatcagcgggtccaacagcttctccttcatcgagagccccggcaagggctacgcgatcgtggacgagccgttctccgagatcccccgccaggggttcctgggcgagatccggtgcaacagcgagtccagcgtcctctccgcccacgagagctgcctgaaggcccccaacctgatctcctacaagcccatgatcgaccagctcgagtgcaccaccaacctgatcgacccgttcgtggtgttcgagcgcgggagcctgccccagacgcggaacgacaagaccttcgccgcctccaagggcaaccgcggggtccaggcgttcagcaagggctccgtgcaggccgacctcaccctgatgttcgacaacttcgaggtggacttcgtcggcgccgccgtgagctgcgacgcggccttcctgaacctcaccgggtgctactcctgcaacgccggcgcccgcgtgtgcctgagcatcacgtccaccgggaccggcagcctgagcgcccacaacaaggacggctccctccacatcgtcctgcccagcgagaacgggaccaaggaccagtgccagatcctgcacttcacggtgcccgaggtcgaggaggagttcatgtactcctgcgacggcgacgagcggccgctcctggtgaaggggaccctgatcgcgatcgaccccttcgacgaccgccgggaggccggcggggagagcaccgtggtcaaccccaagtccggcagctggaacttcttcgactggttctccggcctcatgagctggttcgggggccccctgaagaccatcctgctcatctgcctgtacgtggccctgtccatcgggctgttcttcctgctgatctacctcggccgcacggggctgagcaagatgtggctggccgccaccaagaaggcgtcctga

SEQ ID NO: 12747 - RNA, 3594 nt, synthetic construct
  misc_feature 1..3594: note = derived and/or modified CDS sequence (opt1) from RVFV(2007001602)__EU574043.1__GP
  source 1..3594: mol_type = other RNA
atgtacgtgctgctcaccatcctgatcagcgtcctggtgtgcgaggccgtgatccgcgtctccatcagctccacccgggaggagacgtgcttcggcgacagcaccaaccccgagatgatcgagggggcctgggactccctccgcgaggaggagatgccggaggagctgagctgctccgtgagcggcatccgggaggtgaagacctccagccaggagctgtaccgcgcgctcaaggccatcatcgccgccgacgggctgaacaacatcacgtgccacggcaagaaccccgaggacaagatctccctgatcaaggggccgccccacaagaagcgggtcggcatcgtgcgctgcgagcggcgccgggacgccaagcagatcggccgcgagaccatggcggggatcgccatgaccgtgctccccgccctggccgtcttcgcgctggcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctggagaagggcaagttccccctcttccagagctacgcccaccaccggaccctgctggaggccgtgcacgacaccatcatcgccaaggccgacccgccctcctgcgacctccagagcgcgcacggcaacccctgcatgaaggagaagctggtcatgaagacccactgccccaacgactaccagtccgcccactacctgaacaacgacgggaagatggccagcgtgaagtgcccgcccaagtacgagctcacggaggactgcaacttctgccgccagatgaccggcgcctccctgaagaaggggagctaccccctgcaggacctcttctgccagagctccgaggacgacggcagcaagctgaagaccaagatgaagggcgtgtgcgaggtcggggtgcaggccctgaagaagtgcgacggccagctctccaccgcgcacgaggtggtccccttcgccgtgttcaagaacagcaagaaggtgtacctggacaagctggacctcaagacggaggagaacctgctgcccgactccttcgtctgcttcgagcacaaggggcagtacaagggcaccatggacagcgggcagaccaagcgggagctcaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctgagcgcgaagcccatccagcgcgtcgagccctgcacgacctgcatcaccaagtgcgagccccacggcctcgtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctggtccacgggtgcatcgtgtgcgcccacggcctcatcaactaccagtgccacacggccctgtccgccttcgtggtcatcttcgtgttcagctccaccgccatcatctgcctggcggtgctctaccgcgtcctgaagtgcctgaagatcgcgccccggaaggtgctcaaccccctgatgtggatcaccgccttcatccgctgggtgtacaagaagatggtcgcccgcgtggccgacaacatcaaccaggtgaaccgggagatcgggtggatggagggcggccagctggccctcgggaacccggcccccatcccccgccacgcccccatcccgcggtacagcacctacctgatgctgctgctcatcgtctcctacgccagcgcgtgctccgagctgatccaggccagctcccgcatcacgacctgcagcaccgagggcgtgaacaccaagtgccggctgtccgggacggccctcatccgcgccggcagcgtgggggccgaggcgtgcctgatgctgaagggcgtcaaggaggaccagaccaagttcctcaagatcaagaccgtgagctccgagctgagctgccgggagggccagtcctactggaccgggagcttctcccccaagtgcctgagctcccgccggtgccacctcgtgggcgagtgccacgtcaaccgctgcctgagctggcgggacaacgagacctccgccgagttcagcttcgtgggggagtccacgaccatgcgcgagaacaagtgcttcgagcagtgcggcgggtggggctgcggctgcttcaacgtgaaccccagctgcctgttcgtccacacctacctccagtccgtgcggaaggaggccctgcgcgtgttcaactgcatcgactgggtccacaagctgaccctcgagatcacggacttcgacgggagcgtgtccaccatcgacctgggcgccagctccagccggttcaccaactgggggtccgtgagcctgagcctcgacgccgagggcatctccgggagcaactccttcagcttcatcgagtcccccggcaagggctacgcgatcgtcgacgagccgttcagcgagatcccccgccaggggttcctgggcgagatccggtgcaactccgagagctccgtgctgagcgcccacgagtcctgcctccgcgcccccaacctggtgagctacaagcccatgatcgaccagctggagtgcaccacgaacctcatcgacccgttcgtcgtgttcgagcgggggtccctgccccagacccgcaacgacaagaccttcgccgccagcaagggcaaccgcggggtgcaggcgttctccaagggcagcgtccaggccgacctgaccctcatgttcgacaacttcgaggtggacttcgtgggcgccgccgtctcctgcgacgcggccttcctgaacctgacggggtgctacagctgcaacgccggcgcccgggtgtgcctctccatcaccagcaccgggaccggcacgctgagcgcccacaacaaggacggctccctgcacatcgtcctccccagcgagaacgggaccaaggaccagtgccagatcctgcacttcaccgtgcccgaggtggaggaggagttcatgtactcctgcgacggcgacgagcgcccgctgctcgtcaaggggaccctgatcgcgatcgaccccttcgacgaccggcgcgaggccggcggggagagcacggtggtgaaccccaagtccggcagctggaacttcttcgactggttctccggcctgatgagctggttcgggggccccctcaagaccatcctgctgatctgcctctacgtcgccctgtccatcgggctgttcttcctcctgatctacctgggccggaccgggctcagcaagatgtggctggccgccaccaagaaggcgtcctga

SEQ ID NO: 12748 - RNA, 3594 nt, synthetic construct
  misc_feature 1..3594: note = derived and/or modified CDS sequence (opt1) from RVFV(1260/78)__DQ380214.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccagagcgtctccagcaagatcgtggcgcactgcccgccccaggacccctgcctcgtgcacgggtgcatcgtctgcgcccacggcctgatcaactaccagtgccacacggccctgtccgccttcgtggtggtcttcgtgttcagctccatcgccatcatctgcctcgcgatcctgcaccgcgtgctgaagtgcctcaagatcgcgccccggaaggtcctgaaccccctgatgtggatcaccgccttcatccgctgggtgtacaagaagatggtggcccgcgtcgccgacaacatcaaccaggtgaaccgggagatcgggtggatggagggcggccagctcgtgctggggaacccggcccccatcccccgccacgcccccatcccgcggtacagcacctacctgatgctgctcctgatcgtctcctacgccagcgcctgctccgagctgatccaggcgagctcccgcatcaccacgtgcagcaccgagggcgtgaacaccaagtgccggctctccgggaccgccctgatccgcgccggcagcgtgggggccgaggcctgcctgatgctcaagggcgtcaaggacgaccagacgaagttcctgaagatcaagaccgtgagctccgagctgagctgccgggagggccagtcctactggaccgggagcttctcccccaagtgcctcagctcccgccggtgccacctggtgggcgagtgccacgtcaaccgctgcctgagctggcgggacaacgagacctccgcggagttcagcttcgtgggggagtccaccacgatgcgcgagaacaagtgcttcgagcagtgcggcgggtggggctgcggctgcttcaacgtgaaccccagctgcctcttcgtccacacctacctgcagtccgtgcggaaggaggccctgcgcgtgttcaactgcatcgactgggtccacaagctcaccctggagatcaccgacttcgacgggagcgtgtccacgatcgacctgggcgccagctccagccggttcaccaactgggggtccgtgagcctcagcctggacgccgagggcatctccgggagcaactccttcagcttcatcgagtcccccggcaagggctacgccatcgtcgacgagccgttcagcgagatcccccgccaggggttcctgggcgagatccggtgcaactccgagagctccgtgctcagcgcgcacgagtcctgcctgcgcgcccccaacctgatcagctacaagcccatgatcgaccagctcgagtgcaccaccaacctgatcgacccgttcgtggtcttcgagcgggggtccctgccccagacgcgcaacgacaagaccttcgccgccagcaagggcaaccgcggggtgcaggccttctccaagggcagcgtgcaggcggacctcaccctgatgttcgacaacttcgaggtcgacttcgtgggcgccgccgtgtcctgcgacgccgcgttcctgaacctcaccgggtgctacagctgcaacgccggcgcccgggtctgcctgtccatcacgagcaccgggaccggcaccctgagcgcccacaacaaggacggctccctccacatcgtgctgcccagcgagaacgggacgaaggaccagtgccagatcctgcacttcaccgtccccgaggtggaggaggagttcatgtactcctgcgacggcgacgagcgcccgctcctggtgaaggggaccctgatcgccatcgaccccttcgacgaccggcgcgaggcgggcggggagagcaccgtcgtgaaccccaagtccggcagctggaacttcttcgactggttctccggcctcatgagctggttcgggggccccctgaagacgatcctgctcatctgcctgtacgtggccctgtccatcgggctgttcttcctgctgatctacctcggccggaccgggctgagcaagatgtggctggccgccaccaagaaggcctcctga

SEQ ID NO: 12749 - RNA, 3594 nt, synthetic construct
  misc_feature 1..3594: note = derived and/or modified CDS sequence (opt1) from RVFV(2007000324)__JF326195.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcatcttcgtgttcagctccaccgccatcatctgcctcgcggtgctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgccctggggaacccggcccccatcccccgccacgcccccatcccgcggtacagcacctacctgatgctgctcctgatcgtctcctacgccagcgcgtgctccgagctgatccaggccagctcccgcatcacgacctgcagcaccgagggcgtgaacaccaagtgccggctctccgggacggccctgatccgcgccggcagcgtgggggccgaggcgtgcctgatgctcaagggcgtcaaggaggaccagaccaagttcctgaagatcaagaccgtgagctccgagctgagctgccgggagggccagtcctactggaccgggagcttctcccccaagtgcctcagctcccgccggtgccacctggtgggcgagtgccacgtcaaccgctgcctgagctggcgggacaacgagacctccgccgagttcagcttcgtgggggagtccacgaccatgcgcgagaacaagtgcttcgagcagtgcggcgggtggggctgcggctgcttcaacgtgaaccccagctgcctcttcgtccacacctacctgcagtccgtgcggaaggaggccctgcgcgtgttcaactgcatcgactgggtccacaagctcaccctggagatcacggacttcgacgggagcgtgtccaccatcgacctgggcgccagctccagccggttcaccaactgggggtccgtgagcctcagcctggacgccgagggcatctccgggagcaactccttcagcttcatcgagtcccccggcaagggctacgcgatcgtcgacgagccgttcagcgagatcccccgccaggggttcctgggcgagatccggtgcaactccgagagctccgtgctcagcgcccacgagtcctgcctgcgcgcccccaacctggtgagctacaagcccatgatcgaccagctcgagtgcaccacgaacctgatcgacccgttcgtcgtgttcgagcgggggtccctgccccagacccgcaacgacaagaccttcgccgccagcaagggcaaccgcggggtgcaggcgttctccaagggcagcgtccaggccgacctcaccctgatgttcgacaacttcgaggtggacttcgtgggcgccgccgtctcctgcgacgcggccttcctgaacctcacggggtgctacagctgcaacgccggcgcccgggtgtgcctgtccatcaccagcaccgggaccggcacgctgagcgcccacaacaaggacggctccctccacatcgtcctgcccagcgagaacgggaccaaggaccagtgccagatcctgcacttcaccgtgcccgaggtggaggaggagttcatgtactcctgcgacggcgacgagcgcccgctcctggtcaaggggaccctgatcgcgatcgaccccttcgacgaccggcgcgaggccggcggggagagcacggtggtgaaccccaagtccggcagctggaacttcttcgactggttctccggcctcatgagctggttcgggggccccctgaagaccatcctgctcatctgcctgtacgtcgccctgtccatcgggctgttcttcctgctgatctacctcggccggaccgggctgagcaagatgtggctggccgccaccaagaaggcgtcctga

SEQ ID NO: 12750 - RNA, 3594 nt, synthetic construct
  misc_feature 1..3594: note = derived and/or modified CDS sequence (opt1) from RVFV(KEN/Gar-Msq/131B-04/06)__HM586972.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccttccgcgaggaggagatgccggaggagctgagctgctccgtgagcggcatccgggaggtgaagacctccagccaggagctgtaccgcgcgctcaaggccatcatcgccgccgacgggctgaacaacatcacgtgccacggcaagaaccccgaggacaagatctccctgatcaaggggccgccccacaagaagcgggtcggcatcgtgcgctgcgagcggcgccgggacgccaagcagatcggccgcgagaccatggcggggatcgccatgaccgtgctccccgccctggccgtcttcgcgctggcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctggagaagggcaagttccccctcttccagagctacgcccaccaccggaccctgctggaggccgtgcacgacaccatcatcgccaaggccgacccgccctcctgcgacctccagagcgcgcacggcaacccctgcatgaaggagaagctggtcatgaagacccactgccccaacgactaccagtccgcccactacctgaacaacgacgggaagatggccagcgtgaagtgcccgcccaagtacgagctcacggaggactgcaacttctgccgccagatgaccggcgcctccctgaagaaggggagctaccccctgcaggacctcttctgccagagctccgaggacgacggcagcaagctgaagaccaagatgaagggcgtgtgcgaggtcggggtgcaggccctgaagaagtgcgacggccagctctccaccgcgcacgaggtggtccccttcgccgtgttcaagaacagcaagaaggtgtacctggacaagctggacctcaagacggaggagaacctgctgcccgactccttcgtctgcttcgagcacaaggggcagtacaagggcaccatggacagcgggcagaccaagcgggagctcaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctgagcgcgaagcccatccagcgcgtcgagccctgcacgacctgcatcaccaagtgcgagccccacggcctcgtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctggtccacgggtgcatcgtgtgcgcccacggcctcatcaactaccagtgccacacggccctgtccgccttcgtggtcatcttcgtgttcagctccaccgccatcatctgcctggcggtgctctaccgcgtcctgaagtgcctgaagatcgcgccccggaaggtgctcaaccccctgatgtggatcaccgccttcatccgctgggtgtacaagaagatggtcgcccgcgtggccgacaacatcaaccaggtgaaccgggagatcgggtggatggagggcggccagctggccctcgggaacccggcccccatcccccgccacgcccccatcccgcggtacagcacctacctgatgctgctgctcatcgtctcctacgccagcgcgtgctccgagctgatccaggccagctcccgcatcacgacctgcagcaccgagggcgtgaacaccaagtgccggctgtccgggacggccctcatccgcgccggcagcgtgggggccgaggcgtgcctgatgctgaagggcgtcaaggaggaccagaccaagttcctcaagatcaagaccgtgagctccgagctgagctgccgggagggccagtcctactggaccgggagcttctcccccaagtgcctgagctcccgccggtgccacctcgtgggcgagtgccacgtcaaccgctgcctgagctggcgggacaacgagacctccgccgagttcagcttcgtgggggagtccacgaccatgcgcgagaacaagtgcttcgagcagtgcggcgggtggggctgcggctgcttcaacgtgaaccccagctgcctgttcgtccacacctacctccagtccgtgcggaaggaggccctgcgcgtgttcaactgcatcgactgggtccacaagctgaccctcgagatcacggacttcgacgggagcgtgtccaccatcgacctgggcgccagctccagccggttcaccaactgggggtccgtgagcctgagcctcgacgccgagggcatctccgggagcaactccttcagcttcatcgagtcccccggcaagggctacgcgatcgtcgacgagccgttcagcgagatcccccgccaggggttcctgggcgagatccggtgcaactccgagagctccgtgctgagcgcccacgagtcctgcctccgcgcccccaacctggtgagctacaagcccatgatcgaccagctggagtgcaccacgaacctcatcgacccgttcgtcgtgttcgagcgggggtccctgccccagacccgcaacgacaagaccttcgccgccagcaagggcaaccgcggggtgcaggcgttctccaagggcagcgtccaggccgacctgaccctcatgttcgacaacttcgaggtggacttcgtgggcgccgccgtctcctgcgacgcggccttcctgaacctgacggggtgctacagctgcaacgccggcgcccgggtgtgcctctccatcaccagcaccgggaccggcacgctgagcgcccacaacaaggacggctccctgcacatcgtcctccccagcgagaacgggaccaaggaccagtgccagatcctgcacttcaccgtgcccgaggtggaggaggagttcatgtactcctgcgacggcgacgagcgcccgctgctcgtcaaggggaccctgatcgcgatcgaccccttcgacgaccggcgcgaggccggcggggagagcacggtggtgaaccccaagtccggcagctggaacttcttcgactggttctccggcctgatgagctggttcgggggccccctcaagaccatcctgctgatctgcctctacgtcgccctgtccatcgggctgttcttcctcctgatctacctgggccggaccgggctcagcaagatgtggctggccgccaccaagaaggcgtcctga

SEQ ID NO: 12751 - RNA, 3594 nt, synthetic construct
  misc_feature 1..3594: note = derived and/or modified CDS sequence (opt1) from RVFV(2007004194)__EU574031.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcagcaacgacgggaagatggcctccgtgaagtgcccgcccaagtacgagctgacggaggactgcaacttctgccgccagatgaccggcgccagcctgaagaaggggagctaccccctccaggacctgttctgccagtccagcgaggacgacggctccaagctgaagaccaagatgaagggcgtgtgcgaggtcggggtgcaggccctcaagaagtgcgacggccagctgagcaccgcgcacgaggtggtccccttcgccgtgttcaagaactccaagaaggtgtacctggacaagctcgacctgaagacggaggagaacctgctccccgacagcttcgtctgcttcgagcacaaggggcagtacaagggcaccatggactccgggcagaccaagcgggagctcaagagcttcgacatctcccagtgccccaagatcggcggccacgggagcaagaagtgcaccggcgacgccgccttctgctccgcctacgagtgcacggcgcagtacgccaacgcctactgcagccacgccaacgggtccggcatcgtgcagatccaggtcagcggggtgtggaagaagccgctgtgcgtgggctacgagcgcgtcgtggtgaagcgggagctgtccgcgaagcccatccagcgcgtcgagccctgcacgacctgcatcaccaagtgcgagccccacggcctggtggtgcggagcaccgggttcaagatctccagcgccgtcgcctgcgcctccggcgtgtgcgtgaccgggagccagagcccgtccaccgagatcaccctgaagtaccccggcatcagccagtccagcgggggcgacatcggcgtccacatggcccacgacgaccagtccgtgagctccaagatcgtggcgcactgcccgccccaggacccctgcctcgtccacgggtgcatcgtgtgcgcccacggcctgatcaactaccagtgccacacggccctgagcgccttcgtggtcgtgttcgtgttctccagcatcgccatcatctgcctcgcgatcctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgtcctggggaacccggcccccatcccccgccacgcccccatcccgcggtactccacctacctgatgctgctcctgatcgtgagctacgcctccgcctgcagcgagctgatccaggcgtccagccgcatcaccacgtgctccaccgagggcgtgaacaccaagtgccggctcagcgggaccgccctgatccgcgccggcagcgtcggggccgaggcctgcctgatgctcaagggcgtgaaggaggaccagacgaagttcctgaagatcaagaccgtgtccagcgagctgtcctgccgggagggccagagctactggaccgggtccttcagccccaagtgcctctccagccgccggtgccacctggtcggcgagtgccacgtgaaccgctgcctgtcctggcgggacaacgagaccagcgcggagttctccttcgtgggggagagcaccacgatgcgcgagaacaagtgcttcgagcagtgcggcgggtggggctgcggctgcttcaacgtcaacccctcctgcctcttcgtgcacacctacctgcagagcgtgcggaaggaggccctgcgcgtcttcaactgcatcgactgggtgcacaagctcaccctggagatcaccgacttcgacgggtccgtgagcacgatcgacctgggcgcctccagctcccggttcaccaactgggggagcgtcagcctctccctggacgccgagggcatcagcgggtccaacagcttctccttcatcgagagccccggcaagggctacgccatcgtggacgagccgttctccgagatcccccgccaggggttcctgggcgagatccggtgcaacagcgagtccagcgtgctctccgcgcacgagagctgcctgcgcgcccccaacctgatctcctacaagcccatgatcgaccagctcgagtgcaccaccaacctgatcgacccgttcgtcgtgttcgagcgggggagcctgccccagacgcgcaacgacaagaccttcgccgcctccaagggcaaccgcggggtgcaggccttcagcaagggctccgtccaggcggacctcaccctgatgttcgacaacttcgaggtggacttcgtgggcgccgccgtcagctgcgacgccgcgttcctgaacctcaccgggtgctactcctgcaacgccggcgcccgggtgtgcctgagcatcacgagcaccgggaccggcaccctgtccgcccacaacaaggacggcagcctccacatcgtcctgccctccgagaacgggacgaaggaccagtgccagatcctgcacttcaccgtgcccgaggtggaggaggagttcatgtacagctgcgacggcgacgagcgcccgctcctggtcaaggggaccctgatcgccatcgaccccttcgacgaccggcgcgaggcgggcggggagtccaccgtggtgaaccccaagagcggctcctggaacttcttcgactggttcagcggcctcatgtcctggttcgggggccccctgaagacgatcctgctcatctgcctgtacgtcgccctgagcatcgggctgttcttcctgctgatctacctcggccggaccgggctgtccaagatgtggctggccgccaccaagaaggccagctga

SEQ ID NO: 12752 - RNA, 3594 nt, synthetic construct
  misc_feature 1..3594: note = derived and/or modified CDS sequence (opt1) from RVFV(73HB1230)__DQ380221.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcaggtcggccgcgagacgatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcgtgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagaaggagctgaagtccttcgacatcagccagtgccccaagatcggcggccacgggtccaagaagtgcaccggcgacgccgccttctgcagcgcctacgagtgcaccgcccagtacgccaacgcctactgctcccacgccaacgggagcggcatcgtgcagatccaggtgtccggggtgtggaagaagccgctgtgcgtgggctacgagcgggtcgtggtgaagcgcgagctgagcgcgaagcccatccagcgggtcgagccctgcacgacctgcatcaccaagtgcgagccccacggcctggtggtgcgctccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcgtgttcgtgttcagctccatcgccatcatctgcctcgcgatcctgtaccgggtcctgaagtgcctcaagatcgcgccccgcaaggtgctgaaccccctgatgtggatcaccgccttcatccggtgggtgtacaagaagatggtcgcccgcgtggccgacaacatcaaccaggtgaaccgcgagatcgggtggatggagggcggccagctcgtcctggggaacccggcccccatcccccggcacgcccccatcccgcgctacagcacctacctgatgctgctcctgatcgtgtcctacgccagcgcctgctccgagctgatccaggcgagctcccggatcaccacgtgcagcaccgagggcgtgaacaccaagtgccgcctctccgggaccgccctgatccgggccggcagcgtcggggccgaggcctgcctgatgctcaagggcgtgaaggaggaccagacgaagttcctgaagatcaagaccgtgagctccgagctgagctgccgcgagggccagtcctactggaccgggagcttctcccccaagtgcctcagctcccggcgctgccacctggtcggcgagtgccacgtgaaccggtgcctgagctggcgcgacaacgagacctccgcggagttcagcttcgtgggggagtccaccatcatgcgggagaacaagtgcttcgagcagtgcggcgggtggggctgcggctgcttcaacgtcaaccccagctgcctcttcgtgcacacgtacctgcagtccgtgcgcaaggaggccctgcgggtcttcaactgcatcgactgggtgcacaagctcaccctggagatcaccgacttcgacgggagcgtgtccaccatcgacctgggcgccagctccagccgcttcacgaactgggggtccgtcagcctcagcctggacgccgagggcatctccgggagcaactccttcagcttcatcgagtcccccggcaagggctacgccatcgtggacgagccgttcagcgagatcccccggcaggggttcctgggcgagatccgctgcaactccgagagctccgtgctcagcgcgcacgagtcctgcctgcgggcccccaacctgatcagctacaagcccatgatcgaccagctcgagtgcaccaccaacctgatcgacccgttcgtcgtgttcgagcgcgggtccctgccccagacccggaacgacaagacgttcgccgccagcaagggcaaccgcggggtgcaggccttctccaagggcagcgtccaggcggacctcaccctgatgttcgacaacttcgaggtggacttcgtgggcgccgccgtctcctgcgacgccgcgttcctgaacctcaccgggtgctacagctgcaacgccggcgcccgcgtgtgcctgtccatcaccagcacggggaccggcaccctgagcgcccacaacaaggacggctccctccacatcgtcctgcccagcgagaacgggaccaaggaccagtgccagatcctgcacttcacggtgcccgaggtggaggaggagttcatgtactcctgcgacggcgacgagcggccgctcctggtcaaggggaccctgatcgccatcgaccccttcgacgaccgccgggaggcgggcggggagagcaccgtggtgaaccccaagtccggcagctggaacttcttcgactggttctccggcctcatgagctggttcgggggccccctgaagaccatcctgctcatctgcctgtacgtcgccctgtccatcggcctcttcttcctgctgatctacctcgggcgcacggggctgagcaagatgtggctggccgccaccaagaaggcctcctga

SEQ ID NO: 12753 - RNA, 3594 nt, synthetic construct
  misc_feature 1..3594: note = derived and/or modified CDS sequence (opt1) from RVFV(73HB1449)__DQ380211.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagaacccgagcaccgagatcaccctgaagtaccccggcatcagccagtccagcgggggcgacatcggcgtgcacatggcccacgacgaccagtccgtcagctccaagatcgtggcgcactgcccgccccaggacccctgcctcgtgcacgggtgcatcgtctgcgcccacggcctgatcaactaccagtgccacacggccctgagcgccttcgtggtggtcttcgtgttctccagcatcgccatcatctgcctcgcgatcctgtaccgcgtgctgaagtgcctcaagatcgcgccccggaaggtcctgaaccccctgatgtggatcaccgccttcatccgctgggtgtacaagaagatggtggcccgcgtcgccgacaacatcaaccaggtgaaccgggagatcgggtggatggagggcggccagctcgtgctggggaacccggcccccatcccccgccacgcccccatcccgcggtactccacctacctgatgctgctcctgatcgtcagctacgcctccgcctgcagcgagctgatccaggcgtccagccgcatcaccacgtgctccaccgagggcgtgaacaccaagtgccggctcagcgggaccgccctgatccgcgccggctccgtgggggccgaggcctgcctgatgctcaagggcgtcaaggacgaccagacgaagttcctgaagatcaagaccgtgagcagcgagctgtcctgccgggagggccagagctactggaccgggtccttcagccccaagtgcctctccagccgccggtgccacctggtgggcgagtgccacgtcaaccgctgcctgtcctggcgggacaacgagaccagcgcggagttctccttcgtgggggagagcaccacgatgcgcgagaacaagtgcttcgagcagtgcggcgggtggggctgcggctgcttcaacgtgaacccctcctgcctcttcgtccacacctacctgcagagcgtgcggaaggaggccctgcgcgtgttcaactgcatcgactgggtccacaagctcaccctggagatcaccgacttcgacgggtccgtgagcacgatcgacctgggcgcctccagctcccggttcaccaactgggggagcgtgtccctcagcctggacgccgagggcatcagcgggtccaacagcttctccttcatcgagagccccggcaagggctacgccatcgtcgacgagccgttctccgagatcccccgccaggggttcctgggcgagatccggtgcaacagcgagtccagcgtgctctccgcgcacgagagctgcctgcgcgcccccaacctgatctcctacaagcccatgatcgaccagctcgagtgcaccaccaacctgatcgacccgttcgtggtcttcgagcgggggagcctgccccagacgcgcaacgagaagaccttcgccgcctccaagggcaaccgcggggtgcaggccttcagcaagggctccgtgcaggcggacctcaccctgatgttcgacaacttcgaggtcgacttcgtgggcgccgccgtgagctgcgacgccgcgttcctgaacctcaccgggtgctactcctgcaacgccggcgcccgggtctgcctgagcatcacgtccaccgggaccggcaccctgagcgcccacaacaaggacggcagcctccacatcgtgctgccctccgagaacgggacgaaggaccagtgccagatcctgcacttcaccgtccccgaggtggaggaggagttcatgtacagctgcgacggcgacgagcgcccgctcctggtgaaggggaccctgatcgccatcgaccccttcgacgaccggcgcgaggcgggcggggagtccaccgtcgtgaaccccaagagcggctcctggaacttcttcgactggttcagcggcctcatgtcctggttcgggggccccctgaagacgatcctgctcatctgcctgtacgtggccctgagcatcgggctgttcttcctgctgatctacctcggccggaccgggctgtccaagatgtggctggccgccaccaagaaggccagctga

SEQ ID NO: 12754 - RNA, 3594 nt, synthetic construct
  misc_feature 1..3594: note = derived and/or modified CDS sequence (opt1) from RVFV(ZH-548M12)__M25276.1__GP
  source 1..3594: mol_type = other RNA
atgtacgtgctgctcaccatcctgaccagcgtcctggtgtgcgaggccatcatccgcgtgtccctcagctccacgcgggaggagacctgcttcggcgacagcaccaaccccgagatgatcgagggggcctgggactccctgcgcgaggaggagatgccggaggagctgagctgctccatcagcggcatccgggaggtcaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtgcgctgcgagcggcgccgggacgccaagcagatcggccgcaagaccatggcggggatcgccatgaccgtcctgcccgccctggccgtgttcgcgctcgcccccgtggtcttcgccgaggacccccacctccggaaccgccccggcaaggggcacaactacatcgacggcatgacccaggaggacgccacgtgcaagccggtgacctacgccggggcgtgcagctccttcgacgtgctgctggagaagggcaagttccccctgttccagagctacgcccaccaccggaccctgctcgaggccgtccacgacaccatcatcgccaaggccgacccgccctcctgcgacctgctgagcgcgcacggcaacccctgcatgaaggagaagctcgtgatgaagacgcactgccccaacgactaccagtccgcccaccacctgaacaacgacgggaagatggccagcgtgaagtgcccgcccaagtacgagctgaccgaggactgcaacttctgccgccagatgaccggcgcctccctcaagaaggggagctaccccctgcaggacctgttctgccagagctccgaggacgacggcagcaagctcaagaccaagatgaagggcgtctgcgaggtgggggtgcaggccctgaagaagtgcgacggccagctgtccacggcgcacgaggtcgtgcccttcgccgtgttcaagaacagcaagaaggtctacctcgacaagctggacctgaagaccgaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcacgggcgacgccgccttctgcagcgcctacgagtgcaccgcgcagtacgccaacgcctactgctcccacgccaacgggagcggcatcgtgcagatccaggtctccggggtgtggaagaagccgctctgcgtcggctacgagcgcgtggtggtcaagcgggagctgagcgcgaagcccatccagcgcgtggagccctgcacgacctgcatcaccaagtgcgagccccacggcctggtggtccggtccaccgggttcaagatcagctccgccgtggcctgcgccagcggcgtgtgcgtcaccgggtcccagagcccgagcaccgagatcacgctcaagtaccccggcatctcccagagctccgggggcgacatcggcgtgcacatggcccacgacgaccagagcgtgtccagcaagatcgtcgcgcactgcccgccccaggacccctgcctggtgcacgactgcatcgtgtgcgcccacgggctgatcaactaccagtgccacaccgccctctccgccttcgtcgtggtgttcgtcttcagctccatcgccatcatctgcctggcgatcctgtaccgcgtgctcaagtgcctgaagatcgcgccccggaaggtgctgaaccccctcatgtggatcaccgccttcatccgctggatctacaagaagatggtcgcccgcgtggccgacaacatcaaccaggtgaaccgggagatcggctggatggagggcgggcagctggtcctgggcaacccggcgcccatcccccgccacgcccccatcccgcggtacagcacctacctgatgctcctgctgatcgtgtcctacgccagcgcctgctccgagctcatccaggcgagctcccgcatcacgacctgcagcaccgagggggtgaacaccaagtgccggctgtccggcacggccctgatccgcgccgggagcgtcggcgccgaggcctgcctcatgctgaagggggtgaaggaggaccagaccaagttcctgaagctcaagaccgtgagctccgagctgagctgccgggagggccagtcctactggaccggcagcttctcccccaagtgcctgagctcccgccggtgccacctcgtcggggagtgccacgtgaaccgctgcctgagctggcgggacaacgagacctccgcggagttcagcttcgtgggcgagtccacgaccatgcgcgagaacaagtgcttcgagcagtgcgggggctgggggtgcggctgcttcaacgtcaaccccagctgcctgttcgtgcacacctacctccagtccgtgcggaaggaggccctgcgcgtcttcaactgcatcgactgggtgcacaagctgaccctcgagatcacggacttcgacggcagcgtgtccaccatcgacctgggggccagctccagccggttcaccaactggggctccgtcagcctgagcctcgacgccgaggggatctccggcagcaactccttcagcttcatcgagtcccccgggaagggctacgccatcgtggacgagccgttcagcgagatcccccgccagggcttcctgggggagatccggtgcaactccgagagctccgtgctgagcgcgcacgagtcctgcctccgcgcccccaacctgatcagctacaagcccatgatcgaccagctggagtgcaccacgaacctcatcgacccgttcgtcgtgttcgagcggggctccctgccccagacccgcaacgacaagaccttcgccgccagcaaggggaaccgcggcgtgcaggccttctccaaggggagcgtccaggcggacctgaccctcatgttcgacaacttcgaggtggacttcgtgggcgccgccgtctcctgcgacgccgcgttcctgaacctgacgggctgctacagctgcaacgccggggcccgggtgtgcctctccatcaccagcaccggcaccgggagcctgtccgcccacaacaaggacggcagcctgcacatcgtgctcccctccgagaacggcacgaaggaccagtgccagatcctgcacttcaccgtccccgaggtggaggaggagttcatgtacagctgcgacggggacgagcgcccgctgctcgtcaagggcaccctgatcgccatcgaccccttcgacgaccggcgcgaggccgggggcgagtccaccgtggtgaaccccaagagcgggtcctggaacttcttcgactggttcagcggcctgatgtcctggttcggcgggcccctcaagacgatcctgctgatctgcctctacgtcgccctgagcatcggcctgttcttcctcctgatctacctcgggggcaccgggctgtccaagatgtggctggccgccaccaagaaggccagctga

SEQ ID NO: 12755 - RNA, 3594 nt, synthetic construct
  misc_feature 1..3594: note = derived and/or modified CDS sequence (opt1) from RVFV(ZINGA J83 R1)__KU978776.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctggagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgcctgatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgggtgcatcgtctgcgcccacggcctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctgggtgtaccgcaagatggtggcccgggtcgccgacaacatcaaccaggtgaaccgcgagatcgggtggatggagggcggccagctggtgctggggaacccggcccccatcccccggcacgtccccatcccgcgctacagcacctacctgatgctcctgctgatcgtgtcctacgccagcgcctgctccgagctcatccaggccagctcccggatcaccacgtgcagcaccgagggcgtgaacaccaagtgccgcctgtccgggaccgcgctgatccgggccggcagcgtcggggccgaggcctgcctcatgctgaagggcgtgaaggaggaccagacgaagttcctgaagatcaagaccgtgagctccgagctcagctgccgcgagggccagtcctactggaccgggagcttctcccccaagtgcctgagctcccggcgctgccacctggtcggcgagtgccacgtgaaccggtgcctcagctggcgcgacaacgagacctccgccgagttcagcttcgtgggggagtccaccacgatgcgggagaacaagtgcttcgagcagtgcggcgggtggggctgcggctgcttcaacgtcaaccccagctgcctgttcgtgcacacctacctgcagtccgtgcgcaaggaggcgctccgggtcttcaactgcatcgactgggtgcacaagctgaccctggagatcaccgacttcgacgggagcgtgtccacgatcgacctcggcgccagctccagccgcttcaccaactgggggtccgtcagcctgagcctggacgccgagggcatctccgggagcaactccttcagcttcatcgagtcccccggcaagggctacgccatcgtggacgagccgttcagcgagatcccccggcaggggttcctcggcgagatccgctgcaactccgagagctccgtgctgagcgcccacgagtcctgcctgcgggcgcccaacctcatcagctacaagcccatgatcgaccagctggagtgcaccaccaacctgatcgacccgttcgtcgtgttcgagcgcgggtccctcccccagacgcgcaacgacaagaccttcgccgccagcaagggcaaccgcggggtgcaggccttctccaagggcagcgtccaggccgacctgaccctgatgttcgacaacttcgaggtggacttcgtgggcgcggccgtctcctgcgacgccgccttcctcaacctgaccgggtgctacagctgcaacgcgggcgcccgggtgtgcctgtccatcacgagcaccgggaccggcaccctcagcgcccacaacaaggacggctccctgcacatcgtcctgcccagcgagaacgggacgaaggaccagtgccagatcctccacttcaccgtgcccgaggtggaggaggagttcatgtactcctgcgacggcgacgagcggccgctgctggtccgcgggaccctcatcgccatcgaccccttcgacgaccggcgcgaggccggcggggagagcaccgtggtgaaccccaagtccggcagctggaacttcttcgactggttctccggcctgatgagctggttcgggggccccctgaagacgatcctcctgatctgcctgtacgtcgcgctctccatcgggctgttcttcctgctcatctacctgggccggaccgggctgagcaagatgtggctcgccgccaccaagaaggcctcctga

SEQ ID NO: 12756 - RNA, 3594 nt, synthetic construct
  misc_feature 1..3594: note = derived and/or modified CDS sequence (opt1) from RVFV(Sudan 28-2010)__JQ820491.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcgtgttcgtgttcagctccatcgccatcatctgcctcgcgatcctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgtcctggggaacccggcccccatcccccgccacgcccccatcccgcggtacagcacctacctgatgctgctcctgatcgtgtcctacgccagcgcctgctccgagctgatccaggcgagctcccgcatcaccacgtgcagcaccgagggcgtgaacaccaagtgccggctctccgggaccgccctgatccgcgccggcagcgtcggggccgaggcctgcctgatgctcaagggcgtgaaggaggaccagacgaagttcctgaagatcaagaccgtgagctccgagctgagctgccgggagggccagtcctactggaccgggagcttctcccccaagtgcctcagctcccgccggtgccacctggtcggcgagtgccacgtgaaccgctgcctgagctggcgggacaacgagacctccgcggagttcagcttcgtgggggagtccaccacgatgcgcgagaacaagtgcttcgagcagtgcggcgggtggggctgcggctgcttcaacgtcaaccccagctgcctcttcgtgcacacctacctgcagtccgtgcggaaggaggccctgcgcgtcttcaactgcatcgactgggtgcacaagctcaccctggagatcaccgacttcgacgggagcgtgtccacgatcgacctgggcgccagctccagccggttcaccaactgggggtccgtcagcctcagcctggacgccgagggcatctccgggagcaactccttcagcttcatcgagtcccccggcaagggctacgccatcgtggacgagccgttcagcgagatcccccgccaggggttcctgggcgagatccggtgcaactccgagagctccgtgctcagcgcgcacgagtcctgcctgcgcgcccccaacctgatcagctacaagcccatgatcgaccagctcgagtgcaccaccaacctgatcgacccgttcgtcgtgttcgagcgggggtccctgccccagacgcgcaacgacaagaccttcgccgccagcaagggcaaccgcggggtgcaggccttctccaagggcagcgtccaggcggacctcaccctgatgttcgacaacttcgaggtggacttcgtgggcgccgccgtctcctgcgacgccgcgttcctgaacctcaccgggtgctacagctgcaacgccggcgcccgggtgtgcctgtccatcacgagcaccgggaccggcaccctgagcgcccacaacaaggacggctccctccacatcgtcctgcccagcgagaacgggacgaaggaccagtgccagatcctgcacttcaccgtgcccgaggtggaggaggagttcatgtactcctgcgacggcgacgagcgcccgctcctggtcaaggggaccctgatcgccatcgaccccttcgacgaccggcgcgaggcgggcggggagagcaccgtggtgaaccccaagtccggcagctggaacttcttcgactggttctccggcctcatgagctggttcgggggccccctgaagacgatcctgctcatctgcctgtacgtcgtgctgtccatcgggctgttcttcctgctgatctacctcggccggaccgggctgagcaagatgtggctggccgccaccaagaaggcctcctga

SEQ ID NO: 12757 - RNA, 3594 nt, synthetic construct
  misc_feature 1..3594: note = derived and/or modified CDS sequence (opt1) from RVFV(2007001292)__EU574046.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctggagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcatcttcgtgttcagctccaccgccatcatctgcctcgcggtgctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgccctggggaacccggcccccatcccccgccacgcccccatcccgcggtacagcacctacctgatgctgctcctgatcgtctcctacgccagcgcgtgctccgagctgatccaggccagctcccgcatcacgacctgcagcaccgagggcgtgaacaccaagtgccggctctccgggacggccctgatccgcgccggcagcgtgggggccgaggcgtgcctgatgctcaagggcgtcaaggaggaccagaccaagttcctgaagatcaagaccgtgagctccgagctgagctgccgggagggccagtcctactggaccgggagcttctcccccaagtgcctcagctcccgccggtgccacctggtgggcgagtgccacgtcaaccgctgcctgagctggcgggacaacgagacctccgccgagttcagcttcgtgggggagtccacgaccatgcgcgagaacaagtgcttcgagcagtgcggcgggtggggctgcggctgcttcaacgtgaaccccagctgcctcttcgtccacacctacctgcagtccgtgcggaaggaggccctgcgcgtgttcaactgcatcgactgggtccacaagctcaccctggagatcacggacttcgacgggagcgtgtccaccatcgacctgggcgccagctccagccggttcaccaactgggggtccgtgagcctcagcctggacgccgagggcatctccgggagcaactccttcagcttcatcgagtcccccggcaagggctacgcgatcgtcgacgagccgttcagcgagatcccccgccaggggttcctgggcgagatccggtgcaactccgagagctccgtgctcagcgcccacgagtcctgcctgcgcgcccccaacctggtgagctacaagcccatgatcgaccagctcgagtgcaccacgaacctgatcgacccgttcgtcgtgttcgagcgggggtccctgccccagacccgcaacgacaagaccttcgccgccagcaagggcaaccgcggggtgcaggcgttctccaagggcagcgtccaggccgacctcaccctgatgttcgacaacttcgaggtggacttcgtgggcgccgccgtctcctgcgacgcggccttcctgaacctcacggggtgctacagctgcaacgccggcgcccgggtgtgcctgtccatcaccagcaccgggaccggcacgctgagcgcccacaacaaggacggctccctccacatcgtcctgcccagcgagaacgggaccaaggaccagtgccagatcctgcacttcaccgtgcccgaggtggaggaggagttcatgtactcctgcgacggcgacgagcgcccgctcctggtcaaggggaccctgatcgcgatcgaccccttcgacgaccggcgcgaggccggcggggagagcacggtggtgaaccccaagtccggcagctggaacctcttcgactggttctccggcctgatgagctggttcgggggccccctgaagaccatcctcctgatctgcctgtacgtcgccctctccatcgggctgttcttcctgctcatctacctgggccggaccgggctgagcaagatgtggctcgccgccaccaagaaggcgtcctga

SEQ ID NO: 12758 - RNA, 3594 nt, synthetic construct
  misc_feature 1..3594: note = derived and/or modified CDS sequence (opt1) from RVFV(Sudan 85-2010)__JQ820488.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcgtgttcgtgttcagctccatcgccatcatctgcctcgcgatcctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgtcctggggaacccggcccccatcccccgccacgcccccatcccgcggtacagcacctacctgatgctgctcctgatcgtgtcctacgccagcgcctgctccgagctgatccaggcgagctcccgcatcaccacgtgcagcaccgagggcgtgaacaccaagtgccggctctccgggaccgccctgatccgcgccggcagcgtcggggccgaggcctgcctgatgctcaagggcgtgaaggaggaccagacgaagttcctgaagatcaagaccgtgagctccgagctgagctgccgggagggccagtcctactggaccgggagcttctcccccaagtgcctcagctcccgccggtgccacctggtcggcgagtgccacgtgaaccgctgcctgagctggcgggacaacgagacctccgcggagttcagcttcgtgggggagtccaccacgatgcgcgagaacaagtgcttcgagcagtgcggcgggtggggctgcggctgcttcaacgtcaaccccagctgcctcttcgtgcacacctacctgcagtccgtgcggaaggaggccctgcgcgtcttcaactgcatcgactgggtgcacaagctcaccctggagatcaccgacttcgacgggagcgtgtccacgatcgacctgggcgccagctccagccggttcaccaactgggggtccgtcagcctcagcctggacgccgagggcatctccgggagcaactccttcagcttcatcgagtcccccggcaagggctacgccatcgtggacgagccgttcagcgagatcccccgccaggggttcctgggcgagatccggtgcaactccgagagctccgtgctcagcgcgcacgagtcctgcctgcgcgcccccaacctgatcagctacaagcccatgatcgaccagctcgagtgcaccaccaacctgatcgacccgttcgtcgtgttcgagcgggggtccctgccccagacgcgcaacgagaagaccttcgccgccagcaagggcaaccgcggggtgcaggccttctccaagggcagcgtccaggcggacctcaccctgatgttcgacaacttcgaggtggacttcgtgggcgccgccgtctcctgcgacgccgcgttcctgaacctcaccgggtgctacagctgcaacgccggcgcccgggtgtgcctgtccatcacgagcaccgggaccggcaccctgagcgcccacaacaaggacggctccctccacatcgtcctgcccagcgagaacgggacgaaggaccagtgccagatcctgcacttcaccgtgcccgaggtggaggaggagttcatgtactcctgcgacggcgacgagcgcccgctcctggtcaaggggaccctgatcgccatcgaccccttcgacgaccggcgcgaggcgggcggggagagcaccgtggtgaaccccaagtccggcagctggaacttcttcgactggttctccggcctcatgagctggttcgggggccccctgaagacgatcctgctcatctgcctgtacgtcgccctgtccatcgggctgttcttcctgctgatctacctcggccggaccgggctgagcaagatgtggctggccgccaccaagaaggcctcctga

SEQ ID NO: 12759 - RNA, 3594 nt, synthetic construct
  misc_feature 1..3594: note = derived and/or modified CDS sequence (opt1) from RVFV(2007002060)__EU574039.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgcaaggacgccaagcagatcggccgggagaccatggcggggatcgccatgaccgtgctgcccgccctggccgtcttcgcgctcgcccccgtggtgttcgccgaggacccccacctccgcaaccggcccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccgcaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccggcagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgcgagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgggtcgtggtgaagcgcgagctcagcgcgaagcccatccagcgggtcgagccctgcacgacctgcatcaccaagtgcgagccccacggcctggtggtgcgctccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcatcttcgtgttcagctccaccgccatcatctgcctcgcggtgctgtaccgggtcctgaagtgcctcaagatcgcgccccgcaaggtgctgaaccccctgatgtggatcaccgccttcatccggtgggtgtacaagaagatggtcgcccgcgtggccgacaacatcaaccaggtgaaccgcgagatcgggtggatggagggcggccagctcgccctggggaacccggcccccatcccccggcacgcccccatcccgcgctacagcacctacctgatgctgctcctgatcgtctcctacgccagcgcgtgctccgagctgatccaggccagctcccggatcacgacctgcagcaccgagggcgtgaacaccaagtgccgcctctccgggacggccctgatccgggccggcagcgtgggggccgaggcgtgcctgatgctcaagggcgtcaaggaggaccagaccaagttcctgaagatcaagaccgtgagctccgagctgagctgccgcgagggccagtcctactggaccgggagcttctcccccaagtgcctcagctcccggcgctgccacctggtgggcgagtgccacgtcaaccggtgcctgagctggcgcgacaacgagacctccgccgagttcagcttcgtgggggagtccacgaccatgcgggagaacaagtgcttcgagcagtgcggcgggtggggctgcggctgcttcaacgtgaaccccagctgcctcttcgtccacacctacctgcagtccgtgcgcaaggaggccctgcgggtgttcaactgcatcgactgggtccacaagctcaccctggagatcacggacttcgacgggagcgtgtccaccatcgacctgggcgccagctccagccgcttcaccaactgggggtccgtgagcctcagcctggacgccgagggcatctccgggagcaactccttcagcttcatcgagtcccccggcaagggctacgcgatcgtcgacgagccgttcagcgagatcccccggcaggggttcctgggcgagatccgctgcaactccgagagctccgtgctcagcgcccacgagtcctgcctgcgggcccccaacctggtgagctacaagcccatgatcgaccagctcgagtgcaccacgaacctgatcgacccgttcgtcgtgttcgagcgcgggtccctgccccagacccggaacgacaagaccttcgccgccagcaagggcaaccgcggggtgcaggcgttctccaagggcagcgtccaggccgacctcaccctgatgttcgacaacttcgaggtggacttcgtgggcgccgccgtctcctgcgacgcggccttcctgaacctcacggggtgctacagctgcaacgccggcgcccgcgtgtgcctgtccatcaccagcaccgggaccggcacgctgagcgcccacaacaaggacggctccctccacatcgtcctgcccagcgagaacgggaccaaggaccagtgccagatcctgcacttcaccgtgcccgaggtggaggaggagttcatgtactcctgcgacggcgacgagcggccgctcctggtcaaggggaccctgatcgcgatcgaccccttcgacgaccgccgggaggccggcggggagagcacggtggtgaaccccaagtccggcagctggaacttcttcgactggttctccggcctcatgagctggttcgggggccccctgaagaccatcctgctcatctgcctgtacgtcgccctgtccatcgggctgttcttcctgctgatctacctcggccgcaccgggctgagcaagatgtggctggccgccaccaagaaggcgtcctga

SEQ ID NO: 12760 - RNA, 3594 nt, synthetic construct
  misc_feature 1..3594: note = derived and/or modified CDS sequence (opt1) from RVFV(2007002476)__EU574036.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcatcttcgtgttcagctccaccgccatcatctgcctcgcggtgctgtaccgcgtcctgaagtgcctcaagatcgcgccccggaaggtgctgaaccccctgatgtggatcaccgccttcatcaagtgggtgtacaagaagatggtcgcccgcgtggccgacaacatcaaccaggtgaaccgcgagatcgggtggatggagggcggccagctcgccctggggaacccggcccccatcccccggcacgcccccatcccgcgctacagcacctacctgatgctgctcctgatcgtctcctacgccagcgcgtgctccgagctgatccaggccagctcccggatcacgacctgcagcaccgagggcgtgaacaccaagtgccgcctctccgggacggccctgatccgggccggcagcgtgggggccgaggcgtgcctgatgctcaagggcgtcaaggaggaccagaccaagttcctgaagatcaagaccgtgagctccgagctgagctgccgcgagggccagtcctactggaccgggagcttctcccccaagtgcctcagctcccggcgctgccacctggtgggcgagtgccacgtcaaccggtgcctgagctggcgcgacaacgagacctccgccgagttcagcttcgtgggggagtccacgaccatgcgggagaacaagtgcttcgagcagtgcggcgggtggggctgcggctgcttcaacgtgaaccccagctgcctcttcgtccacacctacctgcagtccgtgcgcaaggaggccctgcgggtgttcaactgcatcgactgggtccacaagctcaccctggagatcacggacttcgacgggagcgtgtccaccatcgacctgggcgccagctccagccgcttcaccaactgggggtccgtgagcctcagcctggacgccgagggcatctccgggagcaactccttcagcttcatcgagtcccccggcaagggctacgcgatcgtcgacgagccgttcagcgagatcccccggcaggggttcctgggcgagatccgctgcaactccgagagctccgtgctcagcgcccacgagtcctgcctgcgggcccccaacctggtgagctacaagcccatgatcgaccagctcgagtgcaccacgaacctgatcgacccgttcgtcgtgttcgagcgcgggtccctgccccagacccggaacgacaagaccttcgccgccagcaagggcaaccgcggggtgcaggcgttctccaagggcagcgtccaggccgacctcaccctgatgttcgacaacttcgaggtggacttcgtgggcgccgccgtctcctgcgacgcggccttcctgaacctcacggggtgctacagctgcaacgccggcgcccgcgtgtgcctgtccatcaccagcaccgggaccggcacgctgagcgcccacaacaaggacggctccctccacatcgtcctgcccagcgagaacgggaccaaggaccagtgccagatcctgcacttcaccgtgcccgaggtggaggaggagttcatgtactcctgcgacggcgacgagcggccgctcctggtcaaggggaccctgatcgcgatcgaccccttcgacgaccgccgggaggccggcggggagagcacggtggtgaaccccaagtccggcagctggaacttcttcgactggttctccggcctcatgagctggttcgggggccccctgaagaccatcctgctcatctgcctgtacgtcgccctgtccatcgggctgttcttcctgctgatctacctcggccgcaccgggctgagcaagatgtggctggccgccaccaagaaggcgtcctga

SEQ ID NO: 12761 - RNA, 3594 nt, synthetic construct
  misc_feature 1..3594: note = derived and/or modified CDS sequence (opt1) from RVFV(2269/74)__DQ380222.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagcacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccagagcgtctccagcaagatcgtggcgcactgcccgccccaggacccctgcctcgtgcacgggtgcatcgtctgcgcccacggcctgatcaactaccagtgccacacggccctgtccgccttcgtggtggtcttcgtgttcagctccgtggccatcatctgcctcgcgatcctgtacaaggtcctgaagtgcctcaagatcgcccccaagaaggtgctgaaccccctgatgtggatcaccgccttcatccgctgggtgtacaagaagatggtcgcccgggtggccgacaacatcaaccaggtgaaccgcgagatcgggtggatggagggcggccagctcgcgctggggaacccggcccccatcccccgccacgcccccatcccgcggtacagcacctacctgatgctgctcctgatcgtctcctacgccagcgcgtgctccgagctgatccaggccagctcccgcatcaccacgtgcagcaccgagggcgtgaacaccaagtgccggctctccgggaccgccctgatccgcgccggcagcgtgggggccgaggcgtgcctgatgctcaagggcgtcaaggaggaccagacgaagttcctgaagatcaagaccgtgagctccgagctgagctgccgggagggccagtcctactggaccgggagcttctcccccaagtgcctcagctcccgccggtgccacctggtgggcgagtgccacgtcaaccgctgcctgagctggcgggacaacgagacctccgccgagttcagcttcgtgggggagtccaccacgatgcgcgagaacaagtgcttcgagcagtgcggcgggtggggctgcggctgcttcaacgtgaaccccagctgcctcttcgtccacacctacctgcagtccgtgcggaaggaggccctgcgcgtgttcaactgcatcgactgggtccacaagctcaccctggagatcaccgacttcgacgggagcgtgtccacgatcgacctgggcgccagctccagccggttcaccaactgggggtccgtgagcctcagcctggacgccgagggcatctccgggagcaactccttcagcttcatcgagtcccccggcaagggctacgcgatcgtcgacgagccgttcagcgagatcccccgccaggggttcctgggcgagatccggtgcaactccgagagctccgtgctcagcgcccacgagtcctgcctgcgcgcccccaacctgatcagctacaagcccatgatcgaccagctcgagtgcaccaccaacctgatcgacccgttcgtggtcttcgagcgggggtccctgccccagacgcgcaacgacaagaccttcgccgccagcaagggcaaccgcggggtgcaggcgttctccaagggcagcgtgcaggccgacctcaccctgatgttcgacaacttcgaggtcgacttcgtgggcgccgccgtgtcctgcgacgcggccttcctgaacctcaccgggtgctacagctgcaacgccggcgcccgggtctgcctgtccatcacgagcaccgggaccggcaccctgagcgcccacaacaaggacggctccctccacatcgtgctgcccagcgagaacgggacgaaggaccagtgccagatcctgcacttcaccgtccccgaggtggaggaggagttcatgtactcctgcgacggcgacgagcgcccgctcctggtgaaggggaccctgatcgcgatcgaccccttcgacgaccggcgcgaggccggcggggagagcaccgtcgtgaaccccaagtccggcagctggaacttcttcgactggttctccggcctcatgagctggttcgggggccccctgaagacgatcctgctcatctgcctgtacgtggccctgtccatcgggctgttcttcctgctgatctacctcggccggaccgggctgagcaagatgtggctggccgccaccaagaaggcgtcctga

SEQ ID NO: 12762 - RNA, 3594 nt, synthetic construct
  misc_feature 1..3594: note = derived and/or modified CDS sequence (opt1) from RVFV(SA-51 (Van Wyck))__DQ380195.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccgcgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgggtggtcgtgaagcgcgagctcagcgcgaagcccatccagcgggtggagccctgcacgacctgcatcaccaagtgcgagccccacggcctggtcgtgcgctccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccagagcgtctccagcaagatcgtggcgcactgcccgccccaggacccctgcctcgtgcacgggtgcatcgtctgcgcccacggcctgatcaactaccagtgccacacggccctgtccgccttcgtggtggtcttcgtgttcagctccgtggccatcatctgcctcgcgatcctgtacaaggtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgccctggggaacccggcccccatcccccgccacgcccccatcccgcggtacagcacctacctgatgctgctcctgatcgtctcctacgccagcgcgtgctccgagctgatccaggccagctcccgcatcaccacgtgcagcaccgagggcgtgaacaccaagtgccggctctccgggaccgccctgatccgcgccggcagcgtgggggccgaggcgtgcctgatgctcaagggcgtcaaggaggaccagacgaagttcctgaagatcaagaccgtgagctccgagctgagctgccgggagggccagtcctactggaccgggagcttctcccccaagtgcctcagctcccgccggtgccacctggtgggcgagtgccacgtcaaccgctgcctgagctggcgggacaacgagacctccgccgagttcagcttcgtgggggagtccaccacgatgcgcgagaacaagtgcttcgagcagtgcggcgggtggggctgcggctgcttcaacgtgaaccccagctgcctcttcgtccacacctacctgcagtccgtgcggaaggaggccctgcgcgtgttcaactgcatcgactgggtccacaagctcaccctggaggtgaccgacttcgacgggagcgtgtccacgatcgacctgggcgccagctccagccggttcaccaactgggggtccgtcagcctcagcctggacgccgagggcatctccgggagcaactccttcagcttcatcgagtcccccggcaagggctacgcgatcgtggacgagccgttcagcgagatcccccgccaggggttcctgggcgagatccggtgcaactccgagagctccgtgctcagcgcccacgagtcctgcctgcgcgcccccaacctgatcagctacaagcccatgatcgaccagctcgagtgcaccaccaacctgatcgacccgttcgtcgtgttcgagcgggggtccctgccccagacgcgcaacgacaagaccttcgccgccagcaagggcaaccgcggggtgcaggcgttctccaagggcagcgtccaggccgacctcaccctgatgttcgacaacttcgaggtggacttcgtgggcgccgccgtctcctgcgacgcggccttcctgaacctcaccgggtgctacagctgcaacgccggcgcccgggtgtgcctgtccatcacgagcaccgggaccggcaccctgagcgcccacaacaaggacggctccctccacatcgtcctgcccagcgagaacgggacgaaggaccagtgccagatcctgcacttcaccgtgcccgaggtggaggaggagttcatgtactcctgcgacggcgacgagcgcccgctcctggtcaaggggaccctgatcgcgatcgaccccttcgacgaccggcgcgaggccggcggggagagcaccgtggtgaaccccaagtccggcagctggaacttcttcgactggttctccggcctcatgagctggttcgggggccccctgaagacgatcctgctcatctgcctgtacgtcgccctgtccatcgggctgttcttcctgctgatctacctcggccggaccgggctgagcaagatgtggctggccgccaccaagaaggcgtcctga

SEQ ID NO: 12763 - RNA, 3594 nt, synthetic construct
  misc_feature 1..3594: note = derived and/or modified CDS sequence (opt1) from RVFV(OS-8)__DQ380185.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcgtcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcgtgttcgtgttcagctccgtcgccatcatctgcctcgcgatcctgtacaaggtgctgaagtgcctcaagatcgcgccccgcaaggtgctgaaccccctgatgtggatcaccgccttcatccggtgggtctacaagaagatggtggcccgcgtggccgacaacatcaaccaggtcaaccgcgagatcgggtggatggagggcggccagctcgccctggggaacccggcccccatcccccggcacgcccccatcccgcgctacagcacctacctgatgctgctcctgatcgtgtcctacgccagcgcgtgctccgagctgatccaggccagctcccggatcaccacgtgcagcaccgagggcgtgaacaccaagtgccgcctctccgggaccgccctgatccgggccggcagcgtcggggccgaggcgtgcctgatgctcaagggcgtgaaggaggaccagacgaagttcctgcgcatcaagaccgtgagctccgagctgagctgccgggagggccagtcctactggaccgggagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcggctgcttcaacgtcaaccccagctgcctcttcgtgcacacctacctgcagtccgtgcggaaggaggccctgcgcgtcttcaactgcatcgactgggtgcacaagctcaccctggagatcaccgacttcgacgggagcgtgtccacgatcgacctgggcgccagctccagccggttcaccaactgggggtccgtcagcctcagcctggacgccgagggcatctccgggagcaactccttcagcttcatcgagtcccccggcaagggctacgcgatcgtggacgagccgttcagcgagatcccccgccaggggttcctgggcgagatccggtgcaactccgagagctccgtgctcagcgcccacgagtcctgcctgcgcgcccccaacctgatcagctacaagcccatgatcgaccagctcgagtgcaccaccaacctgatcgacccgttcgtcgtgttcgagcgggggtccctgccccagacgcgcaacgacaagaccttcgccgccagcaagggcaaccgcggggtgcaggcgttctccaagggcagcgtccaggccgacctcaccctgatgttcgacaacttcgaggtggacttcgtgggcgccgccgtctcctgcgacgcggccttcctgaacctcagcgggtgctactcctgcaacgccggcgcccgggtgtgcctgagcatcaccagcacggggaccggcaccctgtccgcccacaacaaggacggcagcctccacatcgtcctgccctccgagaacgggaccaaggaccagtgccagatcctgcacttcacggtgcccgaggtggaggaggagttcatgtacagctgcgacggcgacgagcgcccgctcctggtcaaggggaccctgatcgcgatcgaccccttcgacgaccggcgcgaggccggcggggagtccaccgtggtgaaccccaagagcggctcctggaacttcttcgactggttcagcggcctcatgtcctggttcgggggccccctgaagaccatcctgctcatctgcctgtacgtcgccctgagcatcgggctgttcttcctgctgatctacctcggccggacggggctgtccaagatgtggctggccgccaccaagaaggcgagctga

SEQ ID NO: 12764 - RNA, 3594 nt, synthetic construct
  misc_feature 1..3594: note = derived and/or modified CDS sequence (opt1) from RVFV(BIME-01)__KX609032.1__GP
  source 1..3594: mol_type = other RNA
atgtacgtgctgctcaccatcctgatcagcgtcctggtgtgcgaggccatcatccgcgtgtccctcagctccacccgggaggagacgtgcttcggcgacagcaccaaccccgagatgatcgagggggcctgggactccctgcgcgaggaggagatgccggaggagctgagctgctccatcagcggcatccgggaggtcaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtgcgctgcgagcggcgccgggacgccaagcagatcggccgcgagaccatggcggggatcgccatgaccgtcctgcccgccctggccgtgttcgcgctcgcccccgtggtcttcgccgaggacccccacctccggaaccgccccggcaaggggcacaactacatcgacggcatgacccaggaggacgcgacctgcaagccggtgacgtacgccggggcctgcagctccttcgacgtgctgctcgagaagggcaagttccccctgttccagagctacgcccaccaccggaccctgctcgaggccgtccacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtctgcgaggtgggggtgcaggccctcaagaagtgcgacggccagctgtccaccgcgcacgaggtcgtgcccttcgccgtgttcaagaacagcaagaaggtctacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtcggctacgagcgcgtggtggtcaagcgggagctcagcgcgaagcccatccagcgcgtggagccctgcacgacctgcatcaccaagtgcgagccccacggcctggtggtccggtccaccgggttcaagatcagctccgccgtggcctgcgccagcggcgtgtgcgtcaccgggtcccagagcccgagcaccgagatcaccctgaagtaccccggcatctcccagagctccgggggcgacatcggcgtgcacatggcccacgacgaccagagcgtgtccagcaagatcgtcgcgcactgcccgccccaggacccctgcctcgtgcacgggtgcatcgtgtgcgcccacggcctgatcaactaccagtgccacacggccctgtccgccttcgtcgtggtgttcgtcttcagctccgtggccatcatctgcctcgcgatcctgtacaaggtgctgcgctgcctcaagatcgcccccaagaaggtcctgaaccccctgatgtggatcaccgccttcatccggtgggtgtacaagaagatggtggcccgcgtcgccgacaacatcaaccaggtgaaccgcgagatcgggtggatggagggcggccagctcgcgctggggaacccggcccccatcccccggcacgcccccatcccgcgctacagcacctacctgatgctgctcctgatcatctcctacgccagcgcgtgctccgagctgatccaggccagctcccggatcaccacgtgcagcaccgagggcgtgaacaccaagtgccgcctctccgggaccgccctgatccgggccggcagcgtcggggccgaggcgtgcctgatgctcaagggcgtgaaggaggaccagacgaagttcctgaagatcaagaccgtgagctccgagctgagctgccgcgagggccagtcctactggaccgggagcttctcccccaagtgcctcagctcccggcgctgccacctggtcggcgagtgccacgtgaaccggtgcctgagctggcgcgacaacgagacctccgccgagttcagcttcgtgggggagtccaccacgatgcgggagaacaagtgcttcgagcagtgcggcgggtggggctgcggctgcttcaacgtcaaccccagctgcctcttcgtgcacacctacctgcagtccgtgcgcaaggaggccctgcgggtcttcaactgcatcgactgggtgcacaagctcaccctggagatcaccgacttcgacgggagcgtgtccacgatcgacctgggcgccagctccagccgcttcaccaactgggggtccgtcagcctcagcctggacgccgagggcatctccgggagcaactccttcagcttcatcgagtcccccggcaagggctacgcgatcgtggacgagccgttcagcgagatcccccggcaggggttcctgggcgagatccgctgcaactccgagagctccgtgctcagcgcccacgagtcctgcctgcgggcccccaacctgatcagctacaagcccatgatcgaccagctcgagtgcaccaccaacctgatcgacccgttcgtcgtgttcgagcgcgggtccctgccccagacgcggaacgacaagaccttcgccgccagcaagggcaaccgcggggtgcaggcgttctccaagggcagcgtccaggccgacctcaccctgatgttcgacaacttcgaggtggacttcgtgggcgccgccgtctcctgcgacgcggccttcctgaacctcaccgggtgctacagctgcaacgccggcgcccgcgtgtgcctgtccatcacgagcaccgggaccggcaccctgagcgcccacaacaaggacggctccctccacatcgtgctgcccagcgagaacgggacgaaggaccagtgccagatcctgcacttcaccgtccccgaggtggaggaggagttcatgtactcctgcgacggcgacgagcggccgctcctggtcaaggggaccctgatcgcgatcgaccccttcgacgaccgccgggaggccggcggggagagcaccgtggtgaaccccaagtccggcagctggaacttcttcgactggttctccggcctcatgagctggttcgggggccccctgaagacgatcctgctcatctgcctgtacgtcgccctgtccatcgggctgttcttcctgctgatctacctcggccgcaccgggctgagcaagatgtggctggccgccaccaagaaggcgtcctga

SEQ ID NO: 12765 - RNA, 3594 nt, synthetic construct
  misc_feature 1..3594: note = derived and/or modified CDS sequence (opt1) from RVFV(Kenya 83 (21445))__DQ380198.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaagaaccccgagaacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccagagcgtctccagcaagatcgtggcgcactgcccgccccaggacccctgcctcgtgcacgggtgcatcgtctgcgcccacggcctgatcaactaccagtgccacacggccctgtccgccttcgtggtggtcttcgtgttcagctccatcgccatcatctgcctcgcgatcctgtaccgcgtgctgaagtgcctcaagatcgcgccccggaaggtcctgaaccccctgatgtggatcaccgccttcatccgctgggtgtacaagaagatggtggcccgcgtcgccgacaacatcaaccaggtgaaccgggagatcgggtggatggagggcggccagctcgccctggggaacccggcccccatcccccgccacgcccccatcccgcggtacagcacctacctgatgctgctcctgatcgtgtcctacgccagcgcgtgctccgagctgatccaggccagctcccgcatcaccacgtgcagcaccgagggcgtcaacaccaagtgccggctctccgggaccgccctgatccgcgccggcagcgtgggggccgaggcgtgcctgatgctcaagggcgtgaaggaggaccagacgaagttcctgaagatcaagaccgtcagctccgagctgagctgccgggagggccagtcctactggaccgggagcttctcccccaagtgcctcagctcccgccggtgccacctggtgggcgagtgccacgtgaaccgctgcctgagctggcgggacaacgagacctccgccgagttcagcttcgtcggggagtccaccacgatgcgcgagaacaagtgcttcgagcagtgcggcgggtggggctgcggctgcttcaacgtgaaccccagctgcctcttcgtgcacacctacctgcagtccgtccggaaggaggccctgcgcgtgttcaactgcatcgactgggtgcacaagctcaccctggagatcaccgacttcgacgggagcgtctccacgatcgacctgggcgccagctccagccggttcaccaactgggggtccgtgagcctcagcctggacgccgagggcatctccgggagcaactccttcagcttcatcgagtcccccggcaagggctacgcgatcgtggacgagccgttcagcgagatcccccgccaggggttcctgggcgagatccggtgcaactccgagagctccgtcctcagcgcccacgagtcctgcctgcgcgcccccaacctgatcagctacaagcccatgatcgaccagctcgagtgcaccaccaacctgatcgacccgttcgtggtgttcgagcgggggtccctgccccagacgcgcaacgacaagaccttcgccgccagcaagggcaaccgcggggtccaggcgttctccaagggcagcgtgcaggccgacctcaccctgatgttcgacaacttcgaggtggacttcgtcggcgccgccgtgtcctgcgacgcggccttcctgaacctcaccgggtgctacagctgcaacgccggcgcccgggtgtgcctgtccatcacgagcaccgggaccggcaccctgagcgcccacaacaaggacggctccctccacatcgtcctgcccagcgagaacgggacgaaggaccagtgccagatcctgcacttcaccgtgcccgaggtcgaggaggagttcatgtactcctgcgacggcgacgagcgcccgctcctggtgaaggggaccctgatcgcgatcgaccccttcgacgaccggcgcgaggccggcggggagagcaccgtggtcaaccccaagtccggcagctggaacttcttcgactggttctccggcctcatgagctggttcgggggccccctgaagacgatcctgctcatctgcctgtacgtggccctgtccatcgggctgttcttcctgctgatctacctcggccggaccgggctgagcaagatgtggctggccgccaccaagaaggcgtcctga

SEQ ID NO: 12766 - RNA, 3594 nt, synthetic construct
  misc_feature 1..3594: note = derived and/or modified CDS sequence (opt1) from RVFV(2007000253)__JF326192.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcatcttcgtgttcagctccaccgccatcatctgcctcgcggtgctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgccctggggaacccggcccccatcccccgccacgcccccatcccgcggtacagcacctacctgatgctgctcctgatcgtctcctacgccagcgcgtgctccgagctgatccaggccagctcccgcatcacgacctgcagcaccgagggcgtgaacaccaagtgccggctctccgggacggccctgatccgcgccggcagcgccggggcggaggcctgcctgatgctcaagggcgtgaaggaggaccagaccaagttcctgaagatcaagaccgtcagctccgagctgagctgccgggagggccagtcctactggaccgggagcttctcccccaagtgcctcagctcccgccggtgccacctggtgggcgagtgccacgtgaaccgctgcctgagctggcgggacaacgagacctccgccgagttcagcttcgtcggggagtccacgaccatgcgcgagaacaagtgcttcgagcagtgcggcgggtggggctgcggctgcttcaacgtgaaccccagctgcctcttcgtgcacacctacctgcagtccgtccggaaggaggccctgcgcgtgttcaactgcatcgactgggtgcacaagctcaccctggagatcacggacttcgacgggagcgtctccaccatcgacctgggcgccagctccagccggttcaccaactgggggtccgtgagcctcagcctggacgcggagggcatctccgggagcaactccttcagcttcatcgagtcccccggcaagggctacgccatcgtggacgagccgttcagcgagatcccccgccaggggttcctgggcgagatccggtgcaactccgagagctccgtcctcagcgcccacgagtcctgcctgcgcgcccccaacctggtgagctacaagcccatgatcgaccagctcgagtgcaccacgaacctgatcgacccgttcgtggtcttcgagcgggggtccctgccccagacccgcaacgacaagaccttcgccgcgagcaagggcaaccgcggggtgcaggccttctccaagggcagcgtgcaggccgacctcaccctgatgttcgacaacttcgaggtcgacttcgtgggcgccgcggtgtcctgcgacgccgccttcctgaacctcacggggtgctacagctgcaacgccggcgcccgggtctgcctgtccatcaccagcaccgggaccggcacgctgagcgcgcacaacaaggacggctccctccacatcgtgctgcccagcgagaacgggaccaaggaccagtgccagatcctgcacttcaccgtccccgaggtggaggaggagttcatgtactcctgcgacggcgacgagcgcccgctcctggtgaaggggaccctgatcgccatcgaccccttcgacgaccggcgcgaggccggcggggagagcacggtcgtgaaccccaagtccggcagctggaacttcttcgactggttctccggcctcatgagctggttcgggggccccctgaagaccatcctgctcatctgcctgtacgtggccctgtccatcgggctgttcttcctgctgatctacctcggccggaccgggctgagcaagatgtggctggccgcgaccaagaaggcctcctga

SEQ ID NO: 12767 - RNA, 3594 nt, synthetic construct
  misc_feature 1..3594: note = derived and/or modified CDS sequence (opt1) from RVFV(200803166)__JF311381.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcaagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcgtgttcgtgttcagctccatcgccatcatctgcctcgcgatcctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgtcctggggaacccggcccccatcccccgccacgcccccatcccgcggtacagcacctacctgatgctgctcctgatcgtgtcctacgccaccgcctgcagcgagctgatccaggcgtccagccgcatcacgacctgctccaccgagggcgtgaacaccaagtgccggctcagcgggacggccctgatccgcgccggctccgtcggggccgaggcctgcctgatgctcaagggcgtgaaggaggaccagaccaagttcctgaagatcaagaccgtgagcagcgagctgtcctgccgggagggccagagctactggaccgggtccttcagccccaagtgcctctccagccgccggtgccacctggtcggcgagtgccacgtgaaccgctgcctgtcctggcgggacaacgagaccagcgcggagttctccttcgtgggggagagcacgaccatgcgcgagaacaagtgcttcgagcagtgcggcgggtggggctgcggctgcttcaacgtcaacccctcctgcctcttcgtgcacacctacctgcagagcgtgcggaaggaggccctgcgcgtcttcaactgcatcgactgggtgcacaagctcaccctggagatcacggacttcgacgggtccgtgagcaccatcgacctgggcgcctccagctcccggttcaccaactgggggagcgtctccctcagcctggacgccgagggcatcagcgggtccaacagcttctccttcatcgagagccccggcaagggctacgccatcgtggacgagccgttctccgagatcccccgccaggggttcctgggcgagatccggtgcaacagcgagtccagcgtgctctccgcgcacgagagctgcctgcgcgcccccaacctgatctcctacaagcccatgatcgaccagctcgagtgcaccacgaacctgatcgacccgttcgtcgtgttcgagcgggggagcctgccccagacccgcaacgacaagaccttcgccgcctccaagggcaaccgcggggtgcaggccttcagcaagggctccgtccaggcggacctcaccctgatgttcgacaacttcgaggtggacttcgtgggcgccgccgtcagctgcgacgccgcgttcctgaacctcacggggtgctactcctgcaacgccggcgcccgggtgtgcctgagcatcacctccaccgggaccggcacgctgagcgcccacaacaaggacggcagcctccacgtcgtgctgccctccgagaacgggaccaaggaccagtgccagatcctgcacttcaccgtgcccgaggtcgaggaggagttcatgtacagctgcgacggcgacgagcgcccgctcctggtgaaggggaccctgatcgccatcgaccccttcgacgaccggcgcgaggcgggcggggagtccacggtggtcaaccccaagagcggctcctggaacttcttcgactggttcagcggcctcatgtcctggttcgggggccccctgaagaccatcctgctcatctgcctgtacgtggccctgagcatcgggctgttcttcctgctgatctacctcggccggaccgggctgtccaagatgtggctggccgccaccaagaaggccagctga

SEQ ID NO: 12768 - RNA, 3594 nt, synthetic construct
  misc_feature 1..3594: note = derived and/or modified CDS sequence (opt1) from RVFV(2007001107)__EU574047.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccaaccaggagctctaccgcgcgctgaaggccatcatcgccgccgacgggctgaacaacatcacgtgccacggcaagaaccccgaggacaagatcagcctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgctccagcttcgacgtgctgctcgagaagggcaagttccccctgttccagtcctacgcccaccaccggaccctgctcgaggccgtgcacgacaccatcatcgccaaggccgacccgcccagctgcgacctgcagtccgcgcacggcaacccctgcatgaaggagaagctggtcatgaagacccactgccccaacgactaccagagcgcccactacctcaacaacgacgggaagatggcctccgtgaagtgcccgcccaagtacgagctgacggaggactgcaacttctgccgccagatgaccggcgccagcctgaagaaggggtcctaccccctccaggacctgttctgccagagcagcgaggacgacggctccaagctgaagaccaagatgaagggcgtgtgcgaggtcggggtgcaggccctcaagaagtgcgacggccagctgagcaccgcgcacgaggtggtccccttcgccgtgttcaagaactccaagaaggtgtacctggacaagctcgacctgaagacggaggagaacctgctccccgacagcttcgtctgcttcgagcacaaggggcagtacaagggcaccatggactccgggcagaccaagcgggagctcaagagcttcgacatctcccagtgccccaagatcggcggccacgggagcaagaagtgcaccggcgacgccgccttctgctccgcctacgagtgcacggcgcagtacgccaacgcctactgcagccacgccaacgggtccggcatcgtgcagatccaggtcagcggggtgtggaagaagccgctgtgcgtgggctacgagcgcgtcgtggtgaagcgggagctgtccgcgaagcccatccagcgcgtcgagccctgcacgacctgcatcaccaagtgcgagccccacggcctggtggtgcggagcaccgggttcaagatctccagcgccgtcgcctgcgcctccggcgtgtgcgtgaccgggagccagtccccgagcaccgagatcaccctgaagtaccccggcatcagccagtccagcgggggcgacatcggcgtccacatggcccacgacgaccagtccgtgagctccaagatcgtggcgcactgcccgccccaggacccctgcctcgtccacgggtgcatcgtgtgcgcccacggcctgatcaactaccagtgccacacggccctgagcgccttcgtggtcatcttcgtgttctccagcaccgccatcatctgcctcgcggtgctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgccctggggaacccggcccccatcccccgccacgcccccatcccgcggtactccacctacctgatgctgctcctgatcgtcagctacgcctccgcgtgcagcgagctgatccaggcctccagccgcatcacgacctgctccaccgagggcgtgaacaccaagtgccggctcagcgggacggccctgatccgcgccggctccgtgggggccgaggcgtgcctgatgctcaagggcgtcaaggaggaccagaccaagttcctgaagatcaagaccgtgagcagcgagctgtcctgccgggagggccagagctactggaccgggtccttcagccccaagtgcctctccagccgccggtgccacctggtgggcgagtgccacgtcaaccgctgcctgtcctggcgggacaacgagaccagcgccgagttctccttcgtgggggagagcacgaccatgcgcgagaacaagtgcttcgagcagtgcggcgggtggggctgcggctgcttcaacgtgaacccctcctgcctcttcgtccacacctacctgcagagcgtgcggaaggaggccctgcgcgtgttcaactgcatcgactgggtccacaagctcaccctggagatcacggacttcgacgggtccgtgagcaccatcgacctgggcgcctccagctcccggttcaccaactgggggagcgtgtccctcagcctggacgccgagggcatcagcgggtccaacagcttctccttcatcgagagccccggcaagggctacgcgatcgtcgacgagccgttctccgagatcccccgccaggggttcctgggcgagatccggtgcaacagcgagtccagcgtgctctccgcccacgagagctgcctgcgcgcccccaacctggtgtcctacaagcccatgatcgaccagctcgagtgcaccacgaacctgatcgacccgttcgtcgtgttcgagcgggggagcctgccccagacccgcaacgacaagaccttcgccgcctccaagggcaaccgcggggtgcaggcgttcagcaagggctccgtccaggccgacctcaccctgatgttcgacaacttcgaggtggacttcgtgggcgccgccgtcagctgcgacgcggccttcctgaacctcacggggtgctactcctgcaacgccggcgcccgggtgtgcctgagcatcacctccaccgggaccggcacgctgagcgcccacaacaaggacggcagcctccacatcgtcctgccctccgagaacgggaccaaggaccagtgccagatcctgcacttcaccgtgcccgaggtggaggaggagttcatgtacagctgcgacggcgacgagcgcccgctcctggtcaaggggaccctgatcgcgatcgaccccttcgacgaccggcgcgaggccggcggggagtccacggtggtgaaccccaagagcggctcctggaacttcttcgactggttcagcggcctcatgtcctggttcgggggccccctgaagaccatcctgctcatctgcctgtacgtcgccctgagcatcgggctgttcttcctgctgatctacctcggccggaccgggctgtccaagatgtggctggccgccaccaagaaggcgagctga

SEQ ID NO: 12769 - RNA, 3594 nt, synthetic construct
  misc_feature 1..3594: note = derived and/or modified CDS sequence (opt1) from RVFV(ANK-3837)__DQ380215.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctggagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaagctggacagcgggcagaccaagcgggagctgaagtccttcgacatcagccagtgccccaagatcggcggccacgggtccaagaagtgcaccggcgacgccgccttctgcagcgcctacgagtgcaccgcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgacggggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgggtgcatcgtctgcgcccacggcctgatcaactaccagtgccacaccgccctctccgccttcgtggtggtcttcgtgttcagctccatcgccatcatctgcctggcgatcctgtaccgcgtgctcaagtgcctgaagatcgcgccccggaaggtcctgaaccccctcatgtggatcacggccttcatccgctgggtgtaccgcaagatggtggcccgggtcgccgacaacatcaaccaggtgaaccgcgagatcgggtggatggagggcggccagctggtgctggggaacccggcccccatcccccggcacgtccccatcccgcgctacagcacctacctgatgctcctgctgatcgtgtcctacgccagcgcctgctccgagctcatccaggccagctcccggatcacgacctgcagcaccgagggcgtgaacaccaagtgccgcctgtccgggaccgcgctgatccgggccggcagcgtcggggccgaggcctgcctcatgctgaagggcgtgaaggaggaccagaccaagttcctgaagatcaagacggtgagctccgagctcagctgccgcgagggccagtcctactggaccgggagcttctcccccaagtgcctgagctcccggcgctgccacctggtcggcgagtgccacgtgaaccggtgcctcagctggcgcgacaacgagacctccgccgagttcagcttcgtgggggagtccaccaccatgcgggagaacaagtgcttcgagcagtgcggcgggtggggctgcggctgcttcaacgtcaaccccagctgcctgttcgtgcacacgtacctgcagtccgtgcgcaaggaggcgctccgggtcttcaactgcatcgactgggtgcacaagctgaccctggagatcaccgacttcgacgggagcgtgtccaccatcgacctcggcgccagctccagccgcttcacgaactgggggtccgtcagcctgagcctggacgccgagggcatctccgggagcaactccttcagcttcatcgagtcccccggcaagggctacgccatcgtggacgagccgttcagcgagatcccccggcaggggttcctcggcgagatccgctgcaactccgagagctccgtgctgagcgcccacgagtcctgcctgcgggcgcccaacctcatcagctacaagcccatgatcgaccagctggagtgcaccaccaacctgatcgacccgttcgtcgtgttcgagcgcgggtccctcccccagacccgcaacgacaagacgttcgccgccagcaagggcaaccgcggggtgcaggccttctccaagggcagcgtccaggccgacctgaccctgatgttcgacaacttcgaggtggacttcgtgggcgcggccgtctcctgcgacgccgccttcctcaacctgaccgggtgctacagctgcaacgcgggcgcccgggtgtgcctgtccatcaccagcacggggaccggcaccctcagcgcccacaacaaggacggctccctgcacatcgtcctgcccagcgagaacgggaccaaggaccagtgccagatcctccacttcacggtgcccgaggtggaggaggagttcatgtactcctgcgacggcgacgagcggccgctgctggtccgcgggaccctcatcgccatcgaccccttcgacgaccggcgcgaggccggcggggagagcaccgtggtgaaccccaagtccggcagctggaacttcttcgactggttctccggcctgatgagctggttcgggggccccctgaagaccatcctcctgatctgcctgtacgtcgcgctctccatcgggctgttcttcctgctcatctacctgggccggacggggctgagcaagatgtggctcgccgccaccaagaaggcctcctga

SEQ ID NO: 12770 - RNA, 3594 nt, synthetic construct
  misc_feature 1..3594: note = derived and/or modified CDS sequence (opt1) from RVFV(OS-1)__DQ380186.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcagcgcgacgccaagcagatcggccgggagaccatggcggggatcgccatgaccgtgctgcccgccctggccgtgttcgcgctcgcccccgtcgtgttcgccgaggacccccacctccgcaaccggcccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccgcaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccggcagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgcgagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcgtcgtgcagatccaggtctccggggtgtggaagaagccgctgtgcgtgggctacgagcgggtcgtggtgaagcgcgagctcagcgcgaagcccatccagcgggtcgagccctgcacgacctgcatcaccaagtgcgagccccacggcctggtggtgcgctccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcgtgttcgtgttcagctccgtcgccatcatctgcctcgcgatcctgtacaaggtgctgaagtgcctcaagatcgcgccccggaaggtgctgaaccccctgatgtggatcaccgccttcatccgctgggtctacaagaagatggtggcccgggtggccgacaacatcaaccaggtcaaccgcgagatcgggtggatggagggcggccagctcgccctggggaacccggcccccatcccccgccacgcccccatcccgcggtacagcacctacctgatgctgctcctgatcgtgtcctacgccagcgcgtgctccgagctgatccaggccagctcccgcatcaccacgtgcagcaccgagggcgtgaacaccaagtgccggctctccgggaccgccctgatccgcgccggcagcgtcggggccgaggcgtgcctgatgctcaagggcgtgaaggaggaccagacgaagttcctgaagatcaagaccgtgagctccgagctgagctgccgggagggccagtcctactggaccgggagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcggctgcttcaacgtcaaccccagctgcctcttcgtgcacacctacctgcagtccgtgcggaaggaggccctgaaggtcttcaactgcatcgactgggtgcacaagctcaccctggagatcaccgacttcgacgggagcgtgtccacgatcgacctgggcgccagctccagccgcttcaccaactgggggtccgtcagcctcagcctggacgccgagggcatctccgggagcaactccttcagcttcatcgagtcccccggcaagggctacgcgatcgtggacgagccgttcagcgagatcccccggcaggggttcctgggcgagatccgctgcaactccgagagctccgtgctcagcgcccacgagtcctgcctgcgggcccccaacctgatcagctacaagcccatgatcgaccagctcgagtgcaccaccaacctgatcgacccgttcgtcgtgttcgagcgcgggtccctgccccagacgcggaacgacaagaccttcgccgccagcaagggcaaccgcggggtgcaggcgttctccaagggcagcgtccaggccgacctcaccctgatgttcgacaacttcgaggtggacttcgtgggcgccgccgtctcctgcgacgcggccttcctgaacctcaccgggtgctacagctgcaacgccggcgcccgggtgtgcctgtccatcacgagcaccgggaccggcaccctgagcgcccacaacaaggacggctccctccacatcgtcctgcccagcgagaacgggacgaaggaccagtgccagatcctgcacttcaccgtgcccgaggtggaggaggagttcatgtactcctgcgacggcgacgagcgcccgctcctggtcaaggggaccctgatcgcgatcgaccccttcgacgaccgccgggaggccggcggggagagcaccgtggtgaaccccaagtccggcagctggaacttcttcgactggttctccggcctcatgagctggttcgggggccccctgaagacgatcctgctcatctgcctgtacgtcgccctgtccatcgggctgttcttcctgctgatctacctcggccgcaccgggctgagcaagatgtggctggccgccaccaagaaggcgtcctga

SEQ ID NO: 12771 - RNA, 3594 nt, synthetic construct
  misc_feature 1..3594: note = derived and/or modified CDS sequence (opt1) from RVFV(Sudan 2V-2007)__JQ820490.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctggagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgctccgtccacgggtgcatcgtgtgcgcccacggcctcatcaactaccagtgccacacggccctgagcgccttcgtggtcgtgttcgtgttctccagcatcgccatcatctgcctggcgatcctctaccgcgtcctgaagtgcctgaagatcgcgccccggaaggtgctcaaccccctgatgtggatcaccgccttcatccgctgggtgtacaagaagatggtcgcccgcgtggccgacaacatcaaccaggtgaaccgggagatcgggtggatggagggcggccagctggtcctcgggaacccggcccccatcccccgccacgcccccatcccgcggtactccacctacctgatgctgctgctcatcgtgagccacgcctccgcctgcagcgagctgatccaggcgtccagccgcatcaccacgtgctccaccgagggcgtgaacaccaagtgccggctgagcgggaccgccctcatccgcgccggcagcgtcggggccgaggcctgcctgatgctgaagggcgtgaaggaggaccagacgaagttcctcaagatcaagaccgtgtccagcgagctgtcctgccgggagggccagagctactggaccgggtccttcagccccaagtgcctgtccagccgccggtgccacctcgtcggcgagtgccacgtgaaccgctgcctgtcctggcgggacaacgagaccagcgcggagttctccttcgtgggggagagcaccacgatgcgcgagaacaagtgcttcgagcagtgcggcgggtggggctgcggctgcttcaacgtcaacccctcctgcctgttcgtgcacacctacctccagagcgtgcggaaggaggccctgcgcgtcttcaactgcatcgactgggtgcacaagctgaccctcgagatcaccgacttcgacgggtccgtgagcacgatcgacctgggcgcctccagctcccggttcaccaactgggggagcgtcagcctgtccctcgacgccgagggcatcagcgggtccaacagcttctccttcatcgagagccccggcaagggctacgccatcgtggacgagccgttctccgagatcccccgccaggggttcctgggcgagatccggtgcaacagcgagtccagcgtgctgtccgcgcacgagagctgcctccgcgcccccaacctgatctcctacaagcccatgatcgaccagctggagtgcaccaccaacctcatcgacccgttcgtcgtgttcgagcgggggagcctgccccagacgcgcaacgacaagaccttcgccgcctccaagggcaaccgcggggtgcaggccttcagcaagggctccgtccaggcggacctgaccctcatgttcgacaacttcgaggtggacttcgtgggcgccgccgtcagctgcgacgccgcgttcctgaacctgaccgggtgctactcctgcaacgccggcgcccgggtgtgcctcagcatcacgagcaccgggaccggcaccctgtccgcccacaacaaggacggcagcctgcacatcgtcctcccctccgagaacgggacgaaggaccagtgccagatcctgcacttcaccgtgcccgaggtggaggaggagttcatgtacagctgcgacggcgacgagcgcccgctgctcgtcaaggggaccctgatggccatcgaccccttcgacgaccggcgcgaggcgggcggggagtccaccgtggtgaaccccaagagcggctcctggaacttcttcgactggttcagcggcctgatgtcctggttcgggggccccctcaagacgatcctgctgatctgcctctacgtcgccctgagcatcgggctgttcttcctcctgatctacctgggccggaccgggctctccaagatgtggctggccgccaccaagaaggccagctga

SEQ ID NO: 12772 - RNA, 3594 nt, synthetic construct
  misc_feature 1..3594: note = derived and/or modified CDS sequence (opt1) from RVFV(200803162)__JF311377.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcgccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcgcacgacgaccagagcgtgtccagcaagatcgtggcccactgcccgccccaggacccctgcctcgtccacgactgcatcgtgtgcgcccacgggctgatcaactaccagtgccacaccgccctgtccgccttcgtggtcatcttcgtgttcagctccacggcgatcatctgcctcgccgtgctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcggctggatggagggcgggcagctcgccctgcgcaacccggcccccatcccccggcacgcccccatcccgcgctacagcacctacctgatgctgctcctgatcgtctcctacgcgagcgcctgctccgagctgatccaggccagctcccggatcaccacgtgcagcaccgagggcgtgaacaccaagtgccgcctctccgggaccgccctgatccgggccggcagcgtgggggcggaggcctgcctgatgctcaagggcgtcaaggaggaccagacgaagttcctgaagatcaagaccgtgagctccgagctgagctgccgcgaggggcagtcctactggaccggcagcttctcccccaagtgcctcagctcccggcgctgccacctggtgggcgagtgccacgtcaaccggtgcctgagctggcgcgacaacgagacctccgccgagttcagcttcgtgggggagtccaccacgatgcgggagaacaagtgcttcgagcagtgcggcgggtggggctgcgggtgcttcaacgtgaaccccagctgcctcttcgtccacacctacctgcagtccgtgcgcaaggaggccctgcgggtgttcaactgcatcgactgggtccacaagctcaccctggagatcaccgacttcgacggcagcgtgtccacgatcgacctgggcgccagctccagccgcttcaccaactgggggtccgtgagcctcagcctggacgcggagggcatctccgggagcaactccttcagcttcatcgagtcccccggcaaggggtacgccatcgtcgacgagccgttcagcgagatcccccggcagggcttcctgggcgagatccgctgcaactccgagagctccgtgctcagcgcccacgagtcctgcctgcgggcccccaacctggtgagctacaagcccatgatcgaccagctcgagtgcaccaccaacctgatcgacccgttcgtcgtgttcgagcgcgggtccctgccccagacgcgcaacgacaagaccttcgccgcgagcaagggcaaccgcggggtgcaggccttctccaagggcagcgtccaggccgacctcaccctgatgttcgacaacttcgaggtggacttcgtgggggccgcggtctcctgcgacgccgccttcctgaacctcaccggctgctacagctgcaacgccggcgcccgggtgtgcctgtccatcacgagcaccgggaccggcaccctgagcgcgcacaacaaggacgggtccctccacatcgtcctgcccagcgagaacggcacgaaggaccagtgccagatcctgcacttcaccgtgcccgaggtggaggaggagttcatgtactcctgcgacggcgacgagcggccgctcctggtcaaggggaccctgatcgccatcgaccccttcgacgaccgccgggaggccggcggggagagcaccgtggtgaaccccaagtccggcagctggaacttcttcgactggttctccgggctcatgagctggttcggcggccccctgaagacgatcctgctcatctgcctgtacgtcgccctgtccatcgggctgttcttcctgctgatctacctcggccgcaccgggctgagcaagatgtggctggccgcgaccaagaaggcctcctga

SEQ ID NO: 12773 - RNA, 3594 nt, synthetic construct
  misc_feature 1..3594: note = derived and/or modified CDS sequence (opt1) from RVFV(2007001811)__EU574040.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcgtgttcgtgttcagctccatcgccatcatctgcctcgcgatcctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgtcctggggaacccggcccccatcccccgccacgcccccatcccgcggtacagcacctacctgatgctgctcctgatcgtgtcctacgccagcgcctgctccgagctgatccaggcgagctcccgcatcaccacgtgcagcaccgagggcgtgaacaccaagtgccggctctccgggaccgccctgatccgcgccggcagcgtcggggccgaggcctgcctgatgctcaagggcgtgaaggaggaccagacgaagttcctgatgatcaagaccgtgagctccgagctgagctgccgggagggccagtcctactggaccgggagcttctcccccaagtgcctcagctcccgccggtgccacctggtcggcgagtgccacgtgaaccgctgcctgagctggcgggacaacgagacctccgcggagttcagcttcgtgggggagtccaccacgatgcgcgagaacaagtgcttcgagcagtgcggcgggtggggctgcggctgcttcaacgtcaaccccagctgcctcttcgtgcacacctacctgcagtccgtgcggaaggaggccctgcgcgtcttcaactgcatcgactgggtgcacaagctcaccctggagatcaccgacttcgacgggagcgtgtccacgatcgacctgggcgccagctccagccggttcaccaactgggggtccgtcagcctcagcctggacgccgagggcatctccgggagcaactccttcagcttcatcgagtcccccggcaagggctacgccatcgtggacgagccgttcagcgagatcccccgccaggggttcctgggcgagatccggtgcaactccgagagctccgtgctcagcgcgcacgagtcctgcctgcgcgcccccaacctgatcagctacaagcccatgatcgaccagctcgagtgcaccaccaacctgatcgacccgttcgtcgtgttcgagcgggggtccctgccccagacgcgcaacgagaagaccttcgccgccagcaagggcaaccgcggggtgcaggccttctccaagggcagcgtccaggcggacctcaccctgatgttcgacaacttcgaggtggacttcgtgggcgccgccgtctcctgcgacgccgcgttcctgaacctcaccgggtgctacagctgcaacgccggcgcccgggtgtgcctgtccatcacgagcaccgggaccggcaccctgagcgcccacaacaaggacggctccctccacatcgtcctgcccagcgagaacgggacgaaggaccagtgccagatcctgcacttcaccgtgcccgaggtggaggaggagttcatgtactcctgcgacggcgacgagcgcccgctcctggtcaaggggaccctgatcgccatcgaccccttcgacgaccggcgcgaggcgggcggggagagcaccgtggtgaaccccaagtccggcagctggaacttcttcgactggttctccggcctcatgagctggttcgggggccccctgaagacgatcctgctcatctgcctgtacgtcgccctgtccatcgggctgttcttcctgctgatctacctcggccggaccgggctgagcaagatgtggctggccgccaccaagaaggcctcctga

SEQ ID NO: 12774 - RNA, 3594 nt, synthetic construct
  misc_feature 1..3594: note = derived and/or modified CDS sequence (opt1) from RVFV(clone 13)__DQ380213.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagcacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagaacccgagcaccgagatcaccctgaagtaccccggcatcagccagtccagcgggggcgacatcggcgtgcacatggcccacgacgaccagtccgtcagctccaagatcgtggcgcactgcccgccccaggacccctgcctcgtgcacgggtgcatcgtctgcgcccacggcctgatcaactaccagtgccacacggccctgagcgccttcgtggtggtcttcgtgttctccagcatcgccatcatctgcctcgcgatcctgtaccgcgtgctgaagtgcctcaagatcgcgccccggaaggtcctgaaccccctgatgtggatcaccgccttcatccgctgggtgtacaagaagatggtggcccgcgtcgccgacaacatcaaccaggtgaaccgggagatcgggtggatggagggcggccagctcgtgctggggaacccggcccccatcccccgccacgcccccatcccgcggtactccacctacctgatgctgctcctgatcgtcagctacgcctccgcctgcagcgagctgatccaggcgtccagccgcatcaccacgtgctccaccgagggcgtgaacaccaagtgccggctcagcgggaccgccctgatccgcgccggctccgtgggggccgaggcctgcctgatgctcaagggcgtcaaggacgaccagacgaagttcctgaagatcaagaccgtgagcagcgagctgtcctgccgggagggccagagctactggaccgggtccttcagccccaagtgcctctccagccgccggtgccacctggtgggcgagtgccacgtcaaccgctgcctgtcctggcgggacaacgagaccagcgcggagttctccttcgtgggggagagcaccacgatgcgcgagaacaagtgcttcgagcagtgcggcgggtggggctgcggctgcttcaacgtgaacccctcctgcctcttcgtccacacctacctgcagagcgtgcggaaggaggccctgcgcgtgttcaactgcatcgactgggtccacaagctcaccctggagatcaccgacttcgacgggtccgtgagcacgatcgacctgggcgcctccagctcccggttcaccaactgggggagcgtgtccctcagcctggacgccgagggcatcagcgggtccaacagcttctccttcatcgagagccccggcaagggctacgccatcgtcgacgagccgttctccgagatcccccgccaggggttcctgggcgagatccggtgcaacagcgagtccagcgtgctctccgcgcacgagagctgcctgcgcgcccccaacctgatctcctacaagcccatgatcgaccagctcgagtgcaccaccaacctgatcgacccgttcgtggtcttcgagcgggggagcctgccccagacgcgcaacgagaagaccttcgccgcctccaagggcaaccgcggggtgcaggccttcagcaagggctccgtgcaggcggacctcaccctgatgttcgacaacttcgaggtcgacttcgtgggcgccgccgtgagctgcgacgccgcgttcctgaacctcaccgggtgctactcctgcaacgccggcgcccgggtctgcctgagcatcacgtccaccgggaccggcaccctgagcgcccacaacaaggacggcagcctccacatcgtgctgccctccgagaacgggacgaaggaccagtgccagatcctgcacttcaccgtccccgaggtggaggaggagttcatgtacagctgcgacggcgacgagcgcccgctcctggtgaaggggaccctgatcgccatcgaccccttcgacgaccggcgcgaggcgggcggggagtccaccgtcgtgaaccccaagagcggctcctggaacttcttcgactggttcagcggcctcatgtcctggttcgggggccccctgaagacgatcctgctcatctgcctgtacgtggccctgagcatcgggctgttcttcctgctgatctacctcggccggaccgggctgtccaagatgtggctggccgccaccaagaaggccagctga

SEQ ID NO: 12775 - RNA, 3594 nt, synthetic construct
  misc_feature 1..3594: note = derived and/or modified CDS sequence (opt1) from RVFV(MP12)__Z30318.1__GP
  source 1..3594: mol_type = other RNA
atgtacgtgctgctcaccatcctgaccagcgtcctggtgtgcgaggccatcatccgcgtgtccctcagctccacgcgggaggagacctgcttcggcgacagcaccaaccccgagatgatcgagggggcctgggactccctgcgcgaggaggagatgccggaggagctgagctgctccatcagcggcatccgggaggtcaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtgcgctgcgagcggcgccgggacgccaagcagatcggccgcaagaccatggcggggatcgccatgaccgtcctgcccgccctggccgtgttcgcgctcgcccccgtggtcttcgccgaggacccccacctccggaaccgccccggcaaggggcacaactacatcgacggcatgacccaggaggacgccacgtgcaagccggtgacctacgccggggcgtgcagctccttcgacgtgctgctggagaagggcaagttccccctgttccagagctacgcccaccaccggaccctgctcgaggccgtccacgacaccatcatcgccaaggccgacccgccctcctgcgacctgctgagcgcgcacggcaacccctgcatgaaggagaagctcgtgatgaagacgcactgccccaacgactaccagtccgcccaccacctgaacaacgacgggaagatggccagcgtgaagtgcccgcccaagtacgagctgaccgaggactgcaacttctgccgccagatgaccggcgcctccctcaagaaggggagctaccccctgcaggacctgttctgccagagctccgaggacgacggcagcaagctcaagaccaagatgaagggcgtctgcgaggtgggggtgcaggccctgaagaagtgcgacggccagctgtccacggcgcacgaggtcgtgcccttcgccgtgttcaagaacagcaagaaggtctacctcgacaagctggacctgaagaccgaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcacgggcgacgccgccttctgcagcgcctacgagtgcaccgcgcagtacgccaacgcctactgctcccacgccaacgggagcggcatcgtgcagatccaggtctccggggtgtggaagaagccgctctgcgtcggctacgagcgcgtggtggtcaagcgggagctgagcgcgaagcccatccagcgcgtggagccctgcacgacctgcatcaccaagtgcgagccccacggcctggtggtccggtccaccgggttcaagatcagctccgccgtggcctgcgccagcggcgtgtgcgtcaccgggtcccagagcccgagcaccgagatcacgctcaagtaccccggcatctcccagagctccgggggcgacatcggcgtgcacatggcccacgacgaccagagcgtgtccagcaagatcgtcgcgcactgcccgccccaggacccctgcctggtgcacgactgcatcgtgtgcgcccacgggctgatcaactaccagtgccacaccgccctctccgccttcgtcgtggtgttcgtcttcagctccatcgccatcatctgcctggcgatcctgtaccgcgtgctcaagtgcctgaagatcgcgccccggaaggtgctgaaccccctcatgtggatcaccgccttcatccgctggatctacaagaagatggtcgcccgcgtggcccacaacatcaaccaggtgaaccgggagatcggctggatggagggcgggcagctggtcctgggcaacccggcgcccatcccccgccacgcccccatcccgcggtacagcacctacctgatgctcctgctgatcgtgtcctacgccagcgcctgctccgagctcatccaggcgagctcccgcatcacgacctgcagcaccgagggggtgaacaccaagtgccggctgtccggcacggccctgatccgcgccgggagcgtcggcgccgaggcctgcctcatgctgaagggggtgaaggaggaccagaccaagttcctgaagctcaagaccgtgagctccgagctgagctgccgggagggccagtcctactggaccggcagcttctcccccaagtgcctgagctcccgccggtgccacctcgtcggggagtgccacgtgaaccgctgcctgagctggcgggacaacgagacctccgcggagttcagcttcgtgggcgagtccacgaccatgcgcgagaacaagtgcttcgagcagtgcgggggctgggggtgcggctgcttcaacgtcaaccccagctgcctgttcgtgcacacctacctccagtccgtgcggaaggaggccctgcgcgtcttcaactgcatcgactgggtgcacaagctgaccctcgagatcacggacttcgacggcagcgtgtccaccatcgacctgggggccagctccagccggttcaccaactggggctccgtcagcctgagcctcgacgccgaggggatctccggcagcaactccttcagcttcatcgagtcccccgggaagggctacgccatcgtggacgagccgttcagcgagatcccccgccagggcttcctgggggagatccggtgcaactccgagagctccgtgctgagcgcgcacgagtcctgcctccgcgcccccaacctgatcagctacaagcccatgatcgaccagctggagtgcaccacgaacctcatcgacccgttcgtcgtgttcgagcggggctccctgccccagacccgcaacgacaagaccttcgccgccagcaaggggaaccgcggcgtgcaggccttctccaaggggagcgtccaggcggacctgaccctcatgttcgacaacttcgaggtggacttcgtgggcgccgccgtctcctgcgacgccgcgttcctgaacctgacgggctgctacagctgcaacgccggggcccgggtgtgcctctccatcaccagcaccggcaccgggagcctgtccgcccacaacaaggacggcagcctgcacatcgtgctcccctccgagaacggcacgaaggaccagtgccagatcctgcacttcaccgtccccgaggtggaggaggagttcatgtacagctgcgacggggacgagcgcccgctgctcgtcaagggcaccctgatcgccatcgaccccttcgacgaccggcgcgaggccgggggcgagtccaccgtggtgaaccccaagagcgggtcctggaacttcttcgactggttcagcggcctgatgtcctggttcggcgggcccctcaagacgatcctgctgatctgcctctacgtcgccctgagcatcggcctgttcttcctcctgatctacctcgggggcaccgggctgtccaagatgtggctggccgccaccaagaaggccagctga

SEQ ID NO: 12776 - RNA, 3594 nt, synthetic construct
  misc_feature 1..3594: note = derived and/or modified CDS sequence (opt1) from RVFV__JQ068143.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatcgacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccagagcgtctccagcaagatcgtggcgcactgcccgccccaggacccctgcctcgtgcacgggtgcatcgtctgcgcccacggcctgatcaactaccagtgccacacggccctgtccgccttcgtggtggtcttcgtgttcagctccgtggccatcatctgcctcgcgatcctgtacaaggtcctgcgctgcctcaagatcgcccccaagaaggtgctgaaccccctgatgtggatcaccgccttcatccggtgggtgtacaagaagatggtcgcccgcgtggccgacaacatcaaccaggtgaaccgcgagatcgggtggatggagggcggccagctcgcgctggggaacccggcccccatcccccggcacgcccccatcccgcgctacagcacctacctgatgctgctcctgatcatctcctacgccagcgcgtgctccgagctgatccaggccagctcccggatcaccacgtgcagcaccgagggcgtcaacaccaagtgccgcctctccgggaccgccctgatccgggccggcagcgtgggggccgaggcgtgcctgatgctcaagggcgtgaaggaggaccagacgaagttcctgaagatcaagaccgtcagctccgagctgagctgccgcgagggccagtcctactggaccgggagcttctcccccaagtgcctcagctcccggcgctgccacctggtgggcgagtgccacgtgaaccggtgcctgagctggcgcgacaacgagacctccgccgagttcagcttcgtcggggagtccaccacgatgcgggagaacaagtgcttcgagcagtgcggcgggtggggctgcggctgcttcaacgtgaaccccagctgcctcttcgtgcacacctacctgcagtccgtccgcaaggaggccctgcgggtgttcaactgcatcgactgggtgcacaagctcaccctggagatcaccgacttcgacgggagcgtctccacgatcgacctgggcgccagctccagccgcttcaccaactgggggtccgtgagcctcagcctggacgccgagggcatctccgggagcaactccttcagcttcatcgagtcccccggcaagggctacgcgatcgtggacgagccgttcagcgagatcccccggcaggggttcctgggcgagatccgctgcaactccgagagctccgtcctcagcgcccacgagtcctgcctgcgggcccccaacctgatcagctacaagcccatgatcgaccagctcgagtgcaccaccaacctgatcgacccgttcgtggtgttcgagcgcgggtccctgccccagacgcggaacgacaagaccttcgccgccagcaagggcaaccgcggggtccaggcgttctccaagggcagcgtgcaggccgacctcaccctgatgttcgacaacttcgaggtggacttcgtcggcgccgccgtgtcctgcgacgcggccttcctgaacctcaccgggtgctacagctgcaacgccggcgcccgcgtgtgcctgtccatcacgagcaccgggaccggcaccctgagcgcccacaacaaggacggctccctccacatcgtcctgcccagcgagaacgggacgaaggaccagtgccagatcctgcacttcaccgtgcccgaggtcgaggaggagttcatgtactcctgcgacggcgacgagcggccgctcctggtgaaggggaccctgatcgcgatcgaccccttcgacgaccgccgggaggccggcggggagagcaccgtggtcaaccccaagtccggcagctggaacttcttcgactggttctccggcctcatgagctggttcgggggccccctgaagacgatcctgctcatctgcctgtacgtggccctgtccatcgggctgttcttcctgctgatctacctcggccgcaccgggctgagcaagatgtggctggccgccaccaagaaggcgtcctga

SEQ ID NO: 12777 - RNA, 3594 nt, synthetic construct
  misc_feature 1..3594: note = derived and/or modified CDS sequence (opt1) from RVFV(2007002445)__EU574037.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcatcttcgtgttcagctccaccgccatcatctgcctcgcggtgctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgccctggggaacccggcccccatcccccgccacgcccccatcccgcggtacagcacctacctgatgctgctcctgatcgtctcctacgccagcgcgtgctccgagctgatccaggccagctcccgcatcacgacctgcagcaccgagggcgtgaacaccaagtgccggctctccgggacggccctgatccgcgccggcagcgtgggggccgaggcgtgcctgatgctcaagggcgtcaaggaggaccagaccaagttcctgaagatcaagaccgtgagctccgagctgagctgccgggagggccagtcctactggaccgggagcttctcccccaagtgcctcagctcccgccggtgccacctggtgggcgagtgccacgtcaaccgctgcctgagctggcgggacaacgagacctccgccgagttcagcttcgtgggggagtccacgaccatgcgcgagaacaagtgcttcgagcagtgcggcgggtggggctgcggctgcttcaacgtgaaccccagctgcctcttcgtccacacctacctgcagtccgtgcggaaggaggccctgcgcgtgttcaactgcatcgactgggtccacaagctcaccctggagatcacggacttcgacgggagcgtgtccaccatcgacctgggcgccagctccagccggttcaccaactgggggtccgtgagcctcagcctggacgccgagggcatctccgggagcaactccttcagcttcatcgagtcccccggcaagggctacgcgatcgtcgacgagccgttcagcgagatcccccgccaggggttcctgggcgagatccggtgcaactccgagagctccgtgctcagcgcccacgagtcctgcctgcgcgcccccaacctggtgagctacaagcccatgatcgaccagctcgagtgcaccacgaacctgatcgacccgttcgtcgtgttcgagcgggggtccctgccccagacccgcaacgagaagaccttcgccgccagcaagggcaaccgcggggtgcaggcgttctccaagggcagcatccaggccgacctcaccctgatgttcgacaacttcgaggtcgacttcgtgggcgccgccgtgtcctgcgacgcggccttcctgaacctcacggggtgctacagctgcaacgccggcgcccgggtctgcctgtccatcaccagcaccgggaccggcacgctgagcgcccacaacaaggacggctccctccacatcgtgctgcccagcgagaacgggaccaaggaccagtgccagatcctgcacttcaccgtccccgaggtggaggaggagttcatgtactcctgcgacggcgacgagcgcccgctcctggtgaaggggaccctgatcgcgatcgaccccttcgacgaccggcgcgaggccggcggggagagcacggtcgtgaaccccaagtccggcagctggaacttcttcgactggttctccggcctcatgagctggttcgggggccccctgaagaccatcctgctcatctgcctgtacgtggccctgtccatcgggctgttcttcctgctgatctacctcggccggaccgggctgagcaagatgtggctggccgccaccaagaaggcgtcctga

SEQ ID NO: 12778 - RNA, 3594 nt, synthetic construct
  misc_feature 1..3594: note = derived and/or modified CDS sequence (opt1) from RVFV(2008/00101)__HE687306.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcatcttcgtgttcagctccaccgccatcatctgcctcgcggtgctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgccctggggaacccggcccccatcccccgccacgcccccatcccgcggtacagcacctacctgatgctgctcctgatcgtctcctacgccagcgcgtgctccgagctgatccaggccagctcccgcatcacgacctgcagcaccgagggcgtgaacaccaagtgccggctctccgggacggccctgatccgcgccggcagcgtgggggccgaggcgtgcctgatgctcaagggcgtcaaggaggaccagaccaagttcctgaagatcaagaccgtgagctccgagctgagctgccgggagggccagtcctactggaccgggagcttctcccccaagtgcctcagctcccgccggtgccacctggtgggcgagtgccacgtcaaccgctgcctgagctggcgggacaacgagacctccgccgagttcagcttcgtgggggagtccacgaccatgcgcgagaacaagtgcttcgagcagtgcggcgggtggggctgcggctgcttcaacgtgaaccccagctgcctcttcgtccacacctacctgcagtccgtgcggaaggaggccctgcgcgtgttcaactgcatcgactgggtccacaagctcaccctggagatcacggacttcgacgggagcgtgtccaccatcgacctgggcgccagctccagccggttcaccaactgggggtccgtgagcctcagcctggacgccgagggcatctccgggagcaactccttcagcttcatcgagtcccccggcaagggctacgcgatcgtcgacgagccgttcagcgagatcccccgccaggggttcctgggcgagatccggtgcaactccgagagctccgtgctcagcgcccacgagtcctgcctgcgcgcccccaacctggtgagctacaagcccatgatcgaccagctcgagtgcaccacgaacctgatcgacccgttcgtcgtgttcgagcgggggtccctgccccagacccgcaacgacaagaccttcgccgccagcaagggcaaccgcggggtgcaggcgttctccaagggcagcgtccaggccgacctcaccctgatgttcgacaacttcgaggtggacttcgtgggcgccgccgtctcctgcgacgcggccttcctgaacctcacggggtgctacagctgcaacgccggcgcccgggtgtgcctgtccatcaccagcaccgggaccggcacgctgagcgcccacaacaaggacggctccctccacatcgtcctgcccagcgagaacgggaccaaggaccagtgccagatcctgcacttcaccgtgcccgaggtggaggaggagttcatgtactcctgcgacggcgacgagcgcccgctcctggtcaaggggaccctgatcgcgatcgaccccttcgacgaccggcgcgaggccggcggggagagcacggtggtgaaccccaagtccggcagctggaacttcttcgactggttctccggcctcatgagctggttcgggggccccctgaagaccaccctgctcatctgcctgtacgtcgccctgtccatcgggctgttcttcctgctgatctacctcggccggaccgggctgagcaagatgtggctggccgccacgaagaaggcgtcctga

SEQ ID NO: 12779 - RNA, 3594 nt, synthetic construct
  misc_feature 1..3594: note = derived and/or modified CDS sequence (opt1) from RVFV(Hv-B375)__DQ380218.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgagggcgagatgccggaggagctgagctgctccatcagcgggatccgggaggtgaagacctccagccaggagctctaccgcgcgctgaaggccatcatcgccgccgacggcctgaacaacatcacgtgccacgggaaggaccccgaggacaagatctccctcatcaagggcccgccccacaagaagcgggtgggcatcgtccgctgcgagcggcgccgggacgccaagcagatcgggcgcgagaccatggcgggcatcgccatgaccgtgctgcccgccctggccgtgttcgcgctcgcccccgtcgtgttcgccgaggacccccacctccggaaccgccccgggaagggccacaactacatcgacgggatgacccaggaggacgcgacctgcaagccggtgacgtacgccggcgcgtgcagctccttcgacgtcctgctggagaagggcaagttccccctgttccagagctacgcccaccaccggaccctgctcgaggccgtgcacgacaccatcatcgccaaggccgacccgccctcctgcgacctgcagagcgcgcacgggaacccctgcatgaaggagaagctggtgatgaagacccactgccccaacgactaccagtccgcccactacctcaacaacgacggcaagatggccagcgtcaagtgcccgcccaagaacgagctgacggaggactgcaacttctgccgccagatgaccggggcctccctgaagaagggcagctaccccctccaggacctgttctgccagagctccgaggacgacggcagcaagctgaagaccaagatgaagggggtgtgcgaggtgggcgtccaggccctcaagaagtgcgacgggcagctgtccaccgcgcacgaggtggtgcccttcgccgtcttcaagaacagcaagaaggtgtacctggacaagctcgacctgaagacggaggagaacctgctccccgactccttcgtgtgcttcgagcacaagggccagtacaaggggaccatggacagcggccagaccaagcgggagctgaagtccttcgacatcagccagtgccccaagatcggcgggcacggctccaagaagtgcaccggggacgccgccttctgcagcgcctacgagtgcacggcgcagtacgccaacgcctactgctcccacgccaacggcagcgggatcgtccagatccaggtgtccggcgtctggaagaagccgctgtgcgtgggctacgagcgcgtggtcgtgaagcgggagctcagcgcgaagcccatccagcgcgtggagccctgcacgacctgcatcaccaagtgcgagccccacgggctggtcgtgcggtccaccggcttcaagatcagctccgccgtggcctgcgccagcggggtctgcgtgaccggctcccagagcccgagcaccgagatcaccctgaagtaccccgggatctcccagagctccggcggcgacatcggggtgcacatggcccacgacgaccagagcgtctccagcaagatcgtggcgcactgcccgccccaggacccctgcctcgtgcacggctgcatcgtctgcgcccacgggctgatcaactaccagtgccacacggccctgtccgccttcgtggtggtcttcgtgttcagctccatcgccatcatctgcctcgcgatcctgtaccgcgtgctgaagtgcctcaagatcgcgccccggaaggtcctgaaccccctgatgtggatcaccgccttcatccgctgggtgtacaagaagatggtggcccgcgtcgccgacaacatcaaccaggtgaaccgggagatcggctggatggagggcgggcagctcgtgctgggcaacccggcccccatcccccgccacgcccccatcccgcggtacagcacctacctgatgctgctcctgatcgtctcctacgccagcgcctgctccgagctgatccaggcgagctcccgcatcaccacgtgcagcaccgagggggtgaacaccaagtgccggctctccggcaccgccctgatccgcgccgggagcgtgggcgccgaggcctgcctgatgctcaagggcgtcaaggaggaccagacgaagttcctgaagatcaagaccgtgagctccgagctgagctgccgggaggggcagtcctactggaccggcagcttctcccccaagtgcctcagctcccgccggtgccacctggtgggggagtgccacgtcaaccgctgcctgagctggcgggacaacgagacctccgcggagttcagcttcgtgggcgagtccaccacgatgcgcgagaacaagtgcttcgagcagtgcgggggctggggctgcgggtgcttcaacgtgaaccccagctgcctcttcgtccacacctacctgcagtccgtgcggaaggaggccctgcgcgtgttcaactgcatcgactgggtccacaagctcaccctggagatcaccgacttcgacggcagcgtgtccacgatcgacctgggggccagctccagccggttcaccaactggggctccgtgagcctcagcctggacgccgaggggatctccggcagcaactccttcagcttcatcgagtcccccggcaaggggtacgccatcgtcgacgagccgttcagcgagatcccccgccagggcttcctgggggagatccggtgcaactccgagagctccgtgctcagcgcgcacgagtcctgcctgcgcgcccccaacctgatcagctacaagcccatgatcgaccagctcgagtgcaccaccaacctgatcgacccgttcgtggtcttcgagcggggctccctgccccagacgcgcaacgacaagaccttcgccgccagcaaggggaaccgcggcgtgcaggccttctccaagggcagcgtgcaggcggacctcaccctgatgttcgacaacttcgaggtcgacttcgtgggggccgccgtgtcctgcgacgccgcgttcctgaacctcaccggctgctacagctgcaacgccggggcccgggtctgcctgtccatcacgagcaccggcaccggcaccctgagcgcccacaacaaggacgggtccctccacatcgtgctgcccagcgagaacggcacgaaggaccagtgccagatcctgcacttcaccgtccccgaggtggaggaggagttcatgtactcctgcgacggggacgagcgcccgctcctggtgaagggcaccctgatcgccatcgaccccttcgacgaccggcgcgaggccgggggcgagagcaccgtcgtgaaccccaagtccggcagctggaacttcttcgactggttctccgggctcatgagctggttcggcgggcccctgaagacgatcctgctcatctgcctgtacgtggccctgtccatcggcctcttcttcctgctgatctacctcgggcggaccggcctgagcaagatgtggctggccgccaccaagaaggcctcctga

SEQ ID NO: 12780 - RNA, 3594 nt, synthetic construct
  misc_feature 1..3594: note = derived and/or modified CDS sequence (opt1) from RVFV(763/70)__DQ380188.1__GP
  source 1..3594: mol_type = other RNA
atgtacgtgctgctcaccatcctgatcaccgtcctggtgtgcgaggccgtgatccgcgtcagcctctccagcacgcgggaggagacctgcttcggcgactccaccaaccccgagatgatcgagggggcctgggacagcctgcgcgaggaggagatgccggaggagctgtcctgcagcatctccggcatccgggaggtgaagaccagctcccaggagctctaccgcgcgctgaaggccatcatcgccgccgacgggctgaacaacatcacgtgccacggcaaggaccccgaggacaagatcagcctcgtgaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgccacgtgcaagccggtcacctacgccggggcgtgctccagcttcgacgtgctgctggagaagggcaagttccccctgttccagtcctacgcccaccaccggaccctgctcgaggccgtgcacgacaccatcatcgccaaggccgacccgcccagctgcgacctgcagtccgcgcacggcaacccctgcatgaaggagaagctggtcatgaagacgcactgccccaacgactaccagagcgcccactacctcaacaacgacgggaagatggcctccgtgaagtgcccgcccaagtacggcctgaccgaggactgcaacttctgccgccagatgaccggggccagcctgaagaagggctcctaccccctccaggacctgttctgccagagcagcgaggacgacggctccaagctgaagaccaagatgaagggggtgtgcgaggtcggcgtgcaggccctcaagaagtgcgacgggcagctgagcacggcgcacgaggtggtccccttcgccgtgttcaagaactccaagaaggtgtacctggacaagctcgacctgaagaccgaggagaacctgctccccgacagcttcgtctgcttcgagcacaagggccagtacaaggggaccatggactccggccagaccaagcgggagctcaagagcttcgacatctcccagtgccccaagatcggcgggcacggcagcaagaagtgcacgggggacgccgccttctgctccgcctacgagtgcaccgcgcagtacgccaacgcctactgcagccacgccaacggctccgggatcgtgcagatccaggtcagcggcgtgtggaagaagccgctgtgcgtgggctacgagcgcgtcgtggtgaagcgggagctgtccgcgaagcccatccagcgcgtcgagccctgcacgacctgcatcaccaagtgcgagccccacgggctggtggtgcggagcaccggcttcaagatctccagcgccgtcgcctgcgcctccggggtgtgcgtgaccggcagccagtccccgagcaccgagatcacgctgaagtaccccgggatcagccagtccagcggcggcgacatcggggtccacatggcccacgacgaccagtccgtgagctccaagatcgtggcgcactgcccgccccaggacccctgcctcgtccacggctgcatcgtgtgcgcccacgggctgatcaactaccagtgccacaccgccctgagcgccttcgtggtcgtgttcgtgttctccagcgtcgccatcatctgcctcgcgatcctgtacaaggtgctgaagtgcctcaagatcgcgccccgcaaggtgctgaaccccctgatgtggatcaccgccttcatccggtgggtctacaagaagatggtggcccgcgtggccgacaacatcaaccaggtcaaccgcgagatcggctggatggagggcgggcagctcgccctgggcaacccggcccccatcccccggcacgcccccatcccgcgctactccacctacctgatgctgctcctgatcgtgagctacgcctccgcgtgcagcgagctgatccaggcctccagccggatcacgacctgctccaccgagggggtgaacaccaagtgccgcctcagcggcacggccctgatccgggccgggtccgtcggcgccgaggcgtgcctgatgctcaagggcgtgaaggaggaccagaccaagttcctgaagatcaagaccgtgagcagcgagctgtcctgccgcgaggggcagagctactggaccggctccttcagccccaagtgcctctccagccggcgctgccacctggtcggggagtgccacgtgaaccggtgcctgtcctggcgcgacaacgagaccagcgccgagttctccttcgtgggcgagagcacgaccatgcgggagaacaagtgcttcgagcagtgcgggggctggggctgcgggtgcttcaacgtcaacccctcctgcctcttcgtgcacacctacctgcagagcgtgcgcaaggaggccctgcgggtcttcaactgcatcgactgggtgcacaagctcaccctggagatcacggacttcgacggctccgtgagcaccatcgacctgggggcctccagctcccgcttcaccaactggggcagcgtctccctcagcctggacgccgaggggatcagcggctccaacagcttctccttcatcgagagccccggcaaggggtacgcgatcgtggacgagccgttctccgagatcccccggcagggcttcctgggggagatccgctgcaacagcgagtccagcgtgctctccgcccacgagagctgcctgcgggcccccaacctgatctcctacaagcccatgatcgaccagctcgagtgcaccacgaacctgatcgacccgttcgtcgtgttcgagcgcggcagcctgccccagacccggaacgacaagaccttcgccgcctccaaggggaaccgcggcgtgcaggcgttcagcaagggctccgtccaggccgacctcaccctgatgttcgacaacttcgaggtggacttcgtgggggccgccgtcagctgcgacgcggccttcctgaacctcacgggctgctactcctgcaacgccggggcccgcgtgtgcctgagcatcacctccaccggcaccggcacgctgagcgcccacaacaaggacgggagcctccacatcgtcctgccctccgagaacggcaccaaggaccagtgccagatcctgcacttcaccgtgcccgaggtggaggaggagttcatgtacagctgcgacggggacgagcggccgctcctggtcaagggcaccctgatcgcgatcgaccccttcgacgaccgccgggaggccgggggcgagtccacggtggtgaaccccaagagcggctcctggaacttcttcgactggttcagcgggctcatgtcctggttcggcgggcccctgaagaccatcctgctcatctgcctgtacgtcgccctgagcatcggcctcttcttcctgctgatctacctcgggcgcaccggcctgtccaagatgtggctggccgccaccaagaaggcgagctga

SEQ ID NO: 12781 - RNA, 3594 nt, synthetic construct
  misc_feature 1..3594: note = derived and/or modified CDS sequence (opt1) from RVFV(RVFBJ01/2016)__KX785331.1__GP
  source 1..3594: mol_type = other RNA
atgtacgtgctgctcaccatcctgatcagcgtcctggtgtgcgaggccatcatccgcgtgtccctcagctccacccgggaggagacgtgcttcggcgacagcaccaaccccgagatgatcgagggggcctgggactccctgcgcgaggaggagatgccggaggagctgagctgctccatcagcggcatccgggaggtcaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtgcgctgcgagcggcgccgggacgccaagcagatcggccgcgagaccatggcggggatcgccatgaccgtcctgcccgccctggccgtgttcgcgctcgcccccgtggtcttcgccgaggacccccacctccggaaccgccccggcaaggggcacaactacatcgacggcatgacccaggaggacgcgacctgcaagccggtgacgtacgccggggcctgcagctccttcgacgtgctgctcgagaagggcaagttccccctgttccagagctacgcccaccaccggaccctgctcgaggccgtccacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtgaagtgcccgcccaagcacgagctgacggaggactgcaacttctgccgccagatgaccggcgcctccctgaagaaggggagctaccccctccaggacctgttctgccagagctccgaggacgacggcagcaagctgaagaccaagatgaagggcgtctgcgaggtgggggtgcaggccctcaagaagtgcgacggccagctgtccaccgcgcacgaggtcgtgcccttcgccgtgttcaagaacagcaagaaggtctacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtcggctacgagcgcgtggtggtcaagcgggagctcagcgcgaagcccatccagcgcgtggagccctgcacgacctgcatcaccaagtgcgagccccacggcctggtggtccggtccaccgggttcaagatcagctccgccgtggcctgcgccagcggcgtgtgcgtcaccgggtcccagagcccgagcaccgagatcaccctgaagtaccccggcatctcccagagctccgggggcgacatcggcgtgcacatggcccacgacgaccagagcgtgtccagcaagatcgtcgcgcactgcccgccccaggacccctgcctcgtgcacgggtgcatcgtgtgcgcccacggcctgatcaactaccagtgccacacggccctgtccgccttcgtcgtggtgttcgtcttcagctccgtggccatcatctgcctcgcgatcctgtacaaggtgctgcgctgcctcaagatcgcccccaagaaggtcctgaaccccctgatgtggatcaccgccttcatccggtgggtgtacaagaagatggtggcccgcgtcgccgacaacatcaaccaggtgaaccgcgagatcgggtggatggagggcggccagctcgcgctggggaacccggcccccatcccccggcacgcccccatcccgcgctacagcacctacctgatgctgctcctgatcatctcctacgccagcgcgtgctccgagctgatccaggccagctcccggatcaccacgtgcagcaccgagggcgtgaacaccaagtgccgcctctccgggaccgccctgatccgggccggcagcgtcggggccgaggcgtgcctgatgctcaagggcgtgaaggaggaccagacgaagttcctgaagatcaagaccgtgagctccgagctgagctgccgcgagggccagtcctactggaccgggagcttctcccccaagtgcctcagctcccggcgctgccacctggtcggcgagtgccacgtgaaccggtgcctgagctggcgcgacaacgagacctccgccgagttcagcttcgtgggggagtccaccacgatgcgggagaacaagtgcttcgagcagtgcggcgggtggggctgcggctgcttcaacgtcaaccccagctgcctcttcgtgcacacctacctgcagtccgtgcgcaaggaggccctgcgggtcttcaactgcatcgactgggtgcacaagctcaccctggagatcaccgacttcgacgggagcgtgtccacgatcgacctgggcgccagctccagccgcttcaccaactgggggtccgtcagcctcagcctggacgccgagggcatctccgggagcaactccttcagcttcatcgagtcccccggcaagggctacgcgatcgtggacgagccgttcagcgagatcccccggcaggggttcctgggcgagatccgctgcaactccgagagctccgtgctcagcgcccacgagtcctgcctgcgggcccccaacctgatcagctacaagcccatgatcgaccagctcgagtgcaccaccaacctgatcgacccgttcgtcgtgttcgagcgcgggtccctgccccagacgcggaacgacaagaccttcgccgccagcaagggcaaccgcggggtgcaggcgttctccaagggcagcgtccaggccgacctcaccctgatgttcgacaacttcgaggtggacttcgtgggcgccgccgtctcctgcgacgcggccttcctgaacctcaccgggtgctacagctgcaacgccggcgcccgcgtgtgcctgtccatcacgagcaccgggaccggcaccctgagcgcccacaacaaggacggctccctccacatcgtgctgcccagcgagaacgggacgaaggaccagtgccagatcctgcacttcaccgtccccgaggtggaggaggagttcatgtactcctgcgacggcgacgagcggccgctcctggtcaaggggaccctgatcgcgatcgaccccttcgacgaccgccgggaggccggcggggagagcaccgtggtgaaccccaagtccggcagctggaacttcttcgactggttctccggcctcatgagctggttcgggggccccctgaagacgatcctgctcatctgcctgtacgtcgccctgtccatcgggctgttcttcctgctgatctacctcggccgcaccgggctgagcaagatgtggctggccgccaccaagaaggcgtcctga

SEQ ID NO: 12782 - RNA, 3594 nt, synthetic construct
  misc_feature 1..3594: note = derived and/or modified CDS sequence (opt1) from RVFV(Lunyo)__KU167026.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggtcagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcgtgttcgtgttcagctccgtcgccatcatctgcctcgcgatcctgtacaaggtgctgaagtgcctcaagatcgcgccccgcaaggtgctgaaccccctgatgtggatcaccgccttcatccggtgggtctacaagaagatggtggcccgcgtggccgacaacatcaaccaggtcaaccgcgagatcgggtggatggagggcggccagctcgccctggggaacccggcccccatcccccggcacgcccccatcccgcgctacagcacctacctgatgctgctcctgatcgtgtcctacgccagcgcgtgctccgagctgatccaggccagctcccggatcaccacgtgcagcaccgagggcgtgaacacccgctgccggctctccgggaccgccctgatccgcgccggcagcgtcggggccgaggcgtgcctgatgctcaagggcgtgaaggaggaccagacgaagttcctgaagatcaagaccgtgagctccgagctgagctgccgggagggccagtcctactggaccgggagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcggctgcttcaacgtcaaccccagctgcctcttcgtgcacacctacctgcagtccgtgcggaaggaggccctgcgcgtcttcaactgcatcgactgggtgcacaagctcaccctggagatcaccgacttcgacgggagcgtgtccacgatcgacctgggcgccagctccagccggttcaccaactgggggtccgtcagcctcagcctggacgccgagggcatctccgggagcaactccttcagcttcatcgagtcccccggcaagggctacgcgatcgtggacgagccgttcagcgagatcccccgccaggggttcctgggcgagatccggtgcaactccgagagctccgtgctcagcgcccacgagtcctgcctgcgcgcccccaacctgatcagctacaagcccatgatcgaccagctcgagtgcaccaccaacctgatcgacccgttcgtcgtgttcgagcgggggtccctgccccagacgcgcaacgacaagaccttcgccgccagcaagggcaaccgcggggtgcaggcgttctccaagggcagcgtccaggccgacctcaccctgatgttcgacaacttcgaggtggacttcgtgggcgccgccgtctcctgcgacgcggccttcctgaacctcaccgggtgctacagctgcaacgccggcgcccgggtgtgcctgtccatcacgagcaccgggaccggcaccctgagcgcccacaacaaggacggctccctccacatcgtcctgcccagcgagaacgggacgaaggaccagtgccagatcctgcacttcaccgtgcccgaggtggaggaggagttcatgtactcctgcgacggcgacgagcgcccgctcctggtcaaggggaccctgatcgcgatcgaccccttcgacgaccggcgcgaggccggcggggagagcaccgtggtgaaccccaagtccggcagctggaacttcttcgactggttctccggcctcatgagctggttcgggggccccctgaagacgatcctgctcatctgcctgtacgtcgccctgtccatcgggctgttcttcctgctgatctacctcggccggaccgggctgagcaagatgtggctggccgccaccaagaaggcgtcctga

SEQ ID NO: 12783 - RNA, 3594 nt, synthetic construct
  misc_feature 1..3594: note = derived and/or modified CDS sequence (opt1) from RVFV(2007000234)__JF326191.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatccgccgggagaccatggcgggcatcgccatgaccgtgctgcccgccctggccgtcttcgcgctcgcccccgtggtgttcgccgaggacccccacctccgcaaccggcccgggaagggccacaactacatcgacgggatgacccaggaggacgcgacctgcaagccggtcacgtacgccggcgcctgcagctccttcgacgtgctgctggagaaggggaagttccccctgttccagagctacgcccaccaccgcaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacggcaagatggccagcgtgaagtgcccgcccaagtacgagctgacggaggactgcaacttctgccggcagatgaccggggcctccctgaagaagggcagctaccccctccaggacctgttctgccagagctccgaggacgacgggagcaagctgaagaccaagatgaagggcgtgtgcgaggtcggcgtgcaggccctcaagaagtgcgacgggcagctgtccaccgcgcacgaggtggtccccttcgccgtgttcaagaacagcaagaaggtgtacctggacaagctcgacctgaagacggaggagaacctgctccccgactccttcgtctgcttcgagcacaagggccagtacaaggggaccatggacagcggccagaccaagcgcgagctgaagtccttcgacatcagccagtgccccaagatcgggggccacggctccaagaagtgcaccggggacgccgccttctgcagcgcctacgagtgcacggcgcagtacgccaacgcctactgctcccacgccaacggcagcgggatcgtgcagatccaggtctccggcgtgtggaagaagccgctgtgcgtggggtacgagcgggtcgtggtgaagcgcgagctcagcgcgaagcccatccagcgggtcgagccctgcacgacctgcatcaccaagtgcgagccccacggcctggtggtgcgctccaccggcttcaagatcagctccgccgtcgcctgcgccagcggggtgtgcgtgaccggctcccagagcccgagcaccgagatcaccctgaagtaccccgggatctcccagagctccggcggggacatcggcgtccacatggcccacgacgaccagagcgtgtccagcaagatcgtggcgcactgcccgccccaggacccctgcctcgtccacggctgcatcgtgtgcgcccacgggctgatcaactaccagtgccacacggccctgtccgccttcgtggtcatcttcgtgttcagctccaccgccatcatctgcctcgcggtgctgtaccgggtcctgaagtgcctcaagatcgcgccccgcaaggtgctgaaccccctgatgtggatcaccgccttcatccgctgggtgtacaagaagatggtcgcccgggtggccgacaacatcaaccaggtgaaccgcgagatcggctggatggagggcgggcagctcgccctgggcaacccggcccccatcccccggcacgcccccatcccgcgctacagcacctacctgatgctgctcctgatcgtctcctacgccagcgcgtgctccgagctgatccaggccagctcccggatcacgacctgcagcaccgagggggtgaacaccaagtgccgcctctccggcacggccctgatccgggccgggagcgtgggcgccgaggcgtgcctgatgctcaagggggtcaaggaggaccagaccaagttcctgaagatcaagaccgtgagctccgagctgagctgccgcgagggccagtcctactggaccggcagcttctcccccaagtgcctcagctcccggcgctgccacctggtgggggagtgccacgtcaaccggtgcctgagctggcgcgacaacgagacctccgccgagttcagcttcgtgggcgagtccacgaccatgcgggagaacaagtgcttcgagcagtgcgggggctgggggtgcggctgcttcaacgtgaaccccagctgcctcttcgtccacacctacctgcagtccgtgcgcaaggaggccctgcgggtgttcaactgcatcgactgggtccacaagctcaccctggagatcacggacttcgacggcagcgtgtccaccatcgacctgggggccagctccagccgcttcaccaactggggctccgtgagcctcagcctggacgccgaggggatctccggcagcaactccttcagcttcatcgagtcccccgggaagggctacgcgatcgtcgacgagccgttcagcgagatcccccggcagggcttcctgggggagatccgctgcaactccgagagctccgtgctcagcgcccacgagtcctgcctgcgggcccccaacctggtgagctacaagcccatgatcgaccagctcgagtgcaccacgaacctgatcgacccgttcgtcgtgttcgagcgcggctccctgccccagacccgcaacgacaagaccttcgccgccagcaaggggaaccggggcgtgcaggcgttctccaaggggagcgtccaggccgacctcaccctgatgttcgacaacttcgaggtggacttcgtgggcgccgccgtctcctgcgacgcggccttcctgaacctcacgggctgctacagctgcaacgccggggcccgcgtgtgcctgtccatcaccagcaccggcaccgggacgctgagcgcccacaacaaggacggctccctccacatcgtcctgcccagcgagaacggcaccaaggaccagtgccagatcctgcacttcaccgtgcccgaggtggaggaggagttcatgtactcctgcgacggggacgagcggccgctcctggtcaagggcaccctgatcgcgatcgaccccttcgacgaccgccgggaggccgggggcgagagcacggtggtgaaccccaagtccgggagctggaacttcttcgactggttctccggcctcatgagctggttcggcgggcccctgaagaccatcctgctcatctgcctgtacgtcgccctgtccatcggcctcttcttcctgctgatctacctcgggcgcaccggcctgagcaagatgtggctggccgccaccaagaaggcgtcctga

SEQ ID NO: 12784 - RNA, 3594 nt, synthetic construct
  misc_feature 1..3594: note = derived and/or modified CDS sequence (opt1) from RVFV(KEN07-KUR340)__EF460404.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcatcttcgtgttcagctccaccgccatcatctgcctcgcggtgctgtaccgcatgctgaagtgcctcaagatcgcgccccggatcgtcctgaaccccctgatgtggatcaccgccttcatccgctgggtgtacaagaagatggtggcccgcgtcgccgacaacatcaaccaggtgaaccgggagatcgggtggatggagggcggccagctcgccctggggaacccggcccccatcccccgccacgcccccatcccgcggtacagcacctacctgatgctgctcctgatcgtgtcctacgccagcgcgtgctccgagctgatccaggccagctcccgcatcacgacctgcagcaccgagggcgtcaacaccaagtgccggctctccgggacggccctgatccgcgccggcagcgtgggggccgaggcgtgcctgatgctcaagggcgtgaaggaggaccagaccaagttcctgaagatcaagaccgtcagctccgagctgagctgccgggagggccagtcctactggaccgggagcttctcccccaagtgcctcagctcccgccggtgccacctggtgggcgagtgccacgtgaaccgctgcctgagctggcgggacaacgagacctccgccgagttcagcttcgtcggggagtccacgaccatgcgcgagaacaagtgcttcgagcagtgcggcgggtggggctgcggctgcttcaacgtgaaccccagctgcctcttcgtgcacacctacctgcagtccgtccggaaggaggccctgcgcgtgttcaactgcatcgactgggtgcacaagctcaccctggagatcacggacttcgacgggagcgtctccaccatcgacctgggcgccagctccagccggttcaccaactgggggtccgtgagcctcagcctggacgccgagggcatctccgggagcaactccttcagcttcatcgagtcccccggcaagggctacgcgatcgtggacgagccgttcagcgagatcccccgccaggggttcctgggcgagatccggtgcaactccgagagctccgtcctcagcgcccacgagtcctgcctgcgcgcccccaacctggtgagctacaagcccatgatcgaccagctcgagtgcaccacgaacctgatcgacccgttcgtggtcttcgagcgggggtccctgccccagacccgcaacgacaagaccttcgccgccagcaagggcaaccgcggggtgcaggcgttctccaagggcagcgtgcaggccgacctcaccctgatgttcgacaacttcgaggtcgacttcgtgggcgccgccgtgtcctgcgacgcggccttcctgaacctcacggggtgctacagctgcaacgccggcgcccgggtctgcctgtccatcaccagcaccgggaccggcacgctgagcgcccacaacaaggacggctccctccacatcgtgctgcccagcgagaacgggaccaaggaccagtgccagatcctgcacttcaccgtccccgaggtggaggaggagttcatgtactcctgcgacggcgacgagcgcccgctcctggtgaaggggaccctgatcgcgatcgaccccttcgacgaccggcgcgaggccggcggggagagcacggtcgtgaaccccaagtccggcagctggaacttcttcgactggttctccggcctcatgagctggttcgggggccccctgaagaccatcctgctcatctgcctgtacgtggccctgtccatcgggctgttcttcctgctgatctacctcggccggaccgggctgagcaagatgtggctggccgccaccaagaaggcgtcctga

SEQ ID NO: 12785 - RNA, 3594 nt, synthetic construct
  misc_feature 1..3594: note = derived and/or modified CDS sequence (opt1) from RVFV(2373/74)__DQ380194.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgctacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctggagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctgtgcgtgggctacgagcgcgtggtcgtgaagcgggagctcagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctgaagtaccccggcatctcccagagctccgggggcgacatcggcgtgcacatggcccacgacgaccagagcgtctccagcaagatggtggcgcactgcccgccccaggacccctgcctcgtgcacgggtgcatcgtctgcgcccacggcctgatcaactaccagtgccacacggccctgtccgccttcgtggtggtcttcgtgttcagctccgtggccatcatctgcctcgcgatcctgtacaaggtcctgaagtgcctcaagatcgcgccccgcaaggtgctgaaccccctgatgtggatcaccgccttcatccggtgggtgtacaagaagatggtcgcccgcgtggccgacaacatcaaccaggtgaaccgcgagatcgggtggatggagggcggccagctcgccctggggaacccggcccccatcccccggcacgcccccatcccgcgctacagcacctacctgatgctgctcctgatcgtctcctacgccagcgcgtgctccgagctgatccaggccagctcccggatcaccacgtgcagcaccgagggcgtgaacaccaagtgccgcctctccgggaccgccctgatccgggccggcagcgtgggggccgaggcgtgcctgatgctcaagggcgtcaaggaggaccagacgaagttcctgaagatcaagaccgtgagctccgagctgagctgccgcgagggccagtcctactggaccgggagcttctcccccaagtgcctcagctcccggcgctgccacctggtgggcgagtgccacgtcaaccggtgcctgagctggcgcgacaacgagacctccgccgagttcagcttcgtgggggagtccaccacgatgcgggagaacaagtgcttcgagcagtgcggcgggtggggctgcggctgcttcaacgtgaaccccagctgcctcttcgtccacacctacctgcagtccgtgcgcaaggaggccctgcgggtgttcaactgcatcgactgggtccacaagctcaccctggagatcaccgacttcgacgggagcgtgtccacgctggacctcggcgccagctccagccgcttcaccaactgggggtccgtgagcctgagcctggacgccgagggcatctccgggagcaactccttcagcttcatcgagtcccccggcaagggctacgcgatcgtcgacgagccgttcagcgagatcccccggcaggggttcctcggcgagatccgctgcaactccgagagctccgtgctgagcgcccacgagtcctgcctgcgggcccccaacctcatcagctacaagcccatgatcgaccagctggagtgcaccaccaacctgatcgacccgttcgtggtcttcgagcgcgggtccctcccccagacgcggaacgagaagaccttcgccgccagcaagggcaaccgcggggtgcaggcgttctccaagggcagcgtgcaggccgacctgaccctgatgttcgacaacttcgaggtcgacttcgtgggcgccgccgtgtcctgcgacgcggccttcctcaacctgaccgggtgctacagctgcaacgccggcgcccgcgtctgcctgtccatcacgagcaccgggaccggcaccctcagcgcccacaacaaggacggctccctgcacatcgtgctgcccagcgagaacgggacgaaggaccagtgccagatcctccacttcaccgtccccgaggtggaggaggagttcatgtactcctgcgacggcgacgagcggccgctgctggtgaaggggaccctcatcgcgatcgaccccttcgacgaccgccgggaggccggcggggagagcaccgtcgtgaaccccaagtccggcagctggaacttcttcgactggttctccggcctgatgagctggttcgggggccccctgaagacgatcctcctgatctgcctgtacgtggccctctccatcgggctgttcttcctgctcatctacctgggccgcaccgggctgagcaagatgtggctcgccgccaccaagaaggcgtcctga

SEQ ID NO: 12786 - RNA, 3594 nt, synthetic construct
  misc_feature 1..3594: note = derived and/or modified CDS sequence (opt1) from RVFV(200803169)__JF311384.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagccgctgtgcgtgggctacgagcgcgtcgtggtgaagcgggagctcagcgcgaagcccatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagcccgagcaccgagatcaccctgaagtaccccggcatctcccagagctccgggggcgacatcggcgtccacatggcccacgacgaccagagcgtgtccagcaagatcgtggcgcactgcccgccccaggacccctgcctcgtccacgggtgcatcgtgtgcgcccacggcctgatcaactaccagtgccacacggccctgtccgccttcgtggtcatcttcgtgttcagctccaccgccatcatctgcctcgcggtgctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgccctggggaacccggcccccatcccccgccacgcccccatcccgcggtacagcacctacctgatgctgctcctgatcgtctcctacgccagcgcgtgctccgagctgatccaggccagctcccgcatcacgacctgcagcaccgagggcgtgaacaccaagtgccggctctccgggacggccctgatccgcgccggcagcgtgggggccgaggcgtgcctgatgctcaagggcgtcaaggtggaccagaccaagttcctgaagatcaagaccgtgagctccgagctgagctgccgggagggccagtcctactggaccgggagcttctcccccaagtgcctcagctcccgccggtgccacctggtcggcgagtgccacgtgaaccgctgcctgagctggcgggacaacgagacctccgccgagttcagcttcgtgggggagtccacgaccatgcgcgagaacaagtgcttcgagcagtgcggcgggtggggctgcggctgcttcaacgtcaaccccagctgcctcttcgtgcacacctacctgcagtccgtgcggaaggaggccctgcgcgtcttcaactgcatcgactgggtgcacaagctcaccctggagatcacggacttcgacgggagcgtgtccaccatcgacctgggcgccagctccagccggttcaccaactgggggtccgtcagcctcagcctggacgccgagggcatctccgggagcaactccttcagcttcatcgagtcccccggcaagggctacgcgatcgtggacgagccgttcagcgagatcccccgccaggggttcctgggcgaggtgcggtgcaactccgagagctccgtcctcagcgcccacgagtcctgcctgcgcgcccccaacctggtgagctacaagcccatgatcgaccagctcgagtgcaccacgaacctgatcgacccgttcgtggtcttcgagcgggggtccctgccccagacccgcaacgacaagaccttcgccgccagcaagggcaaccgcggggtgcaggcgttctccaagggcagcgtgcaggccgacctcaccctgatgttcgacaacttcgaggtcgacttcgtgggcgccgccgtctcctgcgacgcggccttcctgaacctcacggggtgctacagctgcaacgccggcgcccgggtgtgcctgtccatcaccagcaccgggaccggcacgctgagcgcccacaacaaggacggctccctccacatcgtgctgcccagcgagaacgggaccaaggaccagtgccagatcctgcacttcaccgtccccgaggtggaggaggagttcatgtactcctgcgacggcgacgagcgcccgctcctggtgaaggggaccctgatcgcgatcgaccccttcgacgaccggcgcgaggccggcggggagagcacggtcgtgaaccccaagtccggcagctggaacttcttcgactggttctccggcctcatgagctggttcgggggccccctgaagaccatcctgctcatctgcctgtacgtggccctgtccatcgggctgttcttcctgctgatctacctcggccggaccgggctgagcaagatgtggctggccgccaccaagaaggcgtcctga

SEQ ID NO: 12787 - RNA, 3594 nt, synthetic construct
  misc_feature 1..3594: note = derived and/or modified CDS sequence (opt1) from RVFV(200803167)__JF311382.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacctgcacctccggaaccgccccggcaaggggcacaactacatcgacggcatgacccaggaggacgcgacctgcaagcccgtcacgtacgccggggcctgcagctccttcgacgtgctgctggagaagggcaagttcccgctgttccagagctacgcccaccaccggaccctcctggaggccgtgcacgacaccatcatcgccaaggccgacccgccctcctgcgacctgcagagcgcgcacggcaacccctgcatgaaggagaagctcgtcatgaagacccactgccccaacgactaccagtccgcccactacctgaacaacgacgggaagatggccagcgtgaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtcggggtgcaggccctgaagaagtgcgacggccagctgtccaccgcgcacgaggtggtccccttcgccgtgttcaagaacagcaagaaggtgtacctcgacaagctggacctgaagacggaggagaacctcctgcccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctccggggtgtggaagaagcccctctgcgtgggctacgagcgcgtcgtggtgaagcgggagctgagcgcgaagccgatccagcgcgtcgagccctgcacgacctgcatcaccaagtgcgagccccacggcctggtggtgcggtccaccgggttcaagatcagctccgccgtcgcctgcgccagcggcgtgtgcgtgaccgggtcccagagccccagcaccgagatcgccctcaagtacccgggcatctcccagagctccgggggcgacatcggcgtccacatggcgcacgacgaccagagcgtgtccagcaagatcgtggcccactgcccgccccaggacccctgcctggtccacgggtgcatcgtgtgcgcccacggcctgatcaactaccagtgccacaccgccctctccgccttcgtggtcgtgttcgtgttcagctccatcgcgatcatctgcctggccatcctgtaccgcgtcctcaagtgcctgaagatcgcgccccggaaggtgctgaaccccctcatgtggatcacggccttcatccgctgggtgtacaagaagatggtcgcccgcgtggccgacaacatcaaccaggtgaaccgggagatcgggtggatggagggcggccagctggtcctggggaaccccgccccgatcccccgccacgcccccatcccccggtacagcacctacctgatgctcctgctgatcgtgtcctacgccagcgcgtgctccgagctcatccaggccagctcccgcatcacgacctgcagcaccgagggcgtgaacaccaagtgccggctgtccgggaccgccctgatccgcgccggcagcgtcggggccgaggcgtgcctcatgctgaagggcgtgaaggaggaccagaccaagttcctgaagatcaagacggtgagctccgagctcagctgccgggagggccagtcctactggaccgggagcttctccccgaagtgcctgagctcccgccggtgccacctggtcggcgagtgccacgtgaaccgctgcctcagctggcgggacaacgagacctccgccgagttcagcttcgtgggggagtccaccaccatgcgcgagaacaagtgcttcgagcagtgcggcgggtggggctgcggctgcttcaacgtcaaccccagctgcctgttcgtgcacacgtacctgcagtccgtgcggaaggaggccctccgcgtcttcaactgcatcgactgggtgcacaagctgaccctggagatcaccgacttcgacgggagcgtgtccaccatcgacctcggcgccagctccagccggttcacgaactgggggtccgtcagcctgagcctggacgccgagggcatctccgggagcaactccttcagcttcatcgagtcccccggcaagggctacgcgatcgtggacgagcccttcagcgagatcccgcgccaggggttcctcggcgagatccggtgcaactccgagagctccgtgctgagcgcccacgagtcctgcctgcgcgcccccaacctcatcagctacaagcccatgatcgaccagctggagtgcaccaccaacctgatcgaccccttcgtcgtgttcgagcgggggtccctcccgcagacccgcaacgacaagacgttcgccgccagcaagggcaaccgcggggtgcaggcgttctccaagggcagcgtccaggccgacctgaccctgatgttcgacaacttcgaggtggacttcgtgggcgccgccgtctcctgcgacgcggccttcctcaacctgaccgggtgctacagctgcaacgccggcgcccgggtgtgcctgtccatcaccagcacggggaccggcaccctcagcgcccacaacaaggacggctccctgcacatcgtcctgcccagcgagaacgggaccaaggaccagtgccagatcctccacttcacggtgcccgaggtggaggaggagttcatgtactcctgcgacggcgacgagcgccccctgctggtcaaggggaccctcatcgcgatcgacccgttcgacgaccggcgcgaggccggcggggagagcaccgtggtgaaccccaagtccggcagctggaacttcttcgactggttctccggcctgatgagctggttcgggggccccctgaagaccatgctcctgatctgcctgtacgtcgccctctccatcgggctgttcttcctgctcatctacctgggccggacggggctgagcaagatgtggctcgccgccaccaagaaggcgtcctga

SEQ ID NO: 12788 - RNA, 3594 nt, synthetic construct
  misc_feature 1..3594: note = derived and/or modified CDS sequence (opt1) from RVFV(Entebbe)__DQ380191.1__GP
  source 1..3594: mol_type = other RNA
atgtacgccctgctcaccatcctgatcagcgtgctggtctgcgaggccgtgatccgcgtgtccctcagctccacccgggaggagacgtgcttcggcgacagcaccaaccccgagatgatcgagggggcgtgggactccctgcgcgaggaggagatgccggaggagctgagctgctccatcagcggcatccgggaggtcaagacctccagccaggagctccaccgcgccctgaaggccatcatcgccgccgacgggctgaacaacatcacgtgccacggcaaggaccccgaggacaagatctccctcatcaaggggccgccccacaagaagcgggtgggcgtggtccgctgcgagcggcgccgggacgcgaagcagatcggccgcgagaccatggccgggatcgccatgaccgtgctgcccgccctggcggtgttcgccctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggcggacccgccctcctgcgacctgcagagcgcccacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggcgctcaagaagtgcgacggccagctgtccaccgcccacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagatcaagcgggagctgaagtccttcgacatcagccagtgccccaagatcggcggccacgggtccaagaagtgcaccggcgacgccgccttctgcagcgcgtacgagtgcaccgcccagtacgccaacgcctactgctcccacgcgaacgggagcggcatcgtccagatccaggtgtccggggtctggaagaagccgctgtgcgtgggctacgagcgcgtggtcgtgaagcgggagctcagcgccaagcccatccagcgcgtggagccctgcacgacctgcatcaccaagtgcgagccccacggcctggtcgtgcggtccaccgggttcaagatcagctccgccgtggcctgcgccagcggcgtctgcgtgacggggtcccagagcccgagcaccgagatcaccctgaagtaccccggcatctcccagagctccgggggcgacatcggcgtgcacatggcgcacgacgaccagagcgtctccagcaagatcgtggcccactgcccgccccaggacccctgcctcgtgcacgggtgcatcgtctgcgcccacggcctgatcaactaccagtgccacaccgccctgtccgccttcgtggtggtcttcgtgttcagctccgtggcgatcatctgcctcgccatcctgtacaaggtcctgaagtgcctcaagatcgcgccccgcaaggtgctgaaccccctgatgtggatcacggccttcatccggtgggtgtacaagaagatggtcgcccgcgtggccgacaacatcaaccaggtgaaccgcgagatcgggtggatggagggcggccagctcgtcctggggaacccggcccccatcccccggcacgcccccatcccgcgctacagcacctacctgatgctgctcctgatcgtgtcctacgccagcgcgtgctccgagctgatccaggccagctcccggatcacgacctgcagcaccgagggcgtgaacaccaagtgccgcctctccgggaccgccctgatccgggccggcagcgtcggggccgaggcgtgcctgatgctcaagggcgtgaaggaggaccagaccaagttcctgaagatcaagacggtgagctccgagctgagctgccgcgagggccagtcctactggaccgggagcttctcccccaagtgcctcagctcccggcgctgccacctggtcggcgagtgccacgtgaaccggtgcctgagctggcgcgacaacgagacctccgccgagttcagcttcgtgggggagtccaccaccatgcgggagaacaagtgcttcgagcagtgcggcgggtggggctgcggctgcttcaacgtcaaccccagctgcctcttcgtgcacacgtacctgcagtccgtgcgcaaggaggccctgcgggtcttcaactgcatcgactgggtgcacaagctcaccctggagatcaccgacttcgacgggagcgtgtccaccgtcgacctgggcgccagctccagccgcttcacgaactgggggtccgtgagcctcagcctggacgccgagggcatctccgggagcaactccttcagcttcatcgagtcccccggcaagggctacgcgatcgtggacgagccgttcagcgagatcccccggcaggggttcctgggcgagatccgctgcaactccgagagctccgtcctcagcgcccacgagtcctgcctgcgggcccccaacctgatcagctacaagcccatgatcgaccagctcgagtgcaccaccaacctgatcgacccgttcgtggtgttcgagcgcgggtccctgccccagacccggaacgacaagacgttcgccgccagcaagggcaaccgcggggtccaggcgttctccaagggcagcgtgcaggccgacctcaccctgatgttcgacaacttcgaggtggacttcgtcggcgccgccgtgtcctgcgacgcggccttcctgaacctcaccgggtgctacagctgcaacgccggcgcccgcgtctgcctgtccatcaccagcacggggaccggcaccctgagcgcccacaacaaggacggctccctccacatcgtgctgcccagcgagaacgggaccaaggaccagtgccagatcctgcacttcacggtgcccgaggtcgaggaggagttcatgtactcctgcgacggcgacgagcggccgctcctggtgaaggggaccctgatcgcgatcgaccccttcgacgaccgccgggaggccggcggggagagcaccgtggtcaaccccaagtccggcagctggaacttcttcgactggttctccggcctcatgagctggttcgggggccccctgaagaccatcctgctcatctgcctgtacgtggccctgtccatcgggctgttcttcctgctgatctacctcggccgcacggggctgagcaagatgtggctggccgccaccaagaaggcgtcctga

SEQ ID NO: 12789 - RNA, 3594 nt, synthetic construct
  misc_feature 1..3594: note = derived and/or modified CDS sequence (opt1) from RVFV(25010-24)__KM210509.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagcgcgcctgggactccctgcgggaggaggagatgccggaggagctgagctgctccatcagcgggatccgcgaggtgaagacctccagccaggagctctaccgggcgctgaaggccatcatcgccgccgacggcctgaacaacatcacgtgccacgggaaggaccccgaggacaagatctccctcatcaagggcccgccccacaagaagcgcgtggggatcgtccggtgcgagcgccggcgcgacgccaagcaggtcggccgggagacgatggcgggcatcgccatgaccgtgctgcccgccctggccgtcttcgcgctcgcccccgtggtgttcgccgaggacccccacctccgcaaccggcccgggaagggccacaactacatcgacgggatgacccaggaggacgcgacctgcaagccggtcacgtacgccggcgcgtgcagctccttcgacgtgctgctcgagaaggggaagttccccctgttccagagctacgcccaccaccgcaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacggcaagatggccagcgtgaagtgcccgcccaagtacgagctgacggaggactgcaacttctgccggcagatgaccggggcctccctgaagaagggcagctaccccctccaggacctgttctgccagagctccgaggacgacgggagcaagctgaagaccaagatgaagggcgtgtgcgaggtcggcgtgcaggccctcaagaagtgcgacgggcagctgtccaccgcgcacgaggtggtccccttcgccgtgttcaagaacagcaagaaggtgtacctggacaagctcgacctgaagacggaggagaacctgctccccgactccttcgtctgcttcgagcacaagggccagtacaaggggaccatggacagcggccagaccaagcgcgagctgaagtccttcgacatcagccagtgccccaagatcgggggccacggctccaagaagtgcaccggggacgccgccttctgcagcgcctacgagtgcaccgcccagtacgccaacgcctactgctcccacgccaacggcagcgggatcgtgcagatccaggtgtccggcgtgtggaagaagccgctgtgcgtggggtacgagcgggtcgtggtgaagcgcgagctgagcgcgaagcccatccagcgggtcgagccctgcacgacctgcatcaccaagtgcgagccccacggcctgatcgtgcgctccaccggcttcaagatcagctccgccgtggcctgcgccagcggggtctgcgtgaccggctcccagagcccgagcaccgagatcaccctgaagtaccccgggatctcccagagctccggcggggacatcggcgtgcacatggcccacgacgaccagagcgtctccagcaagatcgtggcgcactgcccgccccaggacccctgcctcgtgcacggctgcatcgtctgcgcccacgggctgatcaactaccagtgccacacggccctgtccgccttcgtggtggtcttcgtgttcagctccgtggccatcatctgcctcgcgatcctgtacaaggtcctgaagtgcctcaagatcgcccccaagaaggtgctgaaccccctgatgtggatcaccgccttcatccggtgggtgtacaagaagatggtcgcccgcgtggccgacaacatcaaccaggtgaaccgcgagatcggctggatggagggcgggcagctcgcgctgggcaacccggcccccatcccccggcacgcccccatcccgcgctacagcacctacctgatgctgctcctgatcgtctcctacgccagcgcgtgctccgagctgatccaggccagctcccggatcaccacgtgcagcaccgagggggtgaacaccaagtgccgcctctccggcaccgccctgatccgggccgggagcgtgggcgccgaggcgtgcctgatgctcaagggggtcaaggacgaccagacgaagttcctgaagatcaagaccgtgagctccgagctgagctgccgcgagggccagtcctactggaccggcagcttctcccccaagtgcctcagctcccggcgctgccacctggtgggggagtgccacgtcaaccggtgcctgagctggcgcgacaacgagacctccgccgagttcagcttcgtgggcgagtccaccacgatgcgggagaacaagtgcttcgagcagtgcgggggctgggggtgcggctgcttcaacgtgaaccccagctgcctcttcgtccacacctacctgcagtccgtgcgcaaggaggccctgcgggtgttcaactgcatcgactgggtccacaagctcaccctggagatcaccgacttcgacggcagcgtgtccacgatcgacctgggggccagctccagccgcttcaccaactggggctccgtgagcctcagcctggacgccgaggggatctccggcagcaactccttcagcttcatcgagtcccccgggaagggctacgcgatcgtcgacgagccgttcagcgagatcccccggcagggcttcctgggggagatccgctgcaactccgagagctccgtgctcagcgcccacgagtcctgcctgcgggcccccaacctgatcagctacaagcccatgatcgaccagctcgagtgcaccaccaacctgatcgacccgttcgtggtcttcgagcgcggctccctgccccagacgcggaacgacaagaccttcgccgccagcaaggggaaccgcggcgtgcaggcgttctccaaggggagcgtgcaggccgacctcaccctgatgttcgacaacttcgaggtcgacttcgtgggcgccgccgtgtcctgcgacgcggccttcctgaacctcaccggctgctacagctgcaacgccggggcccgcgtctgcctgtccatcacgagcaccggcaccgggaccctgagcgcccacaacaaggacggctccctccacatcgtgctgcccagcgagaacggcacgaaggaccagtgccagatcctgcacttcaccgtccccgaggtggaggaggagttcatgtactcctgcgacggggacgagcggccgctcctggtgaagggcaccctgatcgcgatcgaccccttcgacgaccgccgggaggccgggggcgagagcaccgtcgtgaaccccaagtccgggagctggaacttcttcgactggttctccggcctcatgagctggttcggcgggcccctgaagacgatcctgctcatctgcctgtacgtggccctgtccatcggcctcttcttcctgctgatctacctcgggcgcaccggcctgagcaagatgtggctggccgccaccaagaaggcgtcctga

SEQ ID NO: 12790 - RNA, 3594 nt, synthetic construct
  misc_feature 1..3594: note = derived and/or modified CDS sequence (opt1) from RVFV(Kenya 9800523)__DQ380196.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacaccaagcagatcggccgcgagaccatggccgggatcgcgatgaccgtgctgcccgccctggccgtcttcgccctcgcgcccgtggtgttcgccgaggacccccacctccggaaccgccccggcaaggggcacaactacatcgacggcatgacccaggaggacgccacgtgcaagccggtcacctacgccggggcctgcagctccttcgacgtgctgctcgagaagggcaagttccccctgttccagagctacgcgcaccaccggaccctgctcgaggccgtgcacgacaccatcatcgccaaggccgacccgccctcctgcgacctgcagagcgcccacggcaacccctgcatgaaggagaagctggtcatgaagacgcactgccccaacgactaccagtccgcgcactacctcaacaacgacgggaagatggccagcgtgaagtgcccgcccaagtacgagctgaccgaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccacggcccacgaggtggtccccttcgcggtgttcaagaacagcaagaaggtgtacctggacaagctcgacctgaagaccgaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcacgggcgacgccgccttctgcagcgcctacgagtgcaccgcccagtacgcgaacgccttctgctcccacgccaacgggagcggcatcgtgcagatccaggtctccggggtgtggaagaagccgctgtgcgtgggctacgagcgcgtcgtggtgaagcgggagctcagcgccaagcccatccagcgcgtcgagccctgcacgacctgcatcaccaagtgcgagccccacggcctggtggtgcggtccaccgggttcaagatcagctccgcggtcgcctgcgccagcggcgtgtgcgtgaccgggtcccagagcccgagcaccgagatcacgctgaagtaccccggcatctcccagagctccgggggcgacatcggcgtccacatggcccacgacgaccagagcgtgtccagcaagatcgtggcccactgcccgccccaggacccctgcctcgtccacgggtgcatcgtgtgcgcgcacggcctgatcaactaccagtgccacaccgccctgtccgccttcgtggtcgtgttcgtgttcagctccatcgccatcatctgcctcgccatcctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcgggtggatggagggcggccagctcgtcctggggaacccggcccccatcccccgccacgcgcccatcccgcggtacagcacctacctgatgctgctcctgatcgtgtcctacgccagcgcctgctccgagctgatccaggccagctcccgcatcacgacctgcagcaccgagggcgtgaacaccaagtgccggctctccgggacggcgctgatccgcgccggcagcgtcggggccgaggcctgcctgatgctcaagggcgtgaaggaggaccagaccaagttcctgaagatcaagaccgtgagctccgagctgagctgccgggagggccagtcctactggaccgggagcttctcccccaagtgcctcagctcccgccggtgccacctggtcggcgagtgccacgtgaaccgctgcctgagctggcgggacaacgagacctccgccgagttcagcttcgtgggggagtccacgaccatgcgcgagaacaagtgcttcgagcagtgcggcgggtggggctgcggctgcttcaacgtcaaccccagctgcctcttcgtgcacacctacctgcagtccgtgcggaaggaggcgctgcgcgtcttcaactgcatcgactgggtgcacaagctcaccctggagatcacggacttcgacgggagcgtgtccaccatcgacctgggcgccagctccagccggttcaccaactgggggtccgtcagcctcagcctggacgccgagggcatctccgggagcaactccttcagcttcatcgagtcccccggcaagggctacgccatcgtggacgagccgttcagcgagatcccccgccaggggttcctgggcgagatccggtgcaactccgagagctccgtgctcaacgcccacgagagctgcctgcgcgcgcccaacctgatctcctacaagcccatgatcgaccagctcgagtgcaccacgaacctgatcgacccgttcgtcgtgttcgagcgggggagcctgccccagacccgcaacgacaagaccttcgccgcctccaagggcaaccgcggggtgcaggccttcagcaagggctccgtccaggccgacctcaccctgatgttcgacaacttcgaggtggacttcgtgggcgcggccgtcagctgcgacgccgccttcctgaacctcacggggtgctactcctgcaacgcgggcgcccgggtgtgcctgagcatcacctccaccgggaccggcacgctgagcgcccacaacaaggagggcagcctccacatcgtcctgccctccgagaacgggaccaaggaccagtgccagatcctgcacttcaccgtgcccgaggtggaggaggagttcatgtacagctgcgacggcgacgagcgcccgctcctggtcaaggggaccctgatcgccatcgaccccttcgacgaccggcgcgaggccggcggggagtccacggtggtgaaccccaagagcggctcctggaacttcttcgactggttcagcggcctcatgtcctggttcgggggccccctgaagaccatcctgctcatctgcctgtacgtcgcgctgagcatcgggctgttcttcctgctgatctacctcggccggaccgggctgtccaagatgtggctggccgccaccaagaaggccagctga

SEQ ID NO: 12791 - RNA, 3594 nt, synthetic construct
  misc_feature 1..3594: note = derived and/or modified CDS sequence (opt1) from RVFV(ANK-6087)__DQ380216.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctggagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcacaaggggcagtacaagggcaagctggacagcgggcagaccaagcgggagctgaagtccttcgacatcagccagtgccccaagatcggcggccacgggtccaagaagtgcaccggcgacgccgccttctgcagcgcctacgagtgcaccgcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgacggggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgggtgcatcgtctgcgcccacggcctgatcaactaccagtgccacaccgccctctccgccttcgtggtggtcttcgtgttcagctccatcgccatcatctgcctggcgatcctgtaccgcgtgctcaagtgcctgaagatcgcgccccggaaggtcctgaaccccctcatgtggatcacggccttcatccgctgggtgtaccgcaagatggtggcccgggtcgccgacaacatcaaccaggtgaaccgcgagatcgggtggatggagggcggccagctggtgctggggaacccggcccccatcccccggcacgtccccatcccgcgctacagcacctacctgatgctcctgctgatcgtgtcctacgccagcgcctgctccgagctcatccaggccagctcccggatcacgacctgcagcaccgagggcgtgaacaccaagtgccgcctgtccgggaccgcgctgatccgggccggcagcgtcggggccgaggcctgcctcatgctgaagggcgtgaaggaggaccagaccaagttcctgaagatcaagacggtgagctccgagctcagctgccgcgagggccagtcctactggaccgggagcttctcccccaagtgcctgagctcccggcgctgccacctggtcggcgagtgccacgtgaaccggtgcctcagctggcgcgacaacgagacctccgccgagttcagcttcgtgggggagtccaccaccatgcgggagaacaagtgcttcgagcagtgcggcgggtggggctgcggctgcttcaacgtcaaccccagctgcctgttcgtgcacacgtacctgcagtccgtgcgcaaggaggcgctccgggtcttcaactgcatcgactgggtgcacaagctgaccctggagatcaccgacttcgacgggagcgtgtccaccatcgacctcggcgccagctccagccgcttcacgaactgggggtccgtcagcctgagcctggacgccgagggcatctccgggagcaactccttcagcttcatcgagtcccccggcaagggctacgccatcgtggacgagccgttcagcgagatcccccggcaggggttcctcggcgagatccgctgcaactccgagagctccgtgctgagcgcccacgagtcctgcctgcgggcgcccaacctcatcagctacaagcccatgatcgaccagctggagtgctccaccaacctgatcgacccgttcgtcgtgttcaagcgcgggagcctcccccagacccgcaacgacaagaccttcgccgcctccaagggcaaccgcggggtgcaggccttcagcaagggctccgtccaggccgacctgacgctgatgttcgacaacttcgaggtggacttcgtgggcgcggccgtcagctgcgacgccgccttcctcaacctgaccgggtgctactcctgcaacgcgggcgcccgggtgtgcctgagcatcaccagcaccgggacgggcaccctctccgcccacaacaaggacggcagcctgcacatcgtcctgccctccgagaacgggaccaaggaccagtgccagatcctccacttcaccgtgcccgaggtggaggaggagttcatgtacagctgcgacggcgacgagcggccgctgctggtccgcgggacgctcatcgccatcgaccccttcgacgaccggcgcgaggccggcggggagtccaccgtggtgaaccccaagagcggctcctggaacttcttcgactggttcagcggcctgatgtcctggttcgggggccccctgaagaccatcctcctgatctgcctgtacgtcgcgctcagcatcgggctgttcttcctgctcatctacctgggccggaccgggctgtccaagatgtggctcgccgccacgaagaaggccagctga

SEQ ID NO: 12792 - RNA, 3594 nt, synthetic construct
  misc_feature 1..3594: note = derived and/or modified CDS sequence (opt1) from RVFV(SAUDI 200010901)__KU978778.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcggccggcgccgggacaccaagcagatcgggcgcgagaccatggccggcatcgcgatgaccgtgctgcccgccctggccgtcttcgccctcgcgcccgtggtgttcgccgaggacccccacctccggaaccgccccgggaagggccacaactacatcgacgggatgacccaggaggacgccacgtgcaagccggtcacctacgccggcgcctgcagctccttcgacgtgctgctggagaagggcaagttccccctgttccagagctacgcgcaccaccggaccctgctcgaggccgtgcacgacaccatcatcgccaaggccgacccgccctcctgcgacctgcagagcgcccacgggaacccctgcatgaaggagaagctggtcatgaagacgcactgccccaacgactaccagtccgcgcactacctcaacaacgacggcaagatggccagcgtgaagtgcccgcccaagtacgagctgaccgaggactgcaacttctgccgccagatgaccggggcctccctgaagaagggcagctaccccctccaggacctgttctgccagagctccgaggacgacggcagcaagctgaagaccaagatgaagggggtgtgcgaggtcggcgtgcaggccctcaagaagtgcgacgggcagctgtccacggcccacgaggtggtccccttcgcggtgttcaagaacagcaagaaggtgtacctggacaagctcgacctgaagaccgaggagaacctgctccccgactccttcgtctgcttcgagcacaagggccagtacaaggggaccatggacagcggccagaccaagcgggagctgaagtccttcgacatcagccagtgccccaagatcggcgggcacggctccaagaagtgcacgggggacgccgccttctgcagcgcctacgagtgcaccgcccagtacgcgaacgccttctgctcccacgccaacggcagcgggatcgtgcagatccaggtctccggcgtgtggaagaagccgctgtgcgtgggctacgagcgcgtcgtggtgaagcgggagctcagcgccaagcccatccagcgcgtcgagccctgcacgacctgcatcaccaagtgcgagccccacgggctggtggtgcggtccaccggcttcaagatcagctccgcggtcgcctgcgccagcggggtgtgcgtgaccggctcccagagcccgagcaccgagatcacgctgaagtaccccgggatctcccagagctccggcggcgacatcggggtccacatggcccacgacgaccagagcgtgtccagcaagatcgtggcccactgcccgccccaggacccctgcctcgtccacggctgcatcgtgtgcgcgcacgggctgatcaactaccagtgccacaccgccctgtccgccttcgtggtcgtgttcgtgttcagctccatcgccatcatctgcctcgccatcctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcggctggatggagggcgggcagctcgtcctgggcaacccggcccccatcccccgccacgcgcccatcccgcggtacagcacctacctgatgctgctcctgatcatctcctacgccagcgcctgctccgagctgatccaggccagctcccgcatcacgacctgcagcaccgagggggtgaacaccaagtgccggctctccggcacggcgctgatccgcgccgggagcgtgggcgccgaggcctgcctgatgctcaagggcgtcaaggaggaccagaccaagttcctgaagatcaagaccgtgagctccgagctgagctgccgggaggggcagtcctactggaccggcagcttctcccccaagtgcctcagctcccgccggtgccacctggtgggggagtgccacgtcaaccgctgcctgagctggcgggacaacgagacctccgccgagttcagcttcgtgggcgagtccacgaccatgcgcgagaacaagtgcttcgagcagtgcgggggctggggctgcgggtgcttcaacgtgaaccccagctgcctcttcgtccacacctacctgcagtccgtgcggaaggaggcgctgcgcgtgttcaactgcatcgactgggtccacaagctcaccctggagatcacggacttcgacggcagcgtgtccaccatcgacctgggggccagctccagccggttcaccaactggggctccgtgagcctcagcctggacgccgaggggatctccggcagcaactccttcagcttcatcgagtcccccggcaaggggtacgccatcgtcgacgagccgttcagcgagatcccccgccagggcttcctgggggagatccggtgcaactccgagagctccgtgctcagcgcccacgagtcctgcctgcgcgcgcccaacctgatcagctacaagcccatgatcgaccagctcgagtgcaccacgaacctgatcgacccgttcgtggtcttcgagcggggctccctgccccagacccgcaacgagaagaccttcgccgccagcaaggggaaccgcggcgtgcaggccttctccaagggcagcgtgcaggccgacctcaccctgatgttcgacaacttcgaggtcgacttcgtgggggcggccgtgtcctgcgacgccgccttcctgaacctcacgggctgctacagctgcaacgcgggggcccgggtctgcctgtccatcaccagcaccggcaccggcacgctgagcgcccacaacaaggacgggtccctccacatcgtgctgcccagcgagaacggcaccaaggaccagtgccagatcctgcacttcaccgtccccgaggtggaggaggagttcatgtactcctgcgacggggacgagcgcccgctcctggtgaagggcaccctgatcgccatcgaccccttcgacgaccggcgcgaggccgggggcgagagcacggtcgtgaaccccaagtccggcagctggaacttcttcgactggttctccgggctcatgagctggttcggcgggcccctgaagaccatcctgctcatctgcctgtacgtggcgctgtccatcggcctcttcttcctgctgatctacctcgggcggaccggcctgagcaagatgtggctggccgccaccaagaaggcctcctga

SEQ ID NO: 12793 - RNA, 3594 nt, synthetic construct
  misc_feature 1..3594: note = derived and/or modified CDS sequence (opt1) from RVFV(35/74)__JF784387.1__GP
  source 1..3594: mol_type = other RNA
atgtacgtgctgctcaccatcctgatcaccgtcctggtgtgcgaggccgtgatccgcgtcagcctctccagcacgcgggaggagacctgcttcggcgactacaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcgtgaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgccacgtgcaagccggtcacctacgccggggcgtgcagctccttcgacgtgctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacgcactgccccaacgactaccagtccgcccactacctcaacaacgacgggaagatggccagcgtgaagtgcccgcccaagtacgagctgaccgaggactgcaacttctgccgccagatgaccggcgcctccctgaagaaggggagctaccccctccaggacctgttctgccagtccagcgaggacgacggcagcaagctgaagaccaagatgaagggcgtgtgcgaggtcggggtgcaggccctcaagaagtgcgacggccagctgtccacggcgcacgaggtggtccccttcgccgtgttcaagaacagcaagaaggtgtacctggacaagctcgacctgaagaccgaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcacgggcgacgccgccttctgcagcgcctacgagtgcaccgcgcagtacgccaacgcctactgctcccacgccaacgggagcggcgtggtccagatccaggtgtccggggtgtggaagaagccgctgtgcgtcggctacgagcgcgtggtggtcaagcgggagctcagcgcgaagcccatccagcgcgtggagccctgcacgacctgcatcaccaagtgcgagccccacggcctggtggtccggtccaccgggttcaagatcagctccgccgtggcctgcgccagcggcgtgtgcgtcaccgggtcccagagcccgtccaccgagatcacgctgaagtaccccggcatcagccagagctccgggggcgacatcggcgtgcacatggcccacgacgaccagagcgtgtccagcaagatcgtcgcgcactgcccgccccaggacccctgcctcgtgcacgggtgcatcgtgtgcgcccacggcctgatcaactaccagtgccacaccgccctgtccgccttcgtcgtggtgttcgtcttcagctccgtggccatcatctgcctcgcgatcctgtacaaggtgctgaagtgcctcaagatcgcgccccgcaaggtcctggaccccctgatgtggatcaccgtgttcatccggtgggtgtacaagaagatggtcgcccgcgtggccgacaacatcaaccaggtgaaccgcgagatcgggtggatggagggcggccagctcgccctggggaacccggcccccatcccccggcacgcccccatcccgcgctacagcacctacctgatgctgctcctgatcgtctcctacgccagcgcctgctccgagctgatccaggcgagctcccggatcacgacctgcagcaccgagggcgtgaacaccaagtgccgcctctccgggacggccctgatccgggccggcagcgtgggggccgaggcctgcctgatgctcaagggcgtcaaggaggaccagaccaagttcctgaagatcaagaccgtgtccagcgagctgagctgccgcgagggccagtcctactggaccgggagcttctcccccaagtgcctcagctcccggcgctgccacctggtgggcgagtgccacgtcaaccggtgcctgagctggcgcgacaacgagacctccgcggagttcagcttcgtgggggagtccacgaccatgcgggagaacaagtgcttcgagcagtgcggcgggtggggctgcggctgcttcaacgtgaaccccagctgcctcttcgtccacacctacctgcagtccgtgcgcaaggaggccctgcgggtgttcaactgcatcgactgggtccacaagctcaccctggagatcacggacttcgacgggagcgtgtccaccatcgacctgggcgccagctccagccgcttcaccaactgggggtccgtgagcctctccctggacgccgagggcatcagcgggagcaactccttcagcttcatcgagtcccccggcaagggctacgccatcgtcgacgagccgttcagcgagatcccccggcaggggttcctgggcgagatccgctgcaactccgagagctccgtgctcagcgcgcacgagtcctgcctgcgggcccccaacctgatcagctacaagcccatgatcgaccagctcgagtgcaccacgaacctgatcgacccgttcgtggtcttcgagcgcgggtccctgccccagacccggaacgacaagaccttcgccgccagcaagggcaaccgcggggtgcaggccttctccaagggcagcgtgcaggcggacctcaccctgatgttcgacaacttcgaggtcgacttcgtgggcgccgccgtctcctgcgacgccgcgttcctgaacctcacggggtgctacagctgcaacgccggcgcccgcgtgtgcctgtccatcaccagcaccgggaccggcacgctgtccgcccacaacaaggacggcagcctccacatcgtgctgcccagcgagaacgggaccaaggaccagtgccagatcctgcacttcaccgtccccgaggtggaggaggagttcatgtactcctgcgacggcgacgagcggccgctcctggtgaaggggaccctgatcgccatcgaccccttcgacgaccgccgggaggcgggcggggagagcacggtcgtgaaccccaagtccggcagctggaacttcttcgactggttctccggcctcatgagctggttcgggggccccctgaagaccatcctgctcatctgcctgtacgtggccctgtccatcgggctgttcttcctgctgatctacctcggccgcaccgggctgagcaagatgtggctggccgccaccaagaaggcctcctga

SEQ ID NO: 12794 - RNA, 3594 nt, synthetic construct
  misc_feature 1..3594: note = derived and/or modified CDS sequence (opt1) from RVFV(KEN/Kil-006/07)__HM586966.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcgtggtgcgctgcgagcggcgccgggacgccaagcagatcggccgcgagaccatggcggggatcgccatgaccgtcctgcccgccctggccgtgttcgcgctcgcccccgtggtcttcgccgaggacccccacctccggaaccgccccggcaaggggcacaactacatcgacggcatgacccaggaggacgcgacctgcaagccggtgacgtacgccggggcctgcagctccttcgacgtgctgctggagaagggcaagttccccctgttccagagctacgcccaccaccggaccctgctcgaggccgtccacgacaccatcatcgccaaggccgacccgccctcctgcgacctgcagagcgcggacggcaacaagtgcatgaaggagaagctggtgatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtctgcgaggtgggggtgcaggccctcaagaagtgcgacggccagctgtccaccgcgcacgaggtcgtgcccttcgccgtgttcaagaacagcaagaaggtctacctggacaagctcgacctgaagacggaggagaacctgctccccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtgtggaagaagcccctgtgcgtcggctacgagcgcgtggtggtcaagcgggagctcagcgcgaagccgatccagcgcgtggagccctgcacgacctgcatcaccaagtgcgagccccacggcctggtggtccggtccaccgggttcaagatcagctccgccgtggcctgcgccagcggcgtgtgcgtcaccgggtcccagagccccagcaccgagatcaccctgaagtacccgggcatctcccagagctccgggggcgacatcggcgtgcacatggcccacgacgaccagagcgtgtccagcaagatcgtcgcgcactgcccgccccaggacccctgcctcgtgcacgggtgcatcgtgtgcgcccacggcctgatcaactaccagtgccacacggccctgtccgccttcgtcgtgatcttcgtgttcagctccaccgccatcatctgcctcgcggtcctgtaccgcgtgctgaagtgcctcaagatcgcgccccggaaggtgctgaaccccctgatgtggatcaccgccttcatccgctgggtctacaagaagatggtggcccgcgtggccgacaacatcaaccaggtcaaccgggagatcgggtggatggagggcggccagctcgccctggggaaccccgccccgatcccccgccacgcccccatcccccggtacagcacctacctgatgctgctcctgatcgtgtcctacgccagcgcgtgctccgagctgatccaggccagctcccgcatcacgacctgcagcaccgagggcgtgaacaccaagtgccggctctccgggacggccctgatccgcgccggcagcgtcggggccgaggcgtgcctgatgctcaagggcgtgaaggaggaccagaccaagttcctgaagatcaagaccgtgagctccgagctgagctgccgggagggccagtcctactggaccgggagcttctccccgaagtgcctcagctcccgccggtgccacctggtcggcgagtgccacgtgaaccgctgcctgagctggcgggacaacgagacctccgccgagttcagcttcgtgggggagtccacgaccatgcgcgagaacaagtgcttcgagcagtgcggcgggtggggctgcggctgcttcaacgtcaaccccagctgcctcttcgtgcacacctacctgcagtccgtgcggaaggaggccctgcgcgtcttcaactgcatcgactgggtgcacaagctcaccctggagatcacggacttcgacgggagcgtgtccaccatcgacctgggcgccagctccagccggttcaccaactgggggtccgtcagcctcagcctggacgccgagggcatctccgggagcaactccttcagcttcatcgagtcccccggcaagggctacgcgatcgtggacgagcccttcagcgagatcccgcgccaggggttcctgggcgagatccggtgcaactccgagagctccgtgctcagcgcccacgagtcctgcctgcgcgcccccaacctggtcagctacaagcccatgatcgaccagctcgagtgcaccacgaacctgatcgaccccttcgtggtgttcgagcgggggtccctgccgcagacccgcaacgacaagaccttcgccgccagcaagggcaaccgcggggtccaggcgttctccaagggcagcgtgcaggccgacctcaccctgatgttcgacaacttcgaggtggacttcgtcggcgccgccgtgtcctgcgacgcggccttcctgaacctcacggggtgctacagctgcaacgccggcgcccgggtctgcctgtccatcaccagcaccgggaccggcacgctgagcgcccacaacaaggacggctccctccacatcgtgctgcccagcgagaacgggaccaaggaccagtgccagatcctgcacttcaccgtgcccgaggtcgaggaggagttcatgtactcctgcgacggcgacgagcgccccctcctggtgaaggggaccctgatcgcgatcgacccgttcgacgaccggcgcgaggccggcggggagagcacggtggtcaaccccaagtccggcagctggaacttcttcgactggttctccggcctcatgagctggttcgggggccccctgaagaccatcctgctcatctgcctgtacgtggccctgtccatcggcctcttcttcctgctgatctacctcgggcggaccgggctgagcaagatgtggctggccgccaccaagaaggcgtcctga

SEQ ID NO: 12795 - RNA, 3594 nt, synthetic construct
  misc_feature 1..3594: note = derived and/or modified CDS sequence (opt1) from RVFV(MgH824)__DQ380210.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggtacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggccctcaagaagtgcgacggccagctgtccaccgcgcacgaggtggtgcccttcgccgtcttcaagaacagcaagaaggtgtacctggacaagctcgacctgaagacggaggagaacctgctccccgactccttcgtgtgcttcgagcggaaggggcagtacaagggcaccatggacagcgggcagaccaagcgcgagctgaagtccttcgacatcagccagtgccccaagatcggcggccacgggtccaagaagtgcaccggcgacgccgccttctgcagcgcctacgagtgcacgacccagtacgcgaacgcctactgctcccacgccaacgggagcggcgtcgtgcagatccaggtctccggggtgtggaagaagccgctgtgcgtgggctacgagcgggtcgtggtgaagcgcgagctcagcgccaagcccatccagcgggtcgagccctgcacgacctgcatcaccaagtgcgagccccacggcctggtggtgcgctccaccgggttcaagatcagctccgcggtcgcctgcgccagcggcgtgtgcgtgaccgggtcccagagcccgagcaccgagatcacgctgaagtaccccggcatctcccagagctccgggggcgacatcggcgtccacatggcccacgacgaccagagcgtgtccagcaagatcgtggcccactgcccgccccaggacccctgcctcgtccacgggtgcatcgtgtgcgcgcacggcctgatcaactaccagtgccacaccgccctgtccgccttcgtggtcgtgttcgtgttcagctccatcgccatcatctgcctcgccatcctgtaccgggtcctgaagtgcctcaagatcgcgccccgcaaggtgctgaaccccctgatgtggatcaccgccttcatccgctggatctacaagaagatggtggcccgggtcgccgacaacatcaaccaggtgaaccgcgagatcgggtggatggagggcggccagctcgtgctggggaacccggcccccatcccccggcacgcgcccatcccgcgctacagcacctacctgatgctgctcctgatcgtctcctacgccagcgcctgctccgagctgatccaggccagctcccggatcacgacctgcagcaccgagggcgtggacaccaagtgccgcctctccgggacggcgctgatccgggccggcagcgtgggggccgaggcctgcctgatgctcaagggcgtcaaggaggaccagaccaagttcctgaagatcaagaccgtgagctccgagctgagctgccgcgagggccagtcctactggaccgggagcttctcccccaagtgcctcagctcccggcgctgccacctggtgggcgagtgccacgtcaaccggtgcctgagctggcgcgacaacgagacctccgccgagttcagcttcgtgggggagtccacgaccatgcgggagaacaagtgcttcgagcagtgcggcgggtggggctgcggctgcttcaacgtgaaccccagctgcctcttcgtccacacctacctgcagtccgtgcgcaaggaggcgctgcgggtgttcaactgcatcgactgggtccacaagctcaccctggagatcacggacttcgacgggagcgtgtccaccatcgacctgggcgccagctccagccgcttcaccaactgggggtccgtgagcctcagcctggacgccgagggcatctccgggagcaactccttcagcttcatcgagtcccccggcaagggctacgccatcgtcgacgagccgttccccgagatcccccggcaggggttcctgggcgagatccgctgcaacagcgagtccagcgtgctctccgcccacgagagctgcctgcgggcgcccaacctgatctcctacaagccgatgatcgaccagctcgagtgcaccacgaacctgatcgaccccttcgtggtcttcgagcgcgggagcctgccccagacccgcaacgacaagaccttcgccgcctccaagggcaaccgcggggtgcaggccttcagcaagggctccgtgcaggccgacctcaccctgatgttcgacaacttcgaggtcgacttcgtgggcgcggccgtgagctgcgacgccgccttcctgaacctcacggggtgctactcctgcaacgcgggcgcccgggtctgcctgagcatcacctccaccgggaccggcagcctgagcgcccacaacaaggacggctccctccacatcgtgctgcccagcgagaacgggacgaaggaccagtgccagatcctgcacttcaccgtcccggaggtggaggaggagttcatgtactcctgcgacggcgacgagcggcccctcctggtgaaggggaccctgatcgccatcgaccccttcgacgaccgccgggaggccggcggggagagcaccgtcgtgaaccccaagtccggcagctggaacttcttcgactggttctccggcctcatgagctggttcgggggcccgctgaagacgatcctgctcatctgcctgtacgtggcgctgtccatcgggctgttcttcctgctgatctacctcggccgcaccgggctgagcaagatgtggctggccgccaccaagaaggcctcctga

SEQ ID NO: 12796 - RNA, 3594 nt, synthetic construct
  misc_feature 1..3594: note = derived and/or modified CDS sequence (opt1) from RVFV(Kenya 57 (Rintoul))__DQ380192.1__GP
  source 1..3594: mol_type = other RNA
atgtacgccctgctcaccatcctgatcagcgtgctggtctgcgaggccgtgatccgcgtgtccctcagctccacccgggaggagacgtgcttcggcgacagcaccaaccccgagatgatcgagggggcgtgggactccctgcgcgaggaggagatgccggaggagctgagctgctccatcagcggcatccgggaggtcaagacctccagccaggagctccaccgcgccctgaaggccatcatcgccgccgacgggctgaacaacatcacgtgccacggcaaggaccccgaggacaagatctccctcatcaaggggccgccccacaagaagcgggtgggcgtggtccgctgcgagcggcgccgggacgcgaagcagatcggccgcgagaccatggccgggatcgccatgaccgtgctgcccgccctggcggtgttcgccctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctcgagaagggcaagttccccctgttccagagctacgcccaccaccggaccctgctcgaggccgtgcacgacaccatcatcgccaaggcggacccgccctcctgcgacctgcagagcgcccacggcaacccctgcatgaaggagaagctggtgatgaagacccactgccccaacgactaccagtccgcccactacctcaacaacgacgggaagatggccagcgtcaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtgggggtccaggcgctcaagaagtgcgacggccagctgtccaccgcccacgaggtggtgcccttcgccgtcttcaagaacagcaagaaggtgtacctggacaagctcgacctgaagacggaggagaacctgctccccgactccttcgtgtgcttcgagcacaaggggcagtacaagggcaccatggacagcgggcagatcaagcgggagctgaagtccttcgacatcagccagtgccccaagatcggcggccacgggtccaagaagtgcaccggcgacgccgccttctgcagcgcgtacgagtgcaccgcccagtacgccaacgcctactgctcccacgcgaacgggagcggcatcgtccagatccaggtgtccggggtctggaagaagccgctgtgcgtgggctacgagcgcgtggtcgtgaagcgggagctcagcgccaagcccatccagcgcgtggagccctgcacgacctgcatcaccaagtgcgagccccacggcctggtcgtgcggtccaccgggttcaagatcagctccgccgtggcctgcgccagcggcgtctgcgtgacggggtcccagagcccgagcaccgagatcaccctgaagtaccccggcatctcccagagctccgggggcgacatcggcgtgcacatggcgcacgacgaccagagcgtctccagcaagatcgtggcccactgcccgccccaggacccctgcctcgtgcacgggtgcatcgtctgcgcccacggcctgatcaactaccagtgccacaccgccctgtccgccttcgtggtggtcttcgtgttcagctccgtggcgatcatctgcctcgccatcctgtacaaggtcctgaagtgcctcaagatcgcgccccgcaaggtgctgaaccccctgatgtggatcacggccttcatccggtgggtgtacaagaagatggtcgcccgcgtggccgacaacatcaaccaggtgaaccgcgagatcgggtggatggagggcggccagctcgtcctggggaacccggcccccatcccccggcacgcccccatcccgcgctacagcacctacctgatgctgctcctgatcgtgtcctacgccagcgcgtgctccgagctgatccaggccagctcccggatcacgacctgcagcaccgagggcgtgaacaccaagtgccgcctctccgggaccgccctgatccgggccggcagcgtcggggccgaggcgtgcctgatgctcaagggcgtgaaggaggaccagaccaagttcctgaagatcaagacggtgagctccgagctgagctgccgcgagggccagtcctactggaccgggagcttctcccccaagtgcctcagctcccggcgctgccacctggtcggcgagtgccacgtgaaccggtgcctgagctggcgcgacaacgagacctccgccgagttcagcttcgtgggggagtccaccaccatgcgggagaacaagtgcttcgagcagtgcggcgggtggggctgcggctgcttcaacgtcaaccccagctgcctcttcgtgcacacgtacctgcagtccgtgcgcaaggaggccctgcgggtcttcaactgcatcgactgggtgcacaagctcaccctggagatcaccgacttcgacgggagcgtgtccaccgtcgacctgggcgccagctccagccgcttcacgaactgggggtccgtgagcctcagcctggacgccgagggcatctccgggagcaactccttcagcttcatcgagtcccccggcaagggctacgcgatcgtggacgagccgttcagcgagatctcccggcaggggttcctgggcgagatccgctgcaacagcgagtccagcgtcctctccgcccacgagagctgcctgcgggcccccaacctgatctcctacaagcccatgatcgaccagctcgagtgcaccaccaacctgatcgaccccttcgtggtgttcgagcgcgggagcctgccgcagacccggaacgacaagacgttcgccgcctccaagggcaaccgcggggtccaggcgttcagcaagggctccgtgcaggccgacctcaccctgatgttcgacaacttcgaggtggacttcgtcggcgccgccgtgagctgcgacgcggccttcctgaacctcaccgggtgctactcctgcaacgccggcgcccgcgtctgcctgagcatcaccagcacggggaccggcaccctgtccgcccacaacaaggacggcagcctccacatcgtgctgccctccgagaacgggaccaaggaccagtgccagatcctgcacttcacggtgcccgaggtcgaggaggagttcatgtacagctgcgacggcgacgagcggcccctcctggtgaaggggaccctgatcgcgatcgacccgttcgacgaccgccgggaggccggcggggagtccaccgtggtcaaccccaagagcggctcctggaacttcttcgactggttcagcggcctcatgtcctggttcgggggccccctgaagaccatcctgctcatctgcctgtacgtggccctgagcatcgggctgttcttcctgctgatctacctcggccgcacggggctgtccaagatgtggctggccgccaccaagaaggcgagctga

SEQ ID NO: 12797 - RNA, 3594 nt, synthetic construct
  misc_feature 1..3594: note = derived and/or modified CDS sequence (opt1) from RVFV(SA-75)__DQ380189.1__GP
  source 1..3594: mol_type = other RNA
atgtacgtgctgctcaccatcctgatcaccgtcctggtgtgcgaggccgtgatccgcgtcagcctctccagcacgcgggaggagacctgcttcggcgactacaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcgtgaaggggccgccccacaagaagcgggtcggcatcgtgcgctgcgagcggcgccgggacgccaagcagatcggccgcgagaccatggcgcggatcgccatgaccgtgctgcccgccctggccgtcttcgcgctcgcccccgtggtgttcgccgaggacccccacctccgcaaccggcccgggaagggccacaactacatcgacgggatgacccaggaggacgccacgtgcaagccggtcacctacgccggcgcgtgcagctccttcgacgtgctgctggagaaggggaagttccccctgttccagagctacgcccaccaccgcaccctgctcgaggccgtgcacgacaccatcatcgccaaggccgacccgccctcctgcgacctgcagagcgcgcacggcaacccctgcatgaaggagaagctggtcatgaagacgcactgccccaacgactaccagtccgcccactacctcaacaacgacggcaagatggccagcgtgaagtgcccgcccaagtacgagctgaccgaggactgcaacttctgccggcagatgaccggggcctccctgaagaagggcagctaccccctccaggacctgttctgccagtccagcgaggacgacgggagcaagctgaagaccaagatgaagggcgtgtgcgaggtcggcgtgcaggccctcaagaagtgcgacgggcagctgtccacggcgcacgaggtggtccccttcgccgtgttcaagaacagcaagaaggtgtacctggacaagctcgacctgaagaccgaggagaacctgctccccgactccttcgtctgcttcgagcacaagggccagtacaaggggaccatggacagcggccagaccaagcgcgagctgaagtccttcgacatcagccagtgccccaagatcgggggccacggctccaagaagtgcacgggggacgccgccttctgcagcgcctacgagtgcaccgcgcagtacgccaacgcctactgctcccacgccaacggcagcggggtggtccagatccaggtgtccggcgtgtggaagaagccgctgtgcgtcgggtacgagcgggtggtggtcaagcgcgagctcagcgcgaagcccatccagcgggtggagccctgcacgacctgcatcaccaagtgcgagccccacggcctggtggtccgctccaccggcttcaagatcagctccgccgtggcctgcgccagcggggtgtgcgtcaccggctcccagagcccgtccaccgagatcacgctgaagtaccccgggatcagccagagctccggcggggacatcggcgtgcacatggcccacgacgaccagagcgtgtccagcaagatcgtcgcgcactgcccgccccaggacccctgcctcgtgcacggctgcatcgtgtgcgcccacgggctgatcaactaccagtgccacaccgccctgtccgccttcgtcgtggtgttcgtcttcagctccgtggccatcatctgcctcgcgatcctgtacaaggtgctgaagtgcctcaagatcgcgccccggaaggtcctgaaccccctgatgtggatcaccgtgttcatccgctgggtgtacaagaagatggtcgcccgcgtggccgacaacatcaaccaggtgaaccgggagatcggctggatggagggcgggcagctcgccctgggcaacccggcgcccatcccccgccacgcccccatcccgcggtacagcacctacctgatgctgctcctgatcgtctcctacgccagcgcctgctccgagctgatccaggcgagctcccgcatcacgacctgcagcaccgagggggtgaacaccaagtgccggctctccggcacggccctgatccgcgccgggagcgtgggcgccgaggcctgcctgatgctcaagggggtcaaggaggaccagaccaagttcctgaagatcaagaccgtgtccagcgagctgagctgccgggagggccagtcctactggaccggcagcttctcccccaagtgcctcagctcccgccggtgccacctggtgggggagtgccacgtcaaccgctgcctgagctggcgggacaacgagacctccgcggagttcagcttcgtgggcgagtccacgaccatgcgcgagaacaagtgcttcgagcagtgcgggggctgggggtgcggctgcttcaacgtgaaccccagctgcctcttcgtccacacctacctgcagtccgtgcggaaggaggccctgcgcgtgttcaactgcatcgactgggtccacaagctcaccctggagatcacggacttcgacggcagcgtgtccaccatcgacctgggggccagctccagccggttcaccaactggggctccgtgagcctctccctggacgccgaggggatcagcggcagcaactccttcagcttcatcgagtcccccgggaagggctacgccatcgtcgacgagccgttcagcgagatcccccgccagggcttcctgggggagatccggtgcaactccgagagctccgtgctcagcgcgcacgagtcctgcctgcgcgcccccaacctgatcagctacaagcccatgatcgaccagctcgagtgcaccacgaacctgatcgacccgttcgtggtcttcgagcggggctccctgccccagacccgcaacgacaagaccttcgccgccagcaaggggaaccgcggcgtgcaggccttctccaaggggagcgtgcaggcggacctcaccctgatgttcgacaacttcgaggtcgacttcgtgggcgccgccgtctcctgcgacgccgcgttcctgaacctcacgggctgctacagctgcaacgccggggcccgggtgtgcctgtccatcaccagcaccggcaccgggacgctgtccgcccacaacaaggacggcagcctccacatcgtgctgcccagcgagaacggcaccaaggaccagtgccagatcctgcacttcaccgtccccgaggtggaggaggagttcatgtactcctgcgacggggacgagcgcccgctcctggtgaagggcaccctgatcgccatcgaccccttcgacgaccggcgcgaggccgggggcgagagcacggtcgtgaaccccaagtccgggagctggaacttcttcgactggttctccggcctcatgagctggttcggcgggcccctgaagaccatcctgctcatctgcctgtacgtggccctgtccatcggcctcttcttcctgctgatctacctcgggcggaccggcctgagcaagatgtggctggccgccaccaagaaggcctcctga

SEQ ID NO: 12798 - RNA, 3594 nt, synthetic construct
  misc_feature 1..3594: note = derived and/or modified CDS sequence (opt1) from RVFV(SA01-1322)__KX096942.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcggccggcgccgggacaccaagcagatcgggcgcgagaccatggccggcatcgcgatgaccgtgctgcccgccctggccgtcttcgccctcgcgcccgtggtgttcgccgaggacccccacctccggaaccgccccgggaagggccacaactacatcgacgggatgacccaggaggacgccacgtgcaagccggtcacctacgccggcgcctgcagctccttcgacgtgctgctggagaagggcaagttccccctgttccagagctacgcgcaccaccggaccctgctcgaggccgtgcacgacaccatcatcgccaaggccgacccgccctcctgcgacctgcagagcgcccacgggaacccctgcatgaaggagaagctggtcatgaagacgcactgccccaacgactaccagtccgcgcactacctcaacaacgacggcaagatggccagcgtgaagtgcccgcccaagtacgagctgaccgaggactgcaacttctgccgccagatgaccggggcctccctgaagaagggcagctaccccctccaggacctgttctgccagagctccgaggacgacggcagcaagctgaagaccaagatgaagggggtgtgcgaggtcggcgtgcaggccctcaagaagtgcgacgggcagctgtccacggcccacgaggtggtccccttcgcggtgttcaagaacagcaagaaggtgtacctggacaagctcgacctgaagaccgaggagaacctgctccccgactccttcgtctgcttcgagcacaagggccagtacaaggggaccatggacagcggccagaccaagcgggagctgaagtccttcgacatcagccagtgccccaagatcggcgggcacggctccaagaagtgcacgggggacgccgccttctgcagcgcctacgagtgcaccgcccagtacgcgaacgccttctgctcccacgccaacggcagcgggatcgtgcagatccaggtctccggcgtgtggaagaagccgctgtgcgtgggctacgagcgcgtcgtggtgaagcgggagctcagcgccaagcccatccagcgcgtcgagccctgcacgacctgcatcaccaagtgcgagccccacgggctggtggtgcggtccaccggcttcaagatcagctccgcggtcgcctgcgccagcggggtgtgcgtgaccggctcccagagcccgagcaccgagatcacgctgaagtaccccgggatctcccagagctccggcggcgacatcggggtccacatggcccacgacgaccagagcgtgtccagcaagatcgtggcccactgcccgccccaggacccctgcctcgtccacggctgcatcgtgtgcgcgcacgggctgatcaactaccagtgccacaccgccctgtccgccttcgtggtcgtgttcgtgttcagctccatcgccatcatctgcctcgccatcctgtaccgcgtcctgaagtgcctcaagatcgcgccccggaaggtgctgaaccccctgatgtggatcaccgccttcatccgctgggtgtacaagaagatggtcgcccgcgtggccgacaacatcaaccaggtgaaccgggagatcggctggatggagggcgggcagctcgtcctgggcgacccggcccccatcccccgccacgcgcccatcccgcggtacagcacctacctgatgctgctcctgatcatctcctacgccagcgcctgctccgagctgatccaggccagctcccgcatcacgacctgcagcaccgagggggtgaacaccaagtgccggctctccggcacggcgctgatccgcgccgggagcgtgggcgccgaggcctgcctgatgctcaagggcgtcaaggaggaccagaccaagttcctgaagatcaagaccgtgagctccgagctgagctgccgggaggggcagtcctactggaccggcagcttctcccccaagtgcctcagctcccgccggtgccacctggtgggggagtgccacgtcaaccgctgcctgagctggcgggacaacgagacctccgccgagttcagcttcgtgggcgagtccacgaccatgcgcgagaacaagtgcttcgagcagtgcgggggctggggctgcgggtgcttcaacgtgaaccccagctgcctcttcgtccacacctacctgcagtccgtgcggaaggaggcgctgcgcgtgttcaactgcatcgactgggtccacaagctcaccctggagatcacggacttcgacggcagcgtgtccaccatcgacctgggggccagctccagccggttcaccaactggggctccgtgagcctcagcctggacgccgaggggatctccggcagcaactccttcagcttcatcgagtcccccggcaaggggtacgccatcgtcgacgagccgttcagcgagatcccccgccagggcttcctgggggagatccggtgcaactccgagagctccgtgctcagcgcccacgagtcctgcctgcgcgcgcccaacctgatcagctacaagcccatgatcgaccagctcgagtgcaccacgaacctgatcgacccgttcgtggtcttcgagcggggctccctgccccagacccgcaacgagaagaccttcgccgccagcaaggggaaccgcggcgtgcaggccttctccaagggcagcgtgcaggccgacctcaccctgatgttcgacaacttcgaggtcgacttcgtgggggcggccgtgtcctgcgacgccgccttcctgaacctcacgggctgctacagctgcaacgcgggggcccgggtctgcctgtccatcaccagcaccggcaccggcacgctgagcgcccacaacaaggacgggtccctccacatcgtgctgcccagcgagaacggcaccaaggaccagtgccagatcctgcacttcaccgtccccgaggtggaggaggagttcatgtactcctgcgacggggacgagcgcccgctcctggtgaagggcaccctgatcgccatcgaccccttcgacgaccggcgcgaggccgggggcgagagcacggtcgtgaaccccaagtccggcagctggaacttcttcgactggttctccgggctcatgagctggttcggcgggcccctgaagaccatcctgctcatctgcctgtacgtggcgctgtccatcggcctcttcttcctgctgatctacctcgggcggaccggcctgagcaagatgtggctggccgccaccaagaaggcctcctga

SEQ ID NO: 12799 - RNA, 3594 nt, synthetic construct
  misc_feature 1..3594: note = derived and/or modified CDS sequence (opt1) from RVFV(KEN/Mal-032/07)__HM586967.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggccggctgcaggaggacgcgacctgcaagccggtcacctacgccggggcctgcagctccttcgacgtgctgctggagaagggcaagttccccctgttccagagctacgcccaccaccgcacgctcctggaggccgtgcacgacaccatcatcgccaaggccgacccgccctcctgcgacctgcagagcgcggacggcaacaagtgcatgaaggagaagctcgtcatgaagacccactgccccaacgactaccagtccgcccactacctgaacaacgacgggaagatggccagcgtgaagtgcccgcccaagtacgagctgaccgaggactgcaacttctgccggcagatgacgggcgcctccctcaagaaggggagctaccccctgcaggacctgttctgccagagctccgaggacgacggcagcaagctcaagaccaagatgaagggcgtgtgcgaggtcggggtgcaggccctgaagaagtgcgacggccagctgtccaccgcgcacgaggtggtccccttcgccgtgttcaagaacagcaagaaggtgtacctcgacaagctggacctgaagaccgaggagaacctcctgcccgactccttcgtctgcttcgagcacaaggggcagtacaagggcacgatggacagcgggcagaccaagcgcgagctgaagtccttcgacatcagccagtgccccaagatcggcggccacgggtccaagaagtgcaccggcgacgccgccttctgcagcgcctacgagtgcaccgcgcagtacgccaacgcctactgctcccacgccaacgggagcggcatcgtgcagatccaggtctccggggtgtggaagaagcccctctgcgtgggctacgagcgggtcgtggtgaagcgcgagctgagcgcgaagccgatccagcgggtcgagccctgcacgacctgcatcaccaagtgcgagccccacggcctggtggtgcgctccaccgggttcaagatcagctccgccgtcgcctgcgccagcggcgtgtgcgtgacggggtcccagagccccagcaccgagatcaccctcaagtacccgggcatctcccagagctccgggggcgacatcggcgtccacatggcccacgacgaccagagcgtgtccagcaagatcgtggcgcactgcccgccccaggacccctgcctggtccacgggtgcatcgtgtgcgcccacggcctgatcaactaccagtgccacaccgccctctccgccttcgtggtcatcttcgtgttcagctccacggccatcatctgcctggcggtgctgtaccgggtcctcaagtgcctgaagatcgcgccccgcaaggtgctgaaccccctcatgtggatcaccgccttcatccgctgggtgtacaagaagatggtcgcccgggtggccgacaacatcaaccaggtgaaccgcgagatcgggtggatggagggcggccagctggccctggggaaccccgccccgatcccccggcacgcccccatcccccgctacagcacctacctgatgctcctgctgatcgtctcctacgccagcgcgtgctccgagctcatccaggccagctcccggatcaccacgtgcagcaccgagggcgtgaacaccaagtgccgcctgtccgggaccgccctgatccgggccggcagcgtgggggccgaggcgtgcctcatgctgaagggcgtcaaggaggaccagacgaagttcctgaagatcaagaccgtgagctccgagctcagctgccgcgagggccagtcctactggaccgggagcttctccccgaagtgcctgagctcccggcgctgccacctggtgggcgagtgccacgtcaaccggtgcctcagctggcgcgacaacgagacctccgccgagttcagcttcgtgggggagtccaccacgatgcgggagaacaagtgcttcgagcagtgcggcgggtggggctgcggctgcttcaacgtgaaccccagctgcctgttcgtccacacctacctgcagtccgtgcgcaaggaggccctccgggtgttcaactgcatcgactgggtccacaagctgaccctggagatcaccgacttcgacgggagcgtgtccacgatcgacctcggcgccagctccagccgcttcaccaactgggggtccgtgagcctgagcctggacgccgagggcatctccgggagcaactccttcagcttcatcgagtcccccggcaagggctacgcgatcgtcgacgagcccttcagcgagatcccgcggcaggggttcctcggcgagatccgctgcaactccgagagctccgtgctgagcgcccacgagtcctgcctgcgggcccccaacctcgtgagctacaagcccatgatcgaccagctggagtgcaccaccaacctgatcgaccccttcgtcgtgttcgagcgcgggtccctcccgcagacgcgcaacgacaagaccttcgccgccagcaagggcaaccgcggggtgcaggcgttctccaagggcagcgtccaggccgacctgaccctgatgttcgacaacttcgaggtggacttcgtgggcgccgccgtctcctgcgacgcggccttcctcaacctgaccgggtgctacagctgcaacgccggcgcccgggtgtgcctgtccatcacgagcaccgggaccggcaccctcagcgcccacaacaaggacggctccctgcacatcgtcctgcccagcgagaacgggacgaaggaccagtgccagatcctccacttcaccgtgcccgaggtggaggaggagttcatgtactcctgcgacggcgacgagcggcccctgctggtcaaggggaccctcatcgcgatcgacccgttcgacgaccgccgggaggccggcggggagagcaccgtggtgaaccccaagtccggcagctggaacttcttcgactggttctccggcctgatgagctggttcgggggccccctgaagacgatcctcctgatctgcctgtacgtcgccctctccatcgggctgttcttcctgctcatctacctgggccgcaccgggctgagcaagatgtggctcgccgccaccaagaaggcgtcctga

SEQ ID NO: 12800 - RNA, 3594 nt, synthetic construct
  misc_feature 1..3594: note = derived and/or modified CDS sequence (opt1) from RVFV(KEN/Gar-008/06)__HM586965.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctggagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtgcagatccaggtctcccgcgtgtggaagaagccgctgtgcgtggggtacgagcgggtcgtggtgaagcgcgagctcagcgcgaagcccatccagcgggtcgagccctgcacgacctgcatcaccaagtgcgagccccacggcctggtggtgcgctccaccggcttcaagatcagctccgccgtcgcctgcgccagcggggtgtgcgtgaccggctcccagagcccgagcaccgagatcaccctgaagtaccccgggatctcccagagctccggcggggacatcggcgtccacatggcccacgacgaccagagcgtgtccagcaagatcgtggcgcactgcccgccccaggacccctgcctcgtccacggctgcatcgtgtgcgcccacgggctgatcaactaccagtgccacacggccctgtccgccttcgtggtcatcttcgtgttcagctccaccgccatcatctgcctcgcggtgctgtaccgggtcctgaagtgcctcaagatcgcgccccgcaaggtgctgaaccccctgatgtggatcaccgccttcatccgctgggtgtacaagaagatggtcgcccgggtggccgacaacatcaaccaggtgaaccgcgagatcggctggatggagggcgggcagctcgccctgggcaacccggcccccatcccccggcacgcccccatcccgcgctacagcacctacctgatgctgctcctgatcgtctcctacgccagcgcgtgctccgagctgatccaggccagctcccggatcacgacctgcagcaccgagggggtgaacaccaagtgccgcctctccggcacggccctgatccgggccgggagcgtgggcgccgaggcgtgcctgatgctcaagggggtcaaggaggaccagaccaagttcctgaagatcaagaccgtgagctccgagctgagctgccgcgagggccagtcctactggaccggcagcttctcccccaagtgcctcagctcccggcgctgccacctggtgggggagtgccacgtcaaccggtgcctgagctggcgcgacaacgagacctccgccgagttcagcttcgtgggcgagtccacgaccatgcgggagaacaagtgcttcgagcagtgcgggggctgggggtgcggctgcttcaacgtgaaccccagctgcctcttcgtccacacctacctgcagtccgtgcgcaaggaggccctgcgggtgttcaactgcatcgactgggtccacaagctcaccctggagatcacggacttcgacggcagcgtgtccaccatcgacctgggggccagctccagccgcttcaccaactggggctccgtgagcctcagcctggacgccgaggggatctccggcagcaactccttcagcttcatcgagtcccccgggaagggctacgcgatcgtcgacgagccgttcagcgagatcccccggcagggcttcctgggggagatccgctgcaactccgagagctccgtgctcagcgcccacgagtcctgcctgcgggcccccaacctggtgagctacaagcccatgatcgaccagctcgagtgcaccacgaacctgatcgacccgttcgtcgtgttcgagcgcggctccctgccccagacccgcaacgacaagaccttcgccgccagcaaggggaaccggggcgtgcaggcgttctccaaggggagcgtccaggccgacctcaccctgatgttcgacaacctgaaggtggacttcgtgggcgccgccgtctcctgcgacgcggccttcctcaacctgacgggctgctacagctgcaacgccggggcccgcgtgtgcctgtccatcaccagcaccggcaccgggacgctcagcgcccacaacaaggacggctccctgcacatcgtcctgcccagcgagaacggcaccaaggaccagtgccagatcctccacttcaccgtgcccgaggtgaaggaggagttcatgtactcctgcgacggggacgagcgggcgctgctgatgaagggcaccctcatcgccatcgacccgttcgacgaccgccgggaggccgggggcgagagcacggtcgtgaaccccaagtccgggagctggaacttcttcgactggttctccggcctgatgagctggttcggcgggcccctgaagaccatcctcctgatctgcctgtacgtggccctctccatcggcctgttcttcctgctcatctacctggggcgcaccggcctgagcaagatgtggctcgccgcgaccaagaaggcctcctga

SEQ ID NO: 12801 - RNA, 3594 nt, synthetic construct
  misc_feature 1..3594: note = derived and/or modified CDS sequence (opt1) from RVFV(Kenya 56 (IB8))__DQ380190.1__GP
  source 1..3594: mol_type = other RNA
atgtacgtgctgctcaccatcctgatcaccgtcctggtgtgcgaggccgtgatccgcgtcagcctctccagcacgcgggaggagacctgcttcggcgactccaccagccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcaggtcggcatcgtgcggtgcgagcgccggcgcgacgccaagcagatcggccgggagaccatggcggggatcgccatgaccgtgctgcccgccctggccgtgttcgcgctcgcccccgtcgtgttcgccgaggacccccacctccgcaaccggcccggcaaggggcacaactacatcgacggcatgacccagggggacgccacgtgcaagccggtgacctacgccggcgcgtgcagctccttcgacgtcctgctggagaagggcaagttccccctgttccagagctacgcccaccaccgcaccctgctcgaggccgtgcacgacaccatcatcgccaaggccgacccgccctcctgcgacctgcagagcgcgcacgggaacccctgcatgaaggagaagctggtgatgaagacgcactgccccaaggactaccagtccgcccactacctcaacaacgacggcaagatggccagcgtcaagtgcccgcccaagtacgagctgaccgaggactgcaacttctgccggcagatgaccggggcctccctgaagaagggcagctaccccctccaggacctgttctgccagagctccgaggacgacggcagcaagctgaagaccaagatgaagggggtgtgcgaggtgggcgtccaggccctcaagaagtgcgacgggcagctgtccacggcgcacgaggtggtgcccttcgccgtcttcaagaacagcaagaaggtgtacctggacaagctcgacctgaagaccgaggagaacctgctccccgactccttcgtgtgcttcgagcacaagggccagtacaaggggaccatggacagcggccagaccaagcgcgagctgaagtccttcgacatcagccagtgccccaagatcggcgggcacggctccaagaagtgcacgggggacgccgccttctgcagcgcctacgagtgcaccgcgcagtacgccaacgcctactgctcccacgccaacggcagcgggatcgtccagatccaggtgtccggcgtctggaagcggccgctgtgcgtgggctacgagcgcgtggtcgtgaagcgggagctcagcgcgaagcccatccagcgcgtggagccctgcacgacctgcatcaccaagtgcgagccccacgggctggtcgtgcggtccaccggcttcaagatcagctccgccgtggcctgcgccagcggggtctgcgtgaccggctcccagagcccgagcaccgagatcacgctgaagtaccccgggatgtcccagagctccggcggcgacatcggggtgcacatggcccacgacgaccagagcgtctccagcaagatcgtggcgcactgcccgccccaggacccctgcctcgtgcacggctgcatcgtctgcgcccacgggctgatcaactaccagtgccacaccgccctgtccgccttcgtggtggtcttcgtgttcagctccgtggccatcatctgcctcgcgatcctgtacaaggtcctgaagtgcctcaagatcgcgccccgcaaggtgctgaaccccctgatgtggatcaccgccttcatccggtgggtgtacaagaagatggtcgcccgcgtggccgacaacatcaaccaggtgaaccgcgagatcggctggatggagggcgggcagccggccctcggcaaccccgcccccatcccccggcacgccccgatcccccgctacagcacctacctgatgctgctgctcatcgtctcctacgccagcgcgtgctccgagctgatccaggccagctcccggatcacgacctgcagcaccgagggggtgaacaccaagtgccgcctgtccggcacggccctcatccgggccgggagcgtgggcgccgaggcgtgcctgatgctgaagggcgtcaaggaggaccagaccaagttcctcaagatcaagaccgtgagctccgagctgagctgccgcgaggggcagtcctactggaccggcagcttctcccccaagtgcctgagctcccggcgctgccacctcgtgggggagtgccacgtcaaccggtgcctgagctggcgcgacaacgagacctccgccgagttcagcttcgtgggcgagtccacgaccatgcgggagaacaagtgcttcgagcagtgcgggggctggggctgcgggtgcttcaacgtgaaccccagctgcctgttcgtccacacctacctccagtccgtgcgcaaggaggccctgcgggtgttcaactgcatcgactgggtccacaagctgaccctcgagatcacggacttcgacggcagcgtgtccaccatcgacctgggggccagctccagccgcttcaccaactggggctccgtgagcctgagcctcgacgccgaggggatctccggcagcaactccttcagcttcatcgagtccccgggcaaggggtacgcgatcgtcgacgagcccttcagcgagatcccccggcagggcttcctgggggagatccgctgcaactccgagagctccgtgctgagcgcccacgagtcctgcctccgggcccccaacctgatcagctacaagccgatgatcgaccagctggagtgcaccacgaacctcatcgaccccttcgtggccttcgagcgcggctccctgccccagacccggaacgacaagaccttcgccgcgagcaaggggaaccgcggcgtccaggccttctccaagggcagcgtgcaggccgacctgaccctcatgttcgacaacttcgaggtggacttcgtcggggccgcggtgtcctgcgacgccgccttcctgaacctgacgggctgctacagctgcaacgccggggcccgcgtgtgcctctccatcaccagcaccggcaccggcacgctgagcgcgcacaacaaggacgggtccctgcacatcgtcctccccagcgagaacggcaccaaggaccagtgccagatcctgcacttcaccgtgccggaggtcgaggaggagttcatgtactcctgcgacggggacgagcggcccctgctcgtgaagggcaccctgatcgccatcgaccccttcgacgaccgccgggaggccgggggcgagagcacggtggtcaaccccaagtccggcagctggaacttcttcgactggttctccgggctgatgagctggttcggcgggccgctcaagaccatcctgctgatctgcctctacgtggccctgtccatcggcctgttcttcctcctgatctacctggggcgcaccggcctcagcaagatgtggctggccgcgaccaagaaggcctcctga

SEQ ID NO: 12802 - RNA, 3594 nt, synthetic construct
  misc_feature 1..3594: note = derived and/or modified CDS sequence (opt1) from RVFV(KEN/Bar-035/07)__HM586969.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggccggctgcaggaggacgcgacctgcaagccggtcacctacgccggggcctgcagctccttcgacgtgctgctggagaagggcaagttccccctgttccagagctacgcccaccaccgcacgctcctggaggccgtgcacgacaccatcatcgccaaggccgacccgccctcctgcgacctgcagagcgcggacggcaacaagtgcatgaaggagaagctcgtcatgaagacccactgccccaacgactaccagtccgcccactacctgaacaacgacgggaagatggccagcgtgaagtgcccgcccaagtacgagctgaccgaggactgcaacttctgccggcagatgacgggcgcctccctcaagaaggggagctaccccctgcaggacctgttctgccagagctccgaggacgacggcagcaagctcaagaccaagatgaagggcgtgtgcgaggtcggggtgcaggccctgaagaagtgcgacggccagctgtccaccgcgcacgaggtggtccccttcgccgtgttcaagaacagcaagaaggtgtacctcgacaagctggacctgaagaccgaggagaacctcctgcccgactccttcgtctgcttcgagcacaaggggcagtacaagggcacgatggacagcgggcagaccaagcgcgagctgaagtccttcgacatcagccagtgccccaagatcggcggccacgggtccaagaagtgcaccggcgacgccgccttctgcagcgcctacgagtgcaccgcgcagtacgccaacgcctactgctcccacgccaacgggagcggcatcgtgcagatccaggtctccggggtgtggaagaagcccctctgcgtgggctacgagcgggtcgtggtgaagcgcgagctgagcgcgaagccgatccagcgggtcgagccctgcacgacctgcatcaccaagtgcgagccccacggcctggtggtgcgctccaccgggttcaagatcagctccgccgtcgcctgcgccagcggcgtgtgcgtgacggggtcccagagccccagcaccgagatcaccctcaagtacccgggcatctcccagagctccgggggcgacatcggcgtccacatggcccacgacgaccagagcgtgtccagcaagatcgtggcgcactgcccgccccaggacccctgcctggtccacgggtgcatcgtgtgcgcccacggcctgatcaactaccagtgccacaccgccctctccgccttcgtggtcatcttcgtgttcagctccacggccatcatctgcctggcggtgctgtaccgggtcctcaagtgcctgaagatcgcgccccgcaaggtgctgaaccccctcatgtggatcaccgccttcatccgctgggtgtacaagaagatggtcgcccgggtggccgacaacatcaaccaggtgaaccgcgagatcgggtggatggagggcggccagctggccctggggaaccccgccccgatcccccggcacgcccccatcccccgctacagcacctacctgatgctcctgctgatcgtctcctacgccagcgcgtgctccgagctcatccaggccagctcccggatcaccacgtgcagcaccgagggcgtgaacaccaagtgccgcctgtccgggaccgccctgatccgggcccgcagcgtgggcgccgaggcgtgcctcatgctgaagggggtcaaggaggaccagacgaagttcctgaagatcaagaccgtgagctccgagctcagctgccgggagggccagtcctactggaccggcagcttctccccgaagtgcctgagctcccgccggtgccacctggtgggggagtgccacgtcaaccgctgcctcagctggcgggacaacgagacctccgccgagttcagcttcgtgggcgagtccaccacgatgcgcgagaacaagtgcttcgagcagtgcgggggctgggggtgcggctgcttcaacgtgaaccccagctgcctgttcgtccacacctacctgcagtccgtgcggaaggaggccctccgcgtgttcaactgcatcgactgggtccacaagctgaccctggagatcaccgacttcgacggcagcgtgtccacgatcgacctcggggccagctccagccggttcaccaactggggctccgtgagcctgagcctggacgccgaggggatctccggcagcaactccttcagcttcatcgagtcccccgggaagggctacgcgatcgtcgacgagcccttcagcgagatcccgcgccagggcttcctcggggagatccggtgcaactccgagagctccgtgctgagcgcccacgagtcctgcctgcgcgcccccaacctcgtgagctacaagcccatgatcgaccagctggagtgcaccaccaacctgatcgaccccttcgtcgtgttcgagcgcggctccctcccgcagacgcggaacgacaagaccttcgccgccagcaaggggaaccgcggcgtgcaggcgttctccaaggggagcgtccaggccgacctgaccctgatgttcgacaacttcgaggtggacttcgtgggcgccgccgtctcctgcgacgcggccttcctcaacctgaccggctgctacagctgcaacgccggggcccgggtgtgcctgtccatcacgagcaccggcaccgggaccctcagcgcccacaacaaggacggctccctgcacatcgtcctgcccagcgagaacggcacgaaggaccagtgccagatcctccacttcaccgtgcccgaggtggaggaggagttcatgtactcctgcgacggggacgagcgccccctgctggtcaagggcaccctcatcgcgatcgacccgttcgacgaccggcgcgaggccgggggcgagagcaccgtggtgaaccccaagtccgggagctggaacttcttcgactggttctccggcctgatgagctggttcggcgggcccctgaagacgatcctcctgatctgcctgtacgtcgccctctccatcggcctgttcttcctgctcatctacctggggcggaccggcctgagcaagatgtggctcgccgccaccaagaaggcgtcctga

SEQ ID NO: 12803 - RNA, 3594 nt, synthetic construct
  misc_feature 1..3594: note = derived and/or modified CDS sequence (opt1) from RVFV(TAN/Dod-002/07)__HM586971.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctggagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtcatgaagacccactgccccaacgactaccagtccgcccactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtgtgcgaggtcggggtgcaggccctcaagaagtgcgacggccagctgtccaccgcgcacgaggtggtccccttcgccgtgttcaagaacagcaagaaggtgtacctggacaagctcgacctgaagacggaggagaacctgctccccgactccttcgtctgcttcgagcacaaggggcagtacaagggcaccatggacagcgggcagaccaagcgggagctgaagtccttcgacatcagccagtgccccaagatcggcggccacgggcgcaagaagtgcaccggcgacgccgccttctgctccgcctacgagtgcacggcgcagtacgccaacgcctactgcagccacgccaacgggtccggcatcgtgcagatccaggtcagcggggtgtggaagaagccgctgtgcgtgggctacgagcgggtcgtggtgaagcgcgagctctccgcgaagcccatccagcgggtcgagccctgcacgacctgcatcaccaagtgcgagccccacggcctggtggtgcgcagcaccgggttcaagatctccagcgccgtcgcctgcgcctccggcgtgtgcgtgaccgggagccagtccccgagcaccgagatcaccctgaagtaccccggcatcagccagtccagcgggggcgacatcggcgtccacatggcccacgacgaccagtccgtgagctccaagatcgtggcgcactgcccgccccaggacccctgcctcgtccacgggtgcatcgtgtgcgcccaggcctggatcatcagccagtggcacacggccctgtccgccttcgtggtcatcttcgtgttcagctccaccgcgatcatctgcctggccgtgctctaccgggtcctgaagtgcctgaagatcgcgccccgcaaggtgctcaaccccctgatgtggatcaccgccttcatccgctgggtgtacaagaagatggtcgcccgggtggccgacaacatcaaccaggtgaaccgcgagatcggctggatggagggcgggcagctggccctcggcaacccggcccccatcccccggcacgcccccatcccgcgctacagcacctacctgatgctgctgctcatcgtctcctacgcgagcgcctgctccgagctgatccaggccagctcccggatcacgacctgcagcaccgagggggtgaacaccaagtgccgcctgtccggcacggccctcatccgggccgggagcgtgggcgcggaggcctgcctgatgctgaagggggtcaaggaggaccagaccaagttcctcaagatcaagaccgtgagctccgagctgagctgccgcgagggccagtcctactggaccggcagcttctcccccaagtgcctgagctcccggcgctgccacctcgtgggggagtgccacgtcaaccggtgcctgagctggcgcgacaacgagacctccgccgagttcagcttcgtgggcgagtccacgaccatgcgggagaacaagtgcttcgagcagtgcgggggctgggggtgcggctgcttcaacgtgaaccccagctgcctgttcgtccacacctacctccagtccgtgcgcaaggaggccctgcgggtgttcaactgcatcgactgggtccacaagctgaccctcgagatcacggacttcgacggcagcgtgtccaccatcgacctgggggccagctccagccgcttcaccaactggggctccgtgagcctgagcctcgacgcggaggggatctccggcagcaactccttcagcttcatcgagtcccccgggaagggctacgccatcgtcgacgagccgttcagcgagatcccccggcagggcttcctgggggagatccgctgcaactccgagagctccgtgctgagcgcccacgagtcctgcctccgggcccccaacctggtgagctacaagcccatgatcgaccagctggagtgcaccacgaacctcatcgacccgttcgtcgtgttcgagcgcggctccctgccccagacccgcaacgacaagaccttcgccgcgagcaaggggaaccggggcgtgcaggccttctccaaggggagcgtccaggccgacctgaccctcatgttcgacaacttcgaggtggacttcgtgggcgccgcggtctcctgcgacgccgccttcctgaacctgacgggctgctacagctgcaacgccggggcccgcgtgtgcctctccatcaccagcaccggcaccgggacgctgagcgcgcacaacaaggacggctccctgcacatcgtcctccccagcgagaacggcaccaaggaccagtgccagatcctgcacttcaccgtgcccgaggtggaggaggagttcatgtactcctgcgacggggacgagcggccgctgctcgtcaagggcaccctgatcgccatcgaccccttcgacgaccgccgggaggccgggggcgagagcacggtggtgaaccccaagtccgggagctggaacttcttcgactggttctccggcctgatgagctggttcggcgggcccctcaagaccatcctgctgatctgcctctacgtcgccctgtccatcggcctgttcttcctcctgatctacctggggcgcaccggcctcagcaagatgtggctggccgcgaccaagaaggcctcctga

SEQ ID NO: 12804 - RNA, 3594 nt, synthetic construct
  misc_feature 1..3594: note = derived and/or modified CDS sequence (opt1) from RVFV(Beijing-01)__KX611606.1__GP
  source 1..3594: mol_type = other RNA
atgtacgtgctgctcaccatcctgatcagcgtcctggtgttcgaggtggtcatccgcgtgtccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgccctgaaggcgatcatcgccgccgacgggctgaacaacatcacgtgccacggcaaggaccccgaggacaagatctccctcatcaaggggccgccccacaagaagcgggtcggcatcgtgcgctgcgagcggcgccgggacgccaagcagatcggccgcgagaccatggccgggatcgcgatgaccgtgctgcccgccctggccgtcttcgccctcgcgcccgtggtgttcgccgaggacccccacctccggaaccgccccggcaaggggcacaactacatcgacggcgtcacccaggaggacgcgacctgcaagccggtgacgtacgccggggcctgcagctccttcgacgtgctgctggagaagggcaagttccccctgttccagagctacgcccaccaccggaccctgctcgaggccgtccacgacaccatcatcgccaaggccgacccgccctcctgcgacctgcagagcgcccacggcaacccctgcatgaaggagaagctggtgatgaagacccactgccccaacgactaccagtccgcgcactacctcaacaacgacgggaagatggccagcgtgaagtgcccgcccaagtacgagctgacggaggactgcaacttctgccgccagatgaccggcgcctccctgaagaaggggagctaccccctccaggacctgttctgccagagctccgaggacgacggcagcaagctgaagaccaagatgaagggcgtctgcgaggtgggggtgcaggccctcaagaagtgcgacggccggctgtccaccgcccacgaggtcgtgcccttcgcggtgttcaagaacagcaagaaggtctacctggacaagctcgacctgaagacggaggagaacctgctccccgactccttcgtgtgcttcgagcacaaggggcagtacaagggcaccatggacagcgggcagaccaagcgcgagctgaagtccttcgacatcagccagtgccccaagatcggcggccacgggtccaagaagtgcaccggcgacgccgccttctgcagcgcctacgagtgcacggcccagtacgcgaacgcctactgctcccacgccaacgggagcggcatcgtccagatccaggtgtccggggtgtggaagaagccgctgtgcgtcggctacgagcgggtggtggtcaagcgcgagctcagcgccaagcccatccagcgggtggagccctgcacgacctgcatcaccaagtgcgagccccacggcctggtggtccgctccaccgggttcaagatcagctccgcggtggcctgcgccagcggcgtgtgcgtcaccgggtcccagagcccgagcaccgagatcaccctgaagtaccccggcatctcccagagctccgggggcgacatcggcgtgcacatggcccacgacgaccagagcgtgtccagcaagatcgtcttcgactgcccgccccaggacccctgcctcgtgcacgggtgcatcgtgtgcgcccacggcctgatcaactaccagtgccacacggcgctgtccgccttcgtcgtggtgttcgtcttcagctccgtggccatcatctgcctcgccatcctgtacaaggtgctgcggtgcctcaagatcgcccccaagaaggtcctgaaccccctgatgtggatcaccgcgttcatccgctgggtgtacaagaagatggtggcccgcgtcgccgacaacatcaaccaggtgaaccgggagatcgggtggatggagggcggccagctcgccctggggaacccggcccccatcccccgccacgcgcccatcccgcggtacagcacctacctgatgctgctcctgatcatctcctacgccagcgcctgctccgagctgatccaggccagctcccgcatcaccacgtgcagcaccgagggcgtgaacaccaagtgccggctctccgggaccgcgctgatccgcgccggcagcgtcggggccgaggcctgcctgatgttcgagggcgtgaaggaggaccagacgaagttcctcaagatcaagaccgtgagctccgagctgagctgccgggagggccagtcctactggaccgggagcttctcccccaagtgcctgagctcccgccggtgccacctcgtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcggctgcttcaacgtcaaccccagctgcctgttcgtgcacacctacctccagtccgtgcggaaggaggcgctgcgcgtcttcaactgcatcgactgggtgcacaagctgaccctcgagatcaccgacttcgacgggagcgtgtccacgatcgacctgggcgccagctccagccggttcaccaactgggggtccgtcagcctgagcctcgacgccgagggcatctccgggagcaactccttcagcttcatcgagtcccccggcaagggctacgccatcgtggacgagccgttcagcgagatcccccgccaggggttcctgggcgagatccggtgcaactccgagagctccgtgctgagcgcccacgagtcctgcctccgcgcgcccaacctgatcagctacaagcccatgatcgaccagctggagtgcaccaccaacctcatcgacccgttcgtcgtgttcgagcgggggtccctgccccagacgcgcaacgacaagaccttcgccgccagcaagggcaaccgcggggtgcaggccttctccaagggcagcgtccaggccgacctgaccctcatgttcgacaacttcgaggtggacttcgtgggcgcggccgtctcctgcgacgccgccttcctgaacctgaccgggtgctacagctgcaacgcgggcgcccgggtgtgcctctccatcacgagcaccgggaccggcaccctgagcgcccacaacaaggacggctccctgcacatcgtcctccccagcgagaacgggacgaaggaccagtgccagatcctgcacttcaccgtgcccgaggtggaggaggagttcatgtactcctgcgacggcgacgagcgcccgctgctcgtcaaggggaccctgatcgccatcgaccccttcgacgaccggcgcgaggccggcggggagagcaccgtggtgaaccccaagtccggcagctggaacttcttcgactggttctccggcctgatgagctggttcgggggccccctcaagacgatcctgctgatctgcctctacgtcgcgctgtccatcgggctgttcttcctcctgatctacctgggccggaccgggctcagcaagatgtggctggccgccaccaagaaggcctcctga

SEQ ID NO: 12805 - RNA, 3594 nt, synthetic construct
  misc_feature 1..3594: note = derived and/or modified CDS sequence (opt1) from RVFV(Smithburn)__DQ380193.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccaccatcgccgccgacgggctgaacaacatcacgtgccacggcaaggaccccgaggacaagatctccctcatcaaggggccgccccacaagaagcgggtgggcgtcgtgcgctgcgagcggcagcgcgacgccaagcagatcggccgggggaccatggcgggcatcgccatgaccgtgttccccgccctggtcgtgttcgccctggcgcccgtggtcttcgccgaggacccccacctccgcaaccggcccgggaagggccacaactacatcgacgggatgacccaggaggacgccacgtgcaagccggtgacctacgccggcgcctgcagctccttcgacgtgctgctggagaagggcaagttccccctcttccagagctacgcgcaccaccgcaccctgctggaggccgtccacgacatcatcatcgccaaggccgacccgccctcctgcaacctccagagcgcccacgggaacccctgcatgaaggagaagctggtgatgaagacctactgccccaacgactaccagtccgcgcactacctgaacaacgacggcaagatggccagcgtgaagtgcccgcccaagcacgagctcacggaggactgcaacttctgccggcagatgaccggggcctccctgaaggagggcagctaccccctgcaggacctcttctgccagagctccgaggacgacggcagcaagctgaagaccaagatgaagggggtctgcgaggtgggcgtgcaggtcctgaagaagtgcgacgggcagctctccaccgcccacgaggtggtgcccttcgccgtcttcaagaacagcaagaaggtgtacctggacaagctggacctcaagacggaggagaacctgctgcccgactccttcgtctgcttcgagcacaagggccagtacaaggggaccatggacagcggccagatcaagcgcgagctcaagtccttcgacatcagccagtgccccaagatcggcgggcacggctccaagaagtgcaccggggacgcggccttctgcagcgcctacgagtgcaccgcccagtacgccaacgcgtactgctcccacgccaacggcagcgggatcgtgcagatccaggtgtccggcgtctggaagaagccgctgtgcgtgggctacgagcgggtggtcgtgaagcgcgagctgagcgccaagcccatccagcgggtggagccctgcacgacctgcatcaccaagtgcgagccccacgggctcgtcgtgcgctccaccggcttcaagatcagctccgccgtggcgtgcgccagcggggtctgcgtgacgggctcccagagcccgagcaccgagatcaccctgaagtaccccgggatctcccagagctccggcggcgacatcggggtgcacatggcccacgacgaccagagcgtctccagcaagatcgtggcccactgcccgccccaggacccctgcctggtgcacggctgcatcgtctgcgcccacgggctcatcaactaccagtgccacaccgcgttctccgccttcgtggtggtcttcgtgttcagctccgtggtcatcatctgcctggccatcctgtacaaggtgctcaagtgcctgaagatcgcgccccggaaggtgctgaaccccctcatgtggatcacggccttcatccgctgggtctacaagaagatggtggcccgggtggccgacaacatcaaccaggtcaaccgcgagatcggctggatggagggcgggcagctggtgctgggcaacccggcccccatcccccgccacgcccccatcccgcggtacagcacctacctcatgctgctgctgatcgtgtcctacgccagcgcgtgctccgagctcatccaggccagctcccgcatcacgacctgcagcaccgagggggtcaacaccaagtgccggctgtccggcaccgccctgatccgcgccgggagcgtgggcgcggaggcctgcctcatgctgaagggcgtgaaggaggaccagaccaagttcctgaagatcaagacggtcagctccgagctcagctgccgggaggggcagtcctactggaccggcagcttctcccccaagtgcctgagctcccgccggtgccacctggtgggggagtgccacgtgaaccgctgcctcagctggcgggacaacgagacctccgccgagttcagcttcgtcggcgagtccaccaccatgcgcgagaacaagtgcttcgagcagtgcgggggctggggctgcgggtgcttcaacgtgaaccccagctgcctgttcgtgcacacgtacctgcagtccgtccggaaggaggccctccgcgtgttcaactgcatcgactgggtgcacaagctgaccctggagatcaccgacttcgacggcagcgtctccaccgtggacctcggggccagctccagccggttcacgaactggggctccgtgagcctgagcctggacgcggaggggatctccggcagcaactccttcagcttcatcgagtcccccggcaaggggtacgccatcgtcgacgagccgttcagcgagatcccccgccagggcttcctcggggagatccggtgcaactccgagagctccgtgctgagcgcccacgagtcctgcctgcgcgcccccaacctcatcagctacaagcccatgatcgaccagctggagtgcaccaccaacctgatcgacccgttcgtggtcttcgagcggggctccctcccccagacccgcaacgacaagacgttcgccgcgagcaaggggaaccggggcgtgcaggccttctccaagggcagcgtccaggccgacctgaccctgatgttcgacaacttcgaggtggacttcgtgggggccgccgtctcctgcgacgcggccttcctcaacctgaccggctgctacagctgcaacgccggggcccgcgtgtgcctgtccatcaccagcacgggcaccggcaccctcagcgcgcacaacaaggacgggtccctgcacatcgtgctgcccagcgagaacggcaccaaggaccagtgccagatcctccacttcacggtccccgaggtggaggaggagttcatgtactcctgcgacggggacgagcgcccgctgctggtgaagggcaccctcatcgccatcgaccccttcgacgaccggcgcgaggccgggggcgagagcaccgtcgtgaaccccaagtccggcagctggaacttcttcgactggttctccgggctgatgagctggttcggcgggcccctgaagaccatcctcctgatctgcctgtacgtggccctctccatcggcctgttcttcttcctgatctacctcgggcggacgggcctgagcaagatgtggctggccgcgaccaagaaggcctcctga

SEQ ID NO: 12806 - RNA, 3594 nt, synthetic construct
  misc_feature 1..3594: note = derived and/or modified CDS sequence (opt1) from RVFV(KEN/Bar-032/07)__HM586968.1__GP
  source 1..3594: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccgtgagcggcatccgggaggtgaagacctccagccaggagctctaccgcgcgctgaaggccatcatcgccgccgacgggctgaacaacatcacgtgccacggcaagaaccccgaggacaagatctccctcatcaaggggccgccccacaagaagcgggtcggcatcgtgcgctgcgagcggcgccgggacgccaagcagatcggccgcgagaccatggcggggatcgccatgaccgtgctgcccgccctggccgtcttcgcgctcgcccccgtggtgttcgccgaggacccccacctccggaaccgccccggcaaggggcacaactacatcgacggccggctgcaggaggacgcgacctgcaagccggtcacctacgccggggcctgcagctccttcgacgtgctgctggagaagggcaagttccccctgttccagagctacgcccaccaccgcacgctcctggaggccgtgcacgacaccatcatcgccaaggccgacccgccctcctgcgacctgcagagcgcggacggcaacaagtgcatgaaggagaagctcgtcatgaagacccactgccccaacgactaccagtccgcccactacctgaacaacgacgggaagatggccagcgtgaagtgcccgcccaagtacgagctgaccgaggactgcaacttctgccggcagatgacgggcgcctccctcaagaaggggagctaccccctgcaggacctgttctgccagagctccgaggacgacggcagcaagctcaagaccaagatgaagggcgtgtgcgaggtcggggtgcaggccctgaagaagtgcgacggccagctgtccaccgcgcacgaggtggtccccttcgccgtgttcaagaacagcaagaaggtgtacctcgacaagctggacctgaagaccgaggagaacctcctgcccgactccttcgtctgcttcgagcacaaggggcagtacaagggcacgatggacagcgggcagaccaagcgcgagctgaagtccttcgacatcagccagtgccccaagatcggcggccacgggtccaagaagtgcaccggcgacgccgccttctgcagcgcctacgagtgcaccgcgcagtacgccaacgcctactgctcccacgccaacgggagcggcatcgtgcagatccaggtctccggggtgtggaagaagcccctctgcgtgggctacgagcgggtcgtggtgaagcgcgagctgagcgcgaagccgatccagcgggtcgagccctgcacgacctgcatcaccaagtgcgagccccacggcctggtggtgcgctccaccgggttcaagatcagctccgccgtcgcctgcgccagcggcgtgtgcgtgacggggtcccagagccccagcaccgagatcaccctcaagtacccgggcatctcccagagctccgtcggggacatcggcgtgcacatggcccacgacgaccagagcgtgtccagcaagatcgtcgcgcactgcccgccccaggacccctgcctggtgcacggctgcatcgtgtgcgcccacgggctgatcaactaccagtgccacaccgccctctccgccttcgtcgtgatcttcgtgttcagctccacggccatcatctgcctggcggtcctgtaccgggtgctcaagtgcctgaagatcgcgccccgcaaggtgctgaaccccctcatgtggatcaccgccttcatccgctgggtctacaagaagatggtggcccgggtggccgacaacatcaaccaggtcaaccgcgagatcggctggatggagggcgggcagctggccctgggcaaccccgccccgatcccccggcacgcccccatcccccgctacagcacctacctgatgctcctgctgatcgtgtcctacgccagcgcgtgctccgagctcatccaggccagctcccggatcaccacgtgcagcaccgagggggtgaacaccaagtgccgcctgtcccacaccgccctgatccgggccggcagcgtcggggccgaggcgtgcctcatgctgaagggcgtgaaggaggaccagacgaagttcctgaagatcaagaccgtgagctccgagctcagctgccgcgaggggcagtcctactggaccggcagcttctccccgaagtgcctgagctcccggcgctgccacctggtcggcgagtgccacgtgaaccggtgcctcagctggcgcgacaacgagacctccgccgagttcagcttcgtgggggagtccaccacgatgcgggagaacaagtgcttcgagcagtgcggcgggtggggctgcgggtgcttcaacgtcaaccccagctgcctgttcgtgcacacctacctgcagtccgtgcgcaaggaggccctccgggtcttcaactgcatcgactgggtgcacaagctgaccctggagatcaccgacttcgacggcagcgtgtccacgatcgacctcggcgccagctccagccgcttcaccaactgggggtccgtcagcctgagcctggacgccgagggcatctccgggagcaactccttcagcttcatcgagtcccccggcaaggggtacgcgatcgtggacgagcccttcagcgagatcccgcggcagggcttcctcggcgagatccgctgcaactccgagagctccgtgctgagcgcccacgagtcctgcctgcgggcccccaacctcgtcagctacaagcccatgatcgaccagctggagtgcaccaccaacctgatcgaccccttcgtggtgttcgagcgcgggtccctcccgcagacgcgcaacgacaagaccttcgccgccagcaagggcaaccgcggggtccaggcgttctccaagggcagcgtgcaggccgacctgaccctgcggttcgacaacttcgaggtggacttcgtcggggccgccgtgtcctgcgacgcggccttcctcaacctgaccggctgctacagctgcaacgccggcgcccgggtctgcctgtccatcacgagcaccgggaccggcaccctcagcgcccacaacaaggacgggtccctgcacatcgtgctgcccagcgagaacggcacgaaggaccagtgccagatcctccacttcaccgtgcccgaggtcgaggaggagttcatgtactcctgcgacggcgacgagcgccccctgctggtgaaggggaccctcatcgcgatcgacccgttcgacgaccggcgcgaggccggcggggagagcaccgtggtcaaccccaagtccggcagctggaacttcttcgactggttctccgggctgatgagctggttcggcggccccctgaagacgatcctcctgatctgcctgtacgtggccctctccatcgggctgttcttcctgctcatctacctgggccggaccgggctgagcaagatgtggctcgccgccaccaagaaggcgtcctga

SEQ ID NO: 12807 - RNA, 3594 nt, synthetic construct
  misc_feature 1..3594: note = derived and/or modified CDS sequence (opt1) from RVFV(KEN/Gar-004/06)__HM586964.1__GP
  source 1..3594: mol_type = other RNA
atgtacgtgctgctcaccatcctgatcagcgtctgggtgtgcgaggccgtgatccgcgtctccctgagctccacccgggaggagacgtgcttcggcgacagcaccaaccccgagatgatcgagggggcctgggactccctccgcgaggaggagatgccggaggagctgagctgctccgtgagcggcatccgggaggtgaagacctccagccaggagctgtaccgcgcgctcaaggccatcatcgccgccgacgggctgaacaacatcacgtgccacggcaagaaccccgaggacaagatctccctgatcaaggggccgccccacaagaagcgggtcggcatcgtgcgctgcgagcggcgccgggacgccaagcagatcggccgcgagaccatggcggggatcgccatgaccgtgctccccgccctggccgtcttcgcgctggcccccgtggtgttcgccgaggacccccacctccggaaccgccccggcaaggggcacaactacatcgacggcatgacccaggaggacgcgacctgcaagccggtcacgtacgccggggcctgcagctccttcgacgtgctgctggagaagggcaagttccccctcttccagagctacgcccaccaccggaccctgctggaggccgtgcacgacaccatcatcgccaaggccgacccgccctcctgcgacctccagagcgcgcacggcaacccctgcatgaaggagaagctggtcatgaagacccactgccccaacgactaccagtccgcccactacctgaacaacgacgggaagatggccagcgtgaagtgcccgcccaagtacgagctcacggaggactgcaacttctgccgccagatgaccggcgcctccctgaagaaggggagctaccccctgcaggacctcttctgccagagctccgaggacgacggcagcaagctgaagaccaagatgaagggcgtgtgcgaggtcggggtgcaggccctgaagaagtgcgacggccagctctccaccgcgcacgaggtggtccccttcgccgtgttcaagaacagccagaaggtgtacctggacaagctggacctcaagacggaggagaacctgctgcccgactccttcgtctgcttcgagcacaaggggcagtacaagggcaccatggacagcgggcagaccaagcgggagctcaagtccttcgacatcagccagtgccccaagatcggcggccacgggcgcaagaagcggaccggcgacgccgccttctgctccgcctacgagtgcacggcgcagtacgccaacgcctactgcagccgcgccaacgggtccggcatcgtgcagatccaggtcagccgggtgtggaagaagccgctgtgcgtggggtacgagcgcgtcgtggtgaagcgggagctgtccgcgaagcccatccagcgcgtcgagccctgcacgacctgcatcaccaagtgcgagccccacggcctcgtggtgcgcagcaccggcttcaagatctccagcgccgtcgcctgcgcctccggggtgtgcgtgaccggcagccagtccccgagcaccgagatcaccctgaagtaccccgggatcagccagtccagcggcggggacatcggcgtccacatggcccacgacgaccagtccgtgagctccaagatcgtggcgcactgcccgccccaggacccctgcctggtccacggctgcatcgtgtgcgcccacgggctcatcaacaaccagagccactccgccctgagcgccttcgtggtcatcttcgtgttctccagcacggccatcatctgcctggcggtgctctaccgggtcctgaagtgcctgaagatcgcgccccgcaaggtgctcaaccccctgatgtggatcaccgccttcatccggtgggtgtacaagaagatggtcgcccgcgtggccgacaacatcaaccaggtgaaccgggagatcggctggatggagggcgggcagctggccctcggcaacccggcccccatcccccgccacgcccccatcccgcggtactccacctacctgatgctgctgctcatcgtcagctacgcctccgcgtgcagcgagctgatccaggcctccagccgcatcaccacgtgctccaccgagggggtgaacaccaagtgccggctgagcggcaccgccctcatccgcgccgggagcgtgggcgccgaggcgtgcctgatgctgaagggggtcaaggaggaccagacgaagttcctcaagatcaagaccgtgtccagcgagctgtcctgccgggagggccagagctactggaccggctccttcagccccaagtgcctgtccagccgccggtgccacctcgtgggggagtgccacgtcaaccgctgcctgtcctggcgggacaacgagaccagcgccgagttctccttcgtgggcgagagcaccacgatgcgcgagaacaagtgcttcgagcagtgcgggggctgggggtgcggctgcttcaacgtgaacccctcctgcctgttcgtccacacctacctccagagcgtgcggaaggaggccctgcgcgtgttcaactgcatcgactgggtccacaagctgaccctcgagatcaccgacttcgacggctccgtgagcacgatcgacctgggggcctccagctcccggttcaccaactggggcagcgtgagcctgtccctcgacgccgaggggatcagcggctccaacagcttctccttcatcgagagccccgggaagggctacgcgatcgtcgacgagccgttctccgagatcccccgccagggcttcctgggggagatccgctgcaacagcgagtccagcgtgctgtccgcccacgagagctgcctccgggcccccaacctggtgtcctacaagcccatgatcgaccagctggagtgcaccaccaacctcatcgacccgttcgtcgtgttcgagcgcggcagcctgccccagacgcggaacgacaagaccttcgccgcctccaaggggaaccgcggcgtgcaggcgttcagcaaggggtccgtccaggccgacctgaccctccggttcgacaacttcgaggtggacttcgtgggcgccgccgtcagctgcgacgcggccttcctgaacctgaccggctgctactcctgcaacgccggggcccgcgtgtgcctcagcatcacgagcaccggcaccgggaccctgtccgcccacaacaaggacggcagcctgcacatcgtcctcccctccgagaacggcacgaaggaccagtgccagatcctgcacttcaccgtgcccgaggtggaggaggagttcatgtacagctgcgacggggacgagcggccgctgctcgtcaagggcaccctgatcgcgatcgaccccttcgacgaccgccgggaggccgggggcgagtccaccgtggtgaaccccaagagcgggtcctggaacttcttcgactggttcagcggcctgatgtcctggttcggcgggcccctcaagacgatcctgctgatctgcctctacgtcgccctgagcatcggcctgttcttcctcctgatctacctggggcgcaccggcctctccaagatgtggctggccgccaccaagaaggcgagctga

SEQ ID NO: 12808 - RNA, 3621 nt, synthetic construct
  misc_feature 1..3621: note = derived and/or modified CDS sequence (opt1) from RVFV(RVFV)__M11157.1__GP
  source 1..3621: mol_type = other RNA
atgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcctgcagctccttcgacgtcctgctggagaagggcaagttccccctgttccagagctacgcccaccaccggaccctgctcgaggccgtgcacgacaccatcatcgccaaggccgacccgccctcctgcgacctgcagagcgcgcacggcaacccctgcatgaaggagaagctggtgatgaagacccactgccccaacgactaccagtccgcccactacctcaacaacgacgggaagatggccagcgtcaagtgcccgcccaagtacggcctgacggaggactgcaacttctgccgccagatgaccggggcctccctgaagaagggcagctaccccctccaggacctgttctgccagagctccgaggacgacggcagcaagctgaagaccaagatgaagggggtgtgcgaggtgggcgtccaggcccacaagaagtgcgacgggcagctctccaccgcgcacgaggtggtgcccttcgccgtcttcaagaacagcaagaaggtgtacctggacaagctggacctcaagacggaggagaacctgctgcccgactccttcgtgtgcttcgagcacaagggccagtacaaggggaccatggacagcggccagaccaagcgggagctcaagtccttcgacatcagccagtgccccaagatcggcgggcacggctccaagaagtgcaccggggacgccgccttctgcagcgcctacgagtgcacggcgcagtacgccaacgcctactgctcccacgccaacggcagcgggatcgtccagatccaggtgtccggcgtctggaagaagccgctgtgcgtgggctacgagcgcgtggtcgtgaagcgggagctgagcgcgaagcccatccagcgcgtggagccctgcacgacctgcatcaccaagtgcgagccccacgggctcgtcgtgcggtccaccggcttcaagatcagctccgccgtggcctgcgccagcggggtctgcgtgaccggctcccagagcccgagcaccgagatcaccctgaagtaccccgggatctcccagagctccggcggcgacatcggggtgcacatggcccacgacgaccagagcgtctccagcaagatcgtggcgcactgcccgccccaggacccctgcctggtgcacggctgcatcgtctgcgcccacgggctcatcaactaccagtgccacacggccctgtccgccttcgtggtggtcttcgtgttcagctccatcgccatcatctgcctggcggtgctctaccgcgtcctgaagtgcctgaagatcgcgccccggaaggtgctcaaccccctgatgtggatcaccgccttcatccgctggatctacaagaagatggtggcccgcgtcgcccacaacatcaaccaggtgaaccgggagatcggctggatggagggcgggcagctggtgctcggcaacccggcccccatcccccgccacgcccccatcccgcggtacagcacctacctgatgctgctgctcatcgtctcctacgccagcgcctgctccgagctgatccaggcgagctcccgcatcaccacgtgcagcaccgagggggtgaacaccaagtgccggctgtccggcaccgccctcatccgcgccgggagcgtgggcgccgaggcctgcctgatgctgaagggcgtcaaggaggaccagacgaagttcctcaagatcaagaccgtgagctccgagctgagctgccgggaggggcagtcctactggaccggcagcatctcccccaagtgcctgagctcccgccggtgccacctcgtgggggagtgccacgtcaaccgctgcctgagctggcgggacaacgagacctccgcggagttcagcttcgtgggcgagtccaccacgatgcgcgagaacaagtgcttcgagcagtgcgggggctggggctgcgggtgcttcaacgtgaaccccagctgcctgttcgtccacacctacctccagtccgtgcggaaggaggccctgcgcgtgttcaactgcatcgactgggtccacaagctgaccctcgagatcaccgacttcgacggcagcgtgtccacgatcgacctgggggccagctccagccggttcaccaactggggctccgtgagcctgagcctcgacgccgaggggatctccggcagcaactccttcagcttcatcgagtcccccagcaagggctacgccatcgtcgacgagccgttctccgagatcccccgccaggggttcctgggcgagatccggtgcaacagcgagtccagcgtgctgtccgcgcacgagagctgcctccgcgcccccaacctgatctcctacaagcccatgatcgaccagctggagtgcaccaccaacctcatcgacccgttcgtggtcttcgagcgggggagcctgccccagacgcgcaacgacaagaccttcgccgcctccaagggcaaccgcggggtgcaggccttcagcaagggctccgtgcaggcggacctgaccctcatgttcgacaacttcgaggtcgacttcgtgggcgccgccgtgagctgcgacgccgcgttcctgaacctgaccgggtgctactcctgcaacgccggcgcccgggtctgcctcagcatcacgagcaccgggaccggctccctgagcgcccacaacaaggacggctccctgcacatcgtgctccccagcgagaacgggaccaaggaccagtgccagatcctgcacttcacggtccccgaggtggaggaggagttcatgtactcctgcgacggcgacgagcgcccgctgctcgtgaaggggaccctgatcgccatcgaccccttcgacgaccggcgcgaggcgggcggggagagcaccgtcgtgaaccccaagtccggcagctggaacttcttcgactggttctccggcctgatgagctggttcgggggccccctcaagctgtactccagcttcgcctgcatgctgcactaccagctcgggtccttcagctccctgtacatcctggaggagcaggccagcctcaagtgcggcctgctgccgctccggcgcccccaccggtccgtgcgcgtcaaggtgatctgctga

SEQ ID NO: 12809 - RNA, 3480 nt, synthetic construct
  misc_feature 1..3480: note = derived and/or modified CDS sequence (opt1) from RVFV(ZH-548)__DQ380206.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgctctccgcccacggcaacccctgcatgaaggagaagctggtcatgaagacccactgccccaacgactaccagagcgcgcactacctgaacaacgacggcaagatggcctccgtgaagtgcccgcccaagtacgagctcacggaggactgcaacttctgccgccagatgaccggggccagcctgaagaagggctcctaccccctgcaggacctcttctgccagagctccgaggacgacgggagcaagctgaagaccaagatgaagggcgtgtgcgaggtcggcgtgcaggccctgaagaagtgcgacgggcagctctccaccgcccacgaggtggtccccttcgcggtgttcaagaacagcaagaaggtgtacctggacaagctggacctcaagacggaggagaacctgctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctcgtggtgcggagcaccggcttcaagatctccagcgcggtcgcctgcgcctccggggtgtgcgtgaccggcagccagtcccccagcaccgagatcaccctgaagtacccggggatctcccagagctccggcggggacatcggcgtccacatggcccacgacgaccagagcgtgagctccaagatcgtggcccactgcccgccccaggacccctgcctggtccacgactgcatcgtgtgcgcgcacggcctcatcaactaccagtgccacacggccctgagcgccttcgtggtcgtgttcgtgttctccagcatcgccatcatctgcctggccatcctctaccgcgtcctgaagtgcctgaagatcgcgccccggaaggtgctcaaccccctgatgtggatcaccgccttcatccgctggatctacaagaagatggtggcccgggtcgccgacaacatcaaccaggtgaaccgcgagatcgggtggatggagggcgggcagctggtgctcggcaaccccgccccgatcccccgccacgcgcccatcccccggtactccacctacctgatgctgctcctgatcgtcagctacgcctccgcctgcagcgagctgatccaggcctccagccgcatcaccacgtgctccaccgagggcgtgaacaccaagtgccggctgagcgggaccgcgctcatccgcgccggctccgtgggggccgaggcctgcctgatgctgaagggcgtcaaggaggaccagacgaagttcctcaagatcaagaccgtgagctccgagctgagctgccgggaggggcagtcctactggaccggcagcttcagcccgaagtgcctgtccagccgccggtgccacctcgtgggcgagtgccacgtcaaccgctgcctgtcctggcgggacaacgagaccagcgccgagttctccttcgtgggggagagcacgaccatgcgcgagaacaagtgcttcgagcagtgcggcgggtggggctgcgggtgcttcaacgtgaacccctcctgcctgttcgtccacacctacctccagagcgtgcggaaggaggcgctgcgcgtgttcaactgcatcgactgggtccacaagctgaccctcgagatcaccgacttcgacggctccgtgagcacgatcgacctgggcgcctccagctcccggttcaccaactgggggagcgtgtccctgagcctcgacgccgagggcatctccgggagcaactccttcagcttcatcgagagccccggcaaggggtacgccatcgtcgacgagcccttctccgagatcccgcgccagggcttcctgggcgagatccggtgcaacagcgagtccagcgtgctgtccgcccacgagagctgcctccgcgcgcccaacctgatctcctacaagcccatgatcgaccagctggagtgcaccaccaacctcatcgaccccttcgtggtcttcgagcgggggagcctgccgcagacgcgcaacgacaagaccttcgccgcctccaagggcaaccgcggggtgcaggccttcagcaagggctccgtgcaggccgacctgaccctcatgttcgacaacttcgaggtcgacttcgtgggggcggccgtgagctgcgacgccgccttcctgaacctgaccggctgctactcctgcaacgcgggcgcccgggtctgcctcagcatcacgtccaccgggaccggcagcctgtccgcccacaacaaggacgggagcctgcacatcgtgctcccctccgagaacggcaccaaggaccagtgccagatcctgcacttcacggtgcccgaggtcgaggaggagttcatgtacagctgcgacggcgacgagcgccccctgctcgtgaaggggaccctgatcgccatcgacccgttcgacgaccggcgcgaggccggcggggagagcaccgtggtcaaccccaagtccggcagctggaacttcttcgactggttctccgggctgatgagctggttcggcggccccctcaagaccatcctgctgatctgcctctacgtggcgctgtccatcgggctgttcttcctcctgatctacctgggccggacggggctcagcaagatgtggctggccgccaccaagaaggcctcctga

SEQ ID NO: 12810 - RNA, 3480 nt, synthetic construct
  misc_feature 1..3480: note = derived and/or modified CDS sequence (opt1) from RVFV(ZS-6365)__DQ380205.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcatcgccatcatctgcctggccatcctgtaccgcgtcctcaagtgcctgaagatcgcgccccggaaggtgctgaaccccctcatgtggatcaccgccttcatccgctggatctacaagaagatggtggcccgggtcgccgacaacatcaaccaggtgaaccgcgagatcggctggatggagggcgggcagctggtgctgggcaaccccgccccgatcccccgccacgcgcccatcccccggtactccacctacctcatgctgctgctcatcgtcagctacgcctccgcctgcagcgagctgatccaggcctccagccgcatcaccacgtgctccaccgagggggtgaacaccaagtgccggctgagcggcaccgcgctgatccgcgccgggtccgtgggcgccgaggcctgcctcatgctgaagggggtcaaggaggaccagacgaagttcctgaagatcaagaccgtgagctccgagctcagctgccgggagggccagtcctactggaccggcagcttcagcccgaagtgcctgtccagccgccggtgccacctggtgggggagtgccacgtcaaccgctgcctctcctggcgggacaacgagaccagcgccgagttctccttcgtgggcgagagcacgaccatgcgcgagaacaagtgcttcgagcagtgcgggggctgggggtgcggctgcttcaacgtgaacccctcctgcctgttcgtccacacctacctgcagagcgtgcggaaggaggcgctccgcgtgttcaactgcatcgactgggtccacaagctgaccctggagatcaccgacttcgacggctccgtgagcacgatcgacctcggggcctccagctcccggttcaccaactggggcagcgtgtccctgagcctggacgccgaggggatctccggcagcaactccttcagcttcatcgagagccccgggaagggctacgccatcgtcgacgagcccttctccgagatcccgcgccagggcttcctcggggagatccggtgcaacagcgagtccagcgtgctgtccgcccacgagagctgcctgcgcgcgcccaacctcatctcctacaagcccatgatcgaccagctggagtgcaccaccaacctgatcgaccccttcgtggtcttcgagcggggcagcctcccgcagacgcgcaacgacaagaccttcgccgcctccaaggggaaccggggcgtgcaggccttcagcaaggggtccgtgcaggccgacctgaccctgatgttcgacaacttcgaggtcgacttcgtgggcgcggccgtgagctgcgacgccgccttcctcaacctgaccggctgctactcctgcaacgcgggggcccgcgtctgcctgagcatcacgtccaccggcaccgggagcctctccgcccacaacaaggacggcagcctgcacatcgtgctgccctccgagaacggcaccaaggaccagtgccagatcctccacttcacggtgcccgaggtcgaggaggagttcatgtacagctgcgacggggacgagcgccccctgctggtgaagggcaccctcatcgccatcgacccgttcgacgaccggcgcgaggccgggggcgagagcaccgtggtcaaccccaagtccgggagctggaacttcttcgactggttctccggcctgatgagctggttcggcgggcccctgaagaccatcctcctgatctgcctgtacgtggcgctctccatcggcctgttcttcctgctcatctacctggggcggacgggcctgagcaagatgtggctcgccgccaccaagaaggcctcctga

SEQ ID NO: 12811 - RNA, 3480 nt, synthetic construct
  misc_feature 1..3480: note = derived and/or modified CDS sequence (opt1) from RVFV(MP-12)__DQ380208.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctcctggagaaggggaagttcccgctgttccagtcctacgcccaccaccggaccctcctggaggccgtgcacgacaccatcatcgccaaggccgacccgcccagctgcgacctgctctccgcccacggcaacccctgcatgaaggagaagctggtcatgaagacccactgccccaacgactaccagagcgcgcaccacctgaacaacgacggcaagatggcctccgtgaagtgcccgcccaagtacgagctcacggaggactgcaacttctgccgccagatgaccggggccagcctgaagaagggctcctaccccctgcaggacctcttctgccagagctccgaggacgacgggagcaagctgaagaccaagatgaagggcgtgtgcgaggtcggcgtgcaggccctgaagaagtgcgacgggcagctctccaccgcccacgaggtggtccccttcgcggtgttcaagaacagcaagaaggtgtacctggacaagctggacctcaagacggaggagaacctgctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctcgtggtgcggagcaccggcttcaagatctccagcgcggtcgcctgcgcctccggggtgtgcgtgaccggcagccagtcccccagcaccgagatcaccctgaagtacccggggatctcccagagctccggcggggacatcggcgtccacatggcccacgacgaccagagcgtgagctccaagatcgtggcccactgcccgccccaggacccctgcctggtccacgactgcatcgtgtgcgcgcacggcctcatcaactaccagtgccacacggccctgagcgccttcgtggtcgtgttcgtgttctccagcatcgccatcatctgcctggccatcctctaccgcgtcctgaagtgcctgaagatcgcgccccggaaggtgctcaaccccctgatgtggatcaccgccttcatccgctggatctacaagaagatggtggcccgggtcgccgacaacatcaaccaggtgaaccgcgagatcgggtggatggagggcgggcagctggtgctcggcaaccccgccccgatcccccgccacgcgcccatcccccggtactccacctacctgatgctgctcctgatcgtcagctacgcctccgcctgcagcgagctgatccaggcctccagccgcatcaccacgtgctccaccgagggcgtgaacaccaagtgccggctgagcgggaccgcgctcatccgcgccggctccgtgggggccgaggcctgcctgatgctgaagggcgtcaaggaggaccagacgaagttcctcaagctgaagaccgtgagctccgagctgagctgccgggaggggcagtcctactggaccggcagcttcagcccgaagtgcctctccagccgccggtgccacctggtgggcgagtgccacgtcaaccgctgcctgtcctggcgggacaacgagaccagcgccgagttctccttcgtgggggagagcacgaccatgcgcgagaacaagtgcttcgagcagtgcggcgggtggggctgcgggtgcttcaacgtgaacccctcctgcctcttcgtccacacctacctgcagagcgtgcggaaggaggcgctgcgcgtgttcaactgcatcgactgggtccacaagctcaccctggagatcaccgacttcgacggctccgtgagcacgatcgacctgggcgcctccagctcccggttcaccaactgggggagcgtgtccctcagcctggacgccgagggcatctccgggagcaactccttcagcttcatcgagagccccggcaaggggtacgccatcgtcgacgagcccttctccgagatcccgcgccagggcttcctgggcgagatccggtgcaacagcgagtccagcgtgctctccgcccacgagagctgcctgcgcgcgcccaacctgatctcctacaagcccatgatcgaccagctcgagtgcaccaccaacctgatcgaccccttcgtggtcttcgagcgggggagcctgccgcagacgcgcaacgacaagaccttcgccgcctccaagggcaaccgcggggtgcaggccttcagcaagggctccgtgcaggccgacctcaccctgatgttcgacaacttcgaggtcgacttcgtgggggcggccgtgagctgcgacgccgccttcctgaacctcaccggctgctactcctgcaacgcgggcgcccgggtctgcctgagcatcacgtccaccgggaccggcagcctgtccgcccacaacaaggacgggagcctccacatcgtgctgccctccgagaacggcaccaaggaccagtgccagatcctgcacttcacggtgcccgaggtcgaggaggagttcatgtacagctgcgacggcgacgagcgccccctcctggtgaaggggaccctgatcgccatcgacccgttcgacgaccggcgcgaggccggcggggagagcaccgtggtcaaccccaagtccggcagctggaacttcttcgactggttctccgggctcatgagctggttcggcggccccctgaagaccatcctgctcatctgcctgtacgtggcgctgtccatcgggctgttcttcctgctgatctacctcggcgggacgggcctgagcaagatgtggctggccgccaccaagaaggcctcctga

SEQ ID NO: 12812 - RNA, 3480 nt, synthetic construct
  misc_feature 1..3480: note = derived and/or modified CDS sequence (opt1) from RVFV(T1)__DQ380201.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcatcgccatcatctgcctggccgtcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctgggcaaccccgccccgatcccccgccacgcgcccatcccccggtactccacctacctcatgctgctgctcatcgtgagctacgcctccgcctgcagcgagctgatccaggcctccagccgcatcaccacgtgctccaccgagggggtgaacaccaagtgccggctgagcggcaccgcgctgatccgcgccgggtccgtcggcgccgaggcctgcctcatgctgaagggggtgaaggaggaccagacgaagttcctgaagatcaagaccgtgagctccgagctcagctgccgggagggccagtcctactggaccggcagcttcagcccgaagtgcctgtccagccgccggtgccacctggtcggggagtgccacgtgaaccgctgcctctcctggcgggacaacgagaccagcgccgagttctccttcgtgggcgagagcacgaccatgcgcgagaacaagtgcttcgagcagtgcgggggctgggggtgcggctgcttcaacgtcaacccctcctgcctgttcgtgcacacctacctgcagagcgtgcggaaggaggcgctccgcgtcttcaactgcatcgactgggtgcacaagctgaccctggagatcaccgacttcgacggctccgtgagcacgatcgacctcggggcctccagctcccggttcaccaactggggcagcgtctccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtgctgtccgcccacgagagctgcctgcgcgcgcccaacctcatctcctacaagcccatgatcgaccagctggagtgcaccaccaacctgatcgaccccttcgtcgtgttcgagcggggcagcctcccgcagacgcgcaacgacaagaccttcgccgcctccaaggggaaccggggcgtgcaggccttcagcaaggggtccgtccaggccgacctgaccctgatgttcgacaacttcgaggtggacttcgtgggcgcggccgtcagctgcgacgccgccttcctcaacctgaccggctgctactcctgcaacgcgggggcccgcgtgtgcctgagcatcacgtccaccggcaccgggagcctctccgcccacaacaaggacggcagcctgcacatcgtgctgccctccgagaacggcaccaaggaccagtgccagatcctccacttcacggtccccgaggtggaggaggagttcatgtacagctgcgacggggacgagcgccccctgctggtgaagggcaccctcatcgccatcgacccgttcgacgaccggcgcgaggccgggggcgagagcaccgtcgtgaaccccaagtccgggagctggaacttcttcgactggttctccggcctgatgagctggttcggcgggcccctgaagaccatcctcctgatctgcctgtacgtcgcgctctccatcggcctgttcttcctgctcatctacctggggcggacgggcctgagcaagatgtggctcgccgccaccaagaaggcctcctga

SEQ ID NO: 12813 - RNA, 3480 nt, synthetic construct
  misc_feature 1..3480: note = derived and/or modified CDS sequence (opt1) from RVFV(1853/78)__DQ380220.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccggggtggtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtggtgttcgtcttctccagcatcgccatcatctgcctggccatcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggtgctgggcaaccccgccccgatcccccgccacgcgcccatcccccggtactccacctacctcatgctgctgctcatcgtgagctacgcctccgcctgcagcgagctgatccaggcctccagccgcatcaccacgtgctccaccgagggggtcaacaccaagtgccggctgagcggcaccgcgctgatccgcgccgggtccgtgggcgccgaggcctgcctcatgctgaagggggtgaaggaggaccagacgaagttcctgaagatcaagaccgtcagctccgagctcagctgccgggagggccagtcctactggaccggcagcttcagcccgaagtgcctgtccagccgccggtgccacctggtgggggagtgccacgtgaaccgctgcctctcctggcgggacaacgagaccagcgccgagttctccttcgtcggcgagagcacgaccatgcgcgagaacaagtgcttcgagcagtgcgggggctgggggtgcggctgcttcaacgtgaacccctcctgcctgttcgtgcacacctacctgcagagcgtccggaaggaggcgctccgcgtgttcaactgcatcgactgggtgcacaagctgaccctggagatcaccgacttcgacggctccgtcagcacgatcgacctcggggcctccagctcccggttcaccaactggggcagcgtgtccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtcctgtccgcccacgagagctgcctgcgcgcgcccaacctcatctcctacaagcccatgatcgaccagctggagtgcaccaccaacctgatcgaccccttcgtggtgttcgagcggggcagcctcccgcagacgcgcaacgacaagaccttcgccgcctccaaggggaaccggggcgtccaggccttcagcaaggggtccgtgcaggccgacctgaccctgatgttcgacaacttcgaggtggacttcgtcggcgcggccgtgagctgcgacgccgccttcctcaacctgaccggctgctactcctgcaacgcgggggcccgcgtgtgcctgagcatcacgtccaccggcaccgggaccctcagcgcccacaacaaggacggctccctgcacatcgtcctgcccagcgagaacggcacgaaggaccagtgccagatcctccacttcaccgtgcccgaggtggaggaggagttcatgtactcctgcgacggggacgagcgccccctgctggtcaagggcaccctcatcgccatcgacccgttcgacgaccggcgcgaggccgggggcgagagcaccgtggtcaaccccaagagcgggtcctggaacttcttcgactggttcagcggcctgatgtcctggttcggcgggcccctgaagacgatcctcctgatctgcctgtacgtggcgctcagcatcggcctgttcttcctgctcatctacctggggcggaccggcctgtccaagatgtggctcgccgccaccaagaaggccagctga

SEQ ID NO: 12814 - RNA, 3480 nt, synthetic construct
  misc_feature 1..3480: note = derived and/or modified CDS sequence (opt1) from RVFV(CAR-R1622)__DQ380219.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcatcgccatcatctgcctggccatcctgtaccgcgtcctcaagtgcctgaagatcgcgccccggaaggtgctgaaccccctcatgtggatcaccgccttcatccgctgggtgtacaagaagatggtcgcccgggtggccgacaacatcaaccaggtgaaccgcgagatcggctggatggagggcgggcagctggtcctgggcaaccccgccccgatcccccgccacgcgcccatcccccggtactccacctacctcatgctgctgctcatcgtgagctacgcctccgcctgcagcgagctgatccaggcctccagccgcatcaccacgtgctccaccgagggggtgaacaccaagtgccggctgagcggcaccgcgctgatccgcgccgggtccgtcggcgccgaggcctgcctcatgctgaagggggtgaaggaggaccagacgaagttcctgaagatcaagaccgtgagctccgagctcagctgccgggagggccagtcctactggaccggcagcttcagcccgaagtgcctgtccagccgccggtgccacctggtcggggagtgccacgtgaaccgctgcctctcctggcgggacaacgagaccagcgccgagttctccttcgtgggcgagagcacgaccatgcgcgagaacaagtgcttcgagcagtgcgggggctgggggtgcggctgcttcaacgtcaacccctcctgcctgttcgtgcacacctacctgcagagcgtgcggaaggaggcgctccgcgtcttcaactgcatcgactgggtgcacaagctgaccctggagatcaccgacttcgacggctccgtgagcacgatcgacctcggggcctccagctcccggttcaccaactggggcagcgtctccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtgctgtccgcccacgagagctgcctgcgcgcgcccaacctcatctcctacaagcccatgatcgaccagctggagtgcaccaccaacctgatcgaccccttcgtcgtgttcgagcggggcagcctcccgcagacgcgcaacgacaagaccttcgccgcctccaaggggaaccggggcgtgcaggccttcagcaaggggtccgtccaggccgacctgaccctgatgttcgacaacttcgaggtggacttcgtgggcgcggccgtcagctgcgacgccgccttcctcaacctgaccggctgctactcctgcaacgcgggggcccgcgtgtgcctgagcatcacgtccaccggcaccgggaccctcagcgcccacaacaaggacggctccctgcacatcgtgctgcccagcgagaacggcacgaaggaccagtgccagatcctccacttcaccgtccccgaggtggaggaggagttcatgtactcctgcgacggggacgagcgccccctgctggtgaagggcaccctcatcgccatcgacccgttcgacgaccggcgcgaggccgggggcgagagcaccgtcgtgaaccccaagagcgggtcctggaacttcttcgactggttcagcggcctgatgtcctggttcggcgggcccctgaagacgatcctcctgatctgcctgtacgtcgcgctcagcatcggcctgttcttcctgctcatctacctggggcggaccggcctgtccaagatgtggctcgccgccaccaagaaggccagctga

SEQ ID NO: 12815 - RNA, 3480 nt, synthetic construct
  misc_feature 1..3480: note = derived and/or modified CDS sequence (opt1) from RVFV(2250/74)__DQ380209.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcatcgccatcatctgcctggccatcctgtaccgcgtcctcaagtgcctgaagatcgcgccccggaaggtgctgaaccccctcatgtggatcaccgccttcatccgctggatctacaagaagatggtggcccgggtcgccgacaacatcaaccaggtgaaccgcgagatcggctggatggagggcgggcagctggtgctgggcaaccccgccccgatcccccgccacgcgcccatcccccggtactccacctacctcatgctgctgctcatcgtcagctacgcctccgcctgcagcgagctgatccaggcctccagccgcatcaccacgtgctccaccgagggggtgaacaccaagtgccggctgagcggcaccgcgctgatccgcgccgggtccgtgggcgccgaggcctgcctcatgctgaagggggtcaaggaggaccagacgaagttcctgaagatcaagaccgtgagctccgagctcagctgccgggagggccagtcctactggaccggcagcttcagcccgaagtgcctgtccagccgccggtgccacctggtgggggagtgccacgtcaaccgctgcctctcctggcgggacaacgagaccagcgccgagttctccttcgtgggcgagagcacgaccatgcgcgagaacaagtgcttcgagcagtgcgggggctgggggtgcggctgcttcaacgtgaacccctcctgcctgttcgtccacacctacctgcagagcgtgcggaaggaggcgctccgcgtgttcaactgcatcgactgggtccacaagctgaccctggagatcaccgacttcgacggctccgtgagcacgatcgacctcggggcctccagctcccggttcaccaactggggcagcgtgtccctgagcctggacgccgaggggatctccggcagcaactccttcagcttcatcgagagccccgggaagggctacgccatcgtcgacgagcccttctccgagatcccgcgccagggcttcctcggggagatccggtgcaacagcgagtccagcgtgctgtccgcccacgagagctgcctgcgcgcgcccaacctcatctcctacaagcccatgatcgaccagctggagtgcaccaccaacctgatcgaccccttcgtggtcttcgagcggggcagcctcccgcagacgcgcaacgacaagaccttcgccgcctccaaggggaaccggggcgtgcaggccttcagcaaggggtccgtgcaggccgacctgaccctgatgttcgacaacttcgaggtcgacttcgtgggcgcggccgtgagctgcgacgccgccttcctcaacctgaccggctgctactcctgcaacgcgggggccaaggtctgcctgagcatcacgtccaccggcaccgggagcctctccgcccacaacaaggacggcagcctgcacatcgtgctgccctccgagaacggcaccaaggaccagtgccagatcctccacttcacggtgcccgaggtcgaggaggagttcatgtacagctgcgacggggacgagcgccccctgctggtgaagggcaccctcatcgccatcgacccgttcgacgaccgccgggaggccgggggcgagagcaccgtggtcaaccccaagtccgggagctggaacttcttcgactggttctccggcctgatgagctggttcggcgggcccctgaagaccatcctcctgatctgcctgtacgtggcgctctccatcggcctgttcttcctgctcatctacctggggcgcacgggcctgagcaagatgtggctcgccgccaccaagaaggcctcctga

SEQ ID NO: 12816 - RNA, 3480 nt, synthetic construct
  misc_feature 1..3480: note = derived and/or modified CDS sequence (opt1) from RVFV(2007000094)__EU574055.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtggtgttcgtcttctccagcatcgccatcatctgcctggccatcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggtgctgggcaaccccgccccgatcccccgccacgcgcccatcccccggtactccacctacctcatgctgctgctcatcgtgagctacgcctccgcctgcagcgagctgatccaggcctccagccgcatcaccacgtgctccaccgagggggtcaacaccaagtgccggctgagcggcaccgcgctgatccgcgccgggtccgtgggcgccgaggcctgcctcatgctgaagggggtgaaggaggaccagacgaagttcctgaagatcaagaccgtcagctccgagctcagctgccgggagggccagtcctactggaccggcagcttcagcccgaagtgcctgtccagccgccggtgccacctggtgggggagtgccacgtgaaccgctgcctctcctggcgggacaacgagaccagcgccgagttctccttcgtcggcgagagcacgaccatgcgcgagaacaagtgcttcgagcagtgcgggggctgggggtgcggctgcttcaacgtgaacccctcctgcctgttcgtgcacacctacctgcagagcgtccggaaggaggcgctccgcgtgttcaactgcatcgactgggtgcacaagctgaccctggagatcaccgacttcgacggctccgtcagcacgatcgacctcggggcctccagctcccggttcaccaactggggcagcgtgtccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtcctgtccgcccacgagagctgcctgcgcgcgcccaacctcatctcctacaagcccatgatcgaccagctggagtgcaccaccaacctgatcgaccccttcgtggtgttcgagcggggcagcctcccgcagacgcgcaacgacaagaccttcgccgcctccaaggggaaccggggcgtccaggccttcagcaaggggtccgtgcaggccgacctgaccctgatgttcgacaacttcgaggtggacttcgtcggcgcggccgtgagctgcgacgccgccttcctcaacctgaccggctgctactcctgcaacgcgggggcccgcgtgtgcctgagcatcacgtccaccggcaccgggaccctcagcgcccacaacaaggacggctccctgcacatcgtcctgcccagcgagaacggcacgaaggaccagtgccagatcctccacttcaccgtgcccgaggtggaggaggagttcatgtactcctgcgacggggacgagcgccccctgctggtcaagggcaccctcatcgccatcgacccgttcgacgaccggcgcgaggccgggggcgagagcaccgtggtcaaccccaagagcgggtcctggaacttcttcgactggttcagcggcctgatgtcctggttcggcgggcccctgaagacgatcctcctgatctgcctgtacgtggcgctcagcatcggcctgttcttcctgctcatctacctggggcggaccggcctgtccaagatgtggctcgccgccaccaagaaggccagctga

SEQ ID NO: 12817 - RNA, 3480 nt, synthetic construct
  misc_feature 1..3480: note = derived and/or modified CDS sequence (opt1) from RVFV(ZM-657)__DQ380204.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaaggcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcatcgccatcatctgcctggccatcctgtaccgcgtcctcaagtgcctgaagatcgcgccccggaaggtgctgaaccccctcatgtggatcaccgccttcatccgctggatctacaagaagatggtggcccgggtcgccgacaacatcaaccaggtgaaccgcgagatcggctggatggagggcgggcagctggtgctgggcaaccccgccccgatcccccgccacgcgcccatcccccggtactccacctacctcatgctgctgctcatcgtcagctacgcctccgcctgcagcgagctgatccaggcctccagccgcatcaccacgtgctccaccgagggggtgaacaccaagtgccggctgagcggcaccgcgctgatccgcgccgggtccgtgggcgccgaggcctgcctcatgctgaagggggtcaaggaggaccagacgaagttcctgaagatcaagaccgtgagctccgagctcagctgccgggagggccagtcctactggaccggcagcttcagcccgaagtgcctgtccagccgccggtgccacctggtgggggagtgccacgtcaaccgctgcctctcctggcgggacaacgagaccagcgccgagttctccttcgtgggcgagagcacgaccatgcgcgagaacaagtgcttcgagcagtgcgggggctgggggtgcggctgcttcaacgtgaacccctcctgcctgttcgtccacacctacctgcagagcgtgcggaaggaggcgctccgcgtgttcaactgcatcgactgggtccacaagctgaccctggagatcaccgacttcgacggctccgtgagcacgatcgacctcggggcctccagctcccggttcaccaactggggcagcgtgtccctgagcctggacgccgaggggatctccggcagcaactccttcagcttcatcgagagccccgggaagggctacgccatcgtcgacgagcccttctccgagatcccgcgccagggcttcctcggggagatccggtgcaacagcgagtccagcgtgctgtccgcccacgagagctgcctgcgcgcgcccaacctcatctcctacaagcccatgatcgaccagctggagtgcaccaccaacctgatcgaccccttcgtggtcttcgagcggggcagcctcccgcagacgcgcaacgacaagaccttcgccgcctccaaggggaaccggggcgtgcaggccttcagcaaggggtccgtgcaggccgacctgaccctgatgttcgacaacttcgaggtcgacttcgtgggcgcggccgtgagctgcgacgccgccttcctcaacctgaccggctgctactcctgcaacgcgggggcccgcgtctgcctgagcatcacgtccaccggcaccgggagcctctccgcccacaacaaggacggcagcctgcacatcgtgctgccctccgagaacggcaccaaggaccagtgccagatcctccacttcacggtgcccgaggtcgaggaggagttcatgtacagctgcgacggggacgagcgccccctgctggtgaagggcaccctcatcgccatcgacccgttcgacgaccggcgcgaggccgggggcgagagcaccgtggtcaaccccaagtccgggagctggaacttcttcgactggttctccggcctgatgagctggttcggcgggcccctgaagaccatcctcctgatctgcctgtacgtggcgctctccatcggcctgttcttcctgctcatctacctggggcggacgggcctgagcaagatgtggctcgccgccaccaagaaggcctcctga

SEQ ID NO: 12818 - RNA, 3480 nt, synthetic construct
  misc_feature 1..3480: note = derived and/or modified CDS sequence (opt1) from RVFV(ZH-548M12)__M25276.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcaagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctcctggagaaggggaagttcccgctgttccagtcctacgcccaccaccggaccctcctggaggccgtgcacgacaccatcatcgccaaggccgacccgcccagctgcgacctgctctccgcccacggcaacccctgcatgaaggagaagctggtcatgaagacccactgccccaacgactaccagagcgcgcaccacctgaacaacgacggcaagatggcctccgtgaagtgcccgcccaagtacgagctcacggaggactgcaacttctgccgccagatgaccggggccagcctgaagaagggctcctaccccctgcaggacctcttctgccagagctccgaggacgacgggagcaagctgaagaccaagatgaagggcgtgtgcgaggtcggcgtgcaggccctgaagaagtgcgacgggcagctctccaccgcccacgaggtggtccccttcgcggtgttcaagaacagcaagaaggtgtacctggacaagctggacctcaagacggaggagaacctgctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctcgtggtgcggagcaccggcttcaagatctccagcgcggtcgcctgcgcctccggggtgtgcgtgaccggcagccagtcccccagcaccgagatcaccctgaagtacccggggatctcccagagctccggcggggacatcggcgtccacatggcccacgacgaccagagcgtgagctccaagatcgtggcccactgcccgccccaggacccctgcctggtccacgactgcatcgtgtgcgcgcacggcctcatcaactaccagtgccacacggccctgagcgccttcgtggtcgtgttcgtgttctccagcatcgccatcatctgcctggccatcctctaccgcgtcctgaagtgcctgaagatcgcgccccggaaggtgctcaaccccctgatgtggatcaccgccttcatccgctggatctacaagaagatggtggcccgggtcgccgacaacatcaaccaggtgaaccgcgagatcgggtggatggagggcgggcagctggtgctcggcaaccccgccccgatcccccgccacgcgcccatcccccggtactccacctacctgatgctgctcctgatcgtcagctacgcctccgcctgcagcgagctgatccaggcctccagccgcatcaccacgtgctccaccgagggcgtgaacaccaagtgccggctgagcgggaccgcgctcatccgcgccggctccgtgggggccgaggcctgcctgatgctgaagggcgtcaaggaggaccagacgaagttcctcaagctgaagaccgtgagctccgagctgagctgccgggaggggcagtcctactggaccggcagcttcagcccgaagtgcctctccagccgccggtgccacctggtgggcgagtgccacgtcaaccgctgcctgtcctggcgggacaacgagaccagcgccgagttctccttcgtgggggagagcacgaccatgcgcgagaacaagtgcttcgagcagtgcggcgggtggggctgcgggtgcttcaacgtgaacccctcctgcctcttcgtccacacctacctgcagagcgtgcggaaggaggcgctgcgcgtgttcaactgcatcgactgggtccacaagctcaccctggagatcaccgacttcgacggctccgtgagcacgatcgacctgggcgcctccagctcccggttcaccaactgggggagcgtgtccctcagcctggacgccgagggcatctccgggagcaactccttcagcttcatcgagagccccggcaaggggtacgccatcgtcgacgagcccttctccgagatcccgcgccagggcttcctgggcgagatccggtgcaacagcgagtccagcgtgctctccgcccacgagagctgcctgcgcgcgcccaacctgatctcctacaagcccatgatcgaccagctcgagtgcaccaccaacctgatcgaccccttcgtggtcttcgagcgggggagcctgccgcagacgcgcaacgacaagaccttcgccgcctccaagggcaaccgcggggtgcaggccttcagcaagggctccgtgcaggccgacctcaccctgatgttcgacaacttcgaggtcgacttcgtgggggcggccgtgagctgcgacgccgccttcctgaacctcaccggctgctactcctgcaacgcgggcgcccgggtctgcctgagcatcacgtccaccgggaccggcagcctgtccgcccacaacaaggacgggagcctccacatcgtgctgccctccgagaacggcaccaaggaccagtgccagatcctgcacttcacggtgcccgaggtcgaggaggagttcatgtacagctgcgacggcgacgagcgccccctcctggtgaaggggaccctgatcgccatcgacccgttcgacgaccggcgcgaggccggcggggagagcaccgtggtcaaccccaagtccggcagctggaacttcttcgactggttctccgggctcatgagctggttcggcggccccctgaagaccatcctgctcatctgcctgtacgtggcgctgtccatcgggctgttcttcctgctgatctacctcggcgggacgggcctgagcaagatgtggctggccgccaccaagaaggcctcctga

SEQ ID NO: 12819 - RNA, 3480 nt, synthetic construct
  misc_feature 1..3480: note = derived and/or modified CDS sequence (opt1) from RVFV(ZH-501-777)__DQ380202.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggaccccggccagaccaagcgggagctgaagtccttcgacatcagccagtgccccaagatcgggggccacggctccaagaagtgcaccggggacgccgccttctgcagcgcctacgagtgcacggcccagtacgcgaacgcctactgctcccacgccaacggcagcgggatcgtgcagatccaggtgtccggcgtctggaagaagccgctctgcgtggggtacgagcgcgtggtcgtgaagcgggagctgagcgccaagcccatccagcgcgtcgagccctgcacgacctgcatcaccaagtgcgagccccacggcctggtggtgcggtccaccggcttcaagatcagctccgcggtcgcctgcgccagcggggtgtgcgtgaccggctcccagagcccgtccaccgagatcaccctcaagtaccccgggatcagccagtccagcggcggggacatcggcgtccacatggcccacgacgaccagtccgtgagcagcaagatcgtggcccactgcccgccccaggacccctgcctggtccacggctgcatcgtgtgcgcgcacgggctgatcaactaccagtgccacacggccctctccgccttcgtggtcgtgttcgtgttcagctccatcgccatcatctgcctggccgtcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctgggcaacccggcccccatcccccgccacgcgcccatcccgcggtacagcacctacctcatgctgctgctcatcgtgtcctacgccagcgcctgctccgagctgatccaggccagctcccgcatcaccacgtgcagcaccgagggggtgaacaccaagtgccggctgtccggcaccgcgctgatccgcgccgggagcgtcggcgccgaggcctgcctcatgctgaagggggtgaaggaggaccagacgaagttcctgaagatcaagaccgtgtccagcgagctctcctgccgggagggccagagctactggaccggctccttcagccccaagtgcctgagctcccgccggtgccacctggtcggggagtgccacgtgaaccgctgcctcagctggcgggacaacgagacctccgccgagttcagcttcgtgggcgagtccacgaccatgcgcgagaacaagtgcttcgagcagtgcgggggctgggggtgcggctgcttcaacgtcaaccccagctgcctgttcgtgcacacctacctgcagtccgtgcggaaggaggcgctccgcgtcttcaactgcatcgactgggtgcacaagctgaccctggagatcaccgacttcgacggcagcgtgtccacgatcgacctcggggccagctccagccggttcaccaactggggctccgtcagcctgtccctggacgccgaggggatcagcggctccaacagcttctccttcatcgagagccccgggaagggctacgccatcgtggacgagccgttcagcgagatcccccgccagggcttcctcggggagatccggtgcaactccgagagctccgtgctgagcgcccacgagtcctgcctgcgcgcgcccaacctcatcagctacaagcccatgatcgaccagctggagtgcaccaccaacctgatcgacccgttcgtcgtgttcgagcggggctccctcccccagacgcgcaacgacaagaccttcgccgccagcaaggggaaccggggcgtgcaggccttctccaaggggagcgtccaggccgacctgaccctgatgttcgacaacttcgaggtggacttcgtgggcgcggccgtctcctgcgacgccgccttcctcaacctgaccggctgctacagctgcaacgcgggggcccgcgtgtgcctgtccatcacgagcaccggcaccgggtccctcagcgcccacaacaaggacggctccctgcacatcgtgctgcccagcgagaacggcaccaaggaccagtgccagatcctccacttcacggtccccgaggtggaggaggagttcatgtactcctgcgacggggacgagcgcccgctgctggtgaagggcaccctcatcgccatcgaccccttcgacgaccggcgcgaggccgggggcgagagcaccgtcgtgaaccccaagagcgggtcctggaacttcttcgactggttcagcggcctgatgtcctggttcggcgggcccctgaagaccatcctcctgatctgcctgtacgtcgcgctcagcatcggcctgttcttcctgctcatctacctggggcggacgggcctgtccaagatgtggctcgccgccaccaagaaggccagctga

SEQ ID NO: 12820 - RNA, 3480 nt, synthetic construct
  misc_feature 1..3480: note = derived and/or modified CDS sequence (opt1) from RVFV(T-46 (228113))__DQ380199.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccaaggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcatcgccatcatctgcctggccgtcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctgggcaaccccgccccgatcccccgccacgcgcccatcccccggtactccacctacctcatgctgctgctcatcgtgagctacgcctccgcctgcagcgagctgatccaggcctccagccgcatcaccacgtgctccaccgagggggtgaacaccaagtgccggctgagcggcaccgcgctgatccgcgccgggtccgtcggcgccgaggcctgcctcatgctgaagggggtgaaggaggaccagacgaagttcctgaagatcaagaccgtgagctccgagctcagctgccgggagggccagtcctactggaccggcagcttcagcccgaagtgcctgtccagccgccggtgccacctggtcggggagtgccacgtgaaccgctgcctctcctggcgggacaacgagaccagcgccgagttctccttcgtgggcgagagcacgaccatgcgcgagaacaagtgcttcgagcagtgcgggggctgggggtgcggctgcttcaacgtcaacccctcctgcctgttcgtgcacacctacctgcagagcgtgcggaaggaggcgctccgcgtcttcaactgcatcgactgggtgcacaagctgaccctggagatcaccgacttcgacggctccgtgagcacgatcgacctcggggcctccagctcccggttcaccaactggggcagcgtctccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtgctgtccgcccacgagagctgcctgcgcgcgcccaacctcatctcctacaagcccatgatcgaccagctggagtgcaccaccaacctgatcgaccccttcgtcgtgttcgagcggggcagcctcccgcagacgcgcaacgacaagaccttcgccgcctccaaggggaaccggggcgtgcaggccttcagcaaggggtccgtccaggccgacctgaccctgatgttcgacaacttcgaggtggacttcgtgggcgcggccgtcagctgcgacgccgccttcctcaacctgaccggctgctactcctgcaacgcgggggcccgcgtgtgcctgagcatcacgtccaccggcaccgggagcctctccgcccacaacaaggacggcagcctgcacatcgtgctgccctccgagaacggcaccaaggaccagtgccagatcctccacttcacggtccccgaggtggaggaggagttcatgtacagctgcgacggggacgagcgccccctgctggtgaagggcaccctcatcgccatcgacccgttcgacgaccggcgcgaggccgggggcgagagcaccgtcgtgaaccccaagtccgggagctggaacttcttcgactggttctccggcctgatgagctggttcggcgggcccctgaagaccatcctcctgatctgcctgtacgtcgcgctctccatcggcctgttcttcctgctcatctacctggggcggacgggcctgagcaagatgtggctcgccgccaccaagaaggcctcctga

SEQ ID NO: 12821 - RNA, 3480 nt, synthetic construct
  misc_feature 1..3480: note = derived and/or modified CDS sequence (opt1) from RVFV(OS-3)__DQ380184.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcgcaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccggggtggtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtggtgttcgtcttctccagcgtggccatcatctgcctggccatcctgtacaaggtgctcaagtgcctgaagatcgcgccccgcaaggtcctgaaccccctcatgtggatcaccgccttcatccggtgggtgtacaagaagatggtggcccgcgtcgccgacaacatcaaccaggtgaaccgggagatcggctggatggagggcgggcagctggccctgggcaaccccgcgccgatcccccgccacgcccccatcccccgctactccacctacctcatgctgctgctcatcgtgagctacgcctccgcctgcagcgagctgatccaggcgtccagccggatcaccacgtgctccaccgagggggtcaacaccaagtgccgcctgagcggcaccgccctgatccgggccgggtccgtgggcgccgaggcctgcctcatgctgaagggggtgaaggaggaccagacgaagttcctgaagatcaagaccgtcagctccgagctcagctgccgcgagggccagtcctactggaccggcagcttcagcccgaagtgcctgtccagccggcgctgccacctggtgggggagtgccacgtgaaccggtgcctctcctggcgcgacaacgagaccagcgcggagttctccttcgtcggcgagagcacgaccatgcgggagaacaagtgcttcgagcagtgcgggggctgggggtgcggctgcttcaacgtgaacccctcctgcctgttcgtgcacacctacctgcagagcgtccgcaaggaggccctccgggtgttcaactgcatcgactgggtgcacaagctgaccctggagatcaccgacttcgacggctccgtcagcacgatcgacctcggggcctccagctcccgcttcaccaactggggcagcgtgtccctgagcctggacgccgaggggatctccggcagcaactccttcagcttcatcgagagccccgggaagggctacgccatcgtggacgagcccttctccgagatcccgcggcagggcttcctcggggagatccgctgcaacagcgagtccagcgtcctgtccgcgcacgagagctgcctgcgggcccccaacctcatctcctacaagcccatgatcgaccagctggagtgcaccaccaacctgatcgaccccttcgtggtgttcgagcgcggcagcctcccgcagacgcggaacgacaagaccttcgccgcctccaaggggaaccgcggcgtccaggccttcagcaaggggtccgtgcaggcggacctgaccctgatgttcgacaacttcgaggtggacttcgtcggcgccgccgtgagctgcgacgccgcgttcctcaacctgaccggctgctactcctgcaacgccggggcccgggtgtgcctgagcatcacgtccaccggcaccgggaccctcagcgcccacaacaaggacggctccctgcacatcgtcctgcccagcgagaacggcacgaaggaccagtgccagatcctccacttcaccgtgcccgaggtggaggaggagttcatgtactcctgcgacggggacgagcgccccctgctggtcaagggcaccctcatcgccatcgacccgttcgacgaccgccgggaggccgggggcgagagcaccgtggtcaaccccaagagcgggtcctggaacttcttcgactggttcagcggcctgatgtcctggttcggcgggcccctgaagacgatcctcctgatctgcctgtacgtggccctcagcatcggcctgttcttcctgctcatctacctggggcgcaccggcctgtccaagatgtggctcgccgccaccaagaaggccagctga

SEQ ID NO: 12822 - RNA, 3480 nt, synthetic construct
  misc_feature 1..3480: note = derived and/or modified CDS sequence (opt1) from RVFV(Sudan 86-2010)__JQ820489.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtggtgttcgtcttctccagcatcgccatcatctgcctggccatcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggtgctgggcaaccccgccccgatcccccgccacgcgcccatcccccggtactccacctacctcatgctgctgctcatcgtgagctacgcctccgcctgcagcgagctgatccaggcctccagccgcatcaccacgtgctccaccgagggggtcaacaccaagtgccggctgagcggcaccgcgctgatccgcgccgggtccgtgggcgccgaggcctgcctcatgctgaagggggtgaaggaggaccagacgaagttcctgaagatcaagaccgtcagctccgagctcagctgccgggagggccagtcctactggaccggcagcttcagcccgaagtgcctgtccagccgccggtgccacctggtgggggagtgccacgtgaaccgctgcctctcctggcgggacaacgagaccagcgccgagttctccttcgtcggcgagagcacgaccatgcgcgagaacaagtgcttcgagcagtgcgggggctgggggtgcggctgcttcaacgtgaacccctcctgcctgttcgtgcacacctacctgcagagcgtccggaaggaggcgctccgcgtgttcaactgcatcgactgggtgcacaagctgaccctggagatcaccgacttcgacggctccgtcagcacgatcgacctcggggcctccagctcccggttcaccaactggggcagcgtgtccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtcctgtccgcccacgagagctgcctgcgcgcgcccaacctcatctcctacaagcccatgatcgaccagctggagtgcaccaccaacctgatcgaccccttcgtgatcttcgagcggggcagcctcccgcagacgcgcaacgacaagaccttcgccgcctccaaggggaaccggggcgtgcaggccttcagcaaggggtccgtccaggccgacctgaccctgatgttcgacaacttcgaggtggacttcgtgggcgcggccgtcagctgcgacgccgccttcctcaacctgaccggctgctactcctgcaacgcgggggcccgcgtgtgcctgagcatcacgtccaccggcaccgggaccctcagcgcccacaacaaggacggctccctgcacatcgtgctgcccagcgagaacggcacgaaggaccagtgccagatcctccacttcaccgtccccgaggtggaggaggagttcatgtactcctgcgacggggacgagcgccccctgctggtgaagggcaccctcatcgccatcgacccgttcgacgaccggcgcgaggccgggggcgagagcaccgtcgtgaaccccaagagcgggtcctggaacttcttcgactggttcagcggcctgatgtcctggttcggcgggcccctgaagacgatcctcctgatctgcctgtacgtcgcgctcagcatcggcctgttcttcctgctcatctacctggggcggaccggcctgtccaagatgtggctcgccgccaccaagaaggccagctga

SEQ ID NO: 12823 - RNA, 3480 nt, synthetic construct
  misc_feature 1..3480: note = derived and/or modified CDS sequence (opt1) from RVFV(Sudan 28-2010)__JQ820491.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtggtgttcgtcttctccagcatcgccatcatctgcctggccatcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggtgctgggcaaccccgccccgatcccccgccacgcgcccatcccccggtactccacctacctcatgctgctgctcatcgtgagctacgcctccgcctgcagcgagctgatccaggcctccagccgcatcaccacgtgctccaccgagggggtcaacaccaagtgccggctgagcggcaccgcgctgatccgcgccgggtccgtgggcgccgaggcctgcctcatgctgaagggggtgaaggaggaccagacgaagttcctgaagatcaagaccgtcagctccgagctcagctgccgggagggccagtcctactggaccggcagcttcagcccgaagtgcctgtccagccgccggtgccacctggtgggggagtgccacgtgaaccgctgcctctcctggcgggacaacgagaccagcgccgagttctccttcgtcggcgagagcacgaccatgcgcgagaacaagtgcttcgagcagtgcgggggctgggggtgcggctgcttcaacgtgaacccctcctgcctgttcgtgcacacctacctgcagagcgtccggaaggaggcgctccgcgtgttcaactgcatcgactgggtgcacaagctgaccctggagatcaccgacttcgacggctccgtcagcacgatcgacctcggggcctccagctcccggttcaccaactggggcagcgtgtccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtcctgtccgcccacgagagctgcctgcgcgcgcccaacctcatctcctacaagcccatgatcgaccagctggagtgcaccaccaacctgatcgaccccttcgtggtgttcgagcggggcagcctcccgcagacgcgcaacgacaagaccttcgccgcctccaaggggaaccggggcgtccaggccttcagcaaggggtccgtgcaggccgacctgaccctgatgttcgacaacttcgaggtggacttcgtcggcgcggccgtgagctgcgacgccgccttcctcaacctgaccggctgctactcctgcaacgcgggggcccgcgtgtgcctgagcatcacgtccaccggcaccgggaccctcagcgcccacaacaaggacggctccctgcacatcgtcctgcccagcgagaacggcacgaaggaccagtgccagatcctccacttcaccgtgcccgaggtggaggaggagttcatgtactcctgcgacggggacgagcgccccctgctggtcaagggcaccctcatcgccatcgacccgttcgacgaccggcgcgaggccgggggcgagagcaccgtggtcaaccccaagagcgggtcctggaacttcttcgactggttcagcggcctgatgtcctggttcggcgggcccctgaagacgatcctcctgatctgcctgtacgtggtgctcagcatcggcctgttcttcctgctcatctacctggggcggaccggcctgtccaagatgtggctcgcggccaccaagaaggccagctga

SEQ ID NO: 12824 - RNA, 3480 nt, synthetic construct
  misc_feature 1..3480: note = derived and/or modified CDS sequence (opt1) from RVFV(2007004194)__EU574031.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgtccaacgacggcaagatggccagcgtgaagtgcccgcccaagtacgagctgacggaggactgcaacttctgccgccagatgaccggggcctccctcaagaagggcagctaccccctgcaggacctgttctgccagtccagcgaggacgacgggtccaagctcaagaccaagatgaagggcgtctgcgaggtgggcgtgcaggccctgaagaagtgcgacgggcagctgagcaccgcccacgaggtcgtgcccttcgcggtgttcaagaacagcaagaaggtctacctcgacaagctggacctgaagacggaggagaacctcctgcccgactccttcgtgtgcttcgagcacaagggccagtacaaggggaccatggacagcggccagaccaagcgggagctgaagtccttcgacatcagccagtgccccaagatcgggggccacggctccaagaagtgcaccggggacgccgccttctgcagcgcctacgagtgcacggcccagtacgcgaacgcctactgctcccacgccaacggcagcgggatcgtgcagatccaggtctccggcgtgtggaagaagcccctctgcgtggggtacgagcgcgtcgtggtcaagcgggagctgagcgccaagccgatccagcgcgtggagccctgcacgacctgcatcaccaagtgcgagccccacggcctggtggtccggtccaccggcttcaagatcagctccgcggtggcctgcgccagcggggtgtgcgtcaccggctcccagagcccctccaccgagatcaccctcaagtacccggggatcagccagtccagcggcggggacatcggcgtgcacatggcccacgacgaccagagcgtgtccagcaagatcgtcgcccactgcccgccccaggacccctgcctggtgcacggctgcatcgtgtgcgcgcacgggctgatcaactaccagtgccacacggccctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggtgctgggcaaccccgccccgatcccccgccacgcgcccatcccccggtacagcacctacctcatgctgctgctcatcgtgtcctacgccagcgcctgctccgagctgatccaggccagctcccgcatcaccacgtgcagcaccgagggggtcaacaccaagtgccggctgtccggcaccgcgctgatccgcgccgggagcgtgggcgccgaggcctgcctcatgctgaagggggtgaaggaggaccagacgaagttcctgaagatcaagaccgtctccagcgagctctcctgccgggagggccagagctactggaccggcagcttctccccgaagtgcctgagctcccgccggtgccacctggtgggggagtgccacgtgaaccgctgcctcagctggcgggacaacgagacctccgccgagttcagcttcgtcggcgagtccacgaccatgcgcgagaacaagtgcttcgagcagtgcgggggctgggggtgcggctgcttcaacgtgaaccccagctgcctgttcgtgcacacctacctgcagtccgtccggaaggaggcgctccgcgtgttcaactgcatcgactgggtgcacaagctgaccctggagatcaccgacttcgacggcagcgtctccacgatcgacctcggggccagctccagccggttcaccaactggggctccgtgagcctgtccctggacgccgaggggatcagcggctccaacagcttcagcttcatcgagtcccccgggaagggctacgccatcgtggacgagcccttcagcgagatcccgcgccagggcttcctcggggagatccggtgcaactccgagagctccgtcctgagcgcccacgagtcctgcctgcgcgcgcccaacctcatcagctacaagcccatgatcgaccagctggagtgcaccaccaacctgatcgaccccttcgtggtgttcgagcggggctccctcccgcagacgcgcaacgacaagaccttcgccgccagcaaggggaaccggggcgtccaggccttctccaaggggagcgtgcaggccgacctgaccctgatgttcgacaacttcgaggtggacttcgtcggcgcggccgtgtcctgcgacgccgccttcctcaacctgaccggctgctacagctgcaacgcgggggcccgcgtgtgcctgtccatcacgagcaccggcaccgggaccctctccgcccacaacaaggacggcagcctgcacatcgtcctgccctccgagaacggcacgaaggaccagtgccagatcctccacttcaccgtgcccgaggtggaggaggagttcatgtacagctgcgacggggacgagcgccccctgctggtcaagggcaccctcatcgccatcgacccgttcgacgaccggcgcgaggccgggggcgagagcaccgtggtcaaccccaagtccgggagctggaacttcttcgactggttctccggcctgatgagctggttcggcgggcccctgaagacgatcctcctgatctgcctgtacgtggcgctctccatcggcctgttcttcctgctcatctacctggggcggaccggcctgagcaagatgtggctcgccgccaccaagaaggcctcctga

SEQ ID NO: 12825 - RNA, 3480 nt, synthetic construct
  misc_feature 1..3480: note = derived and/or modified CDS sequence (opt1) from RVFV(73HB1230)__DQ380221.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcaggtcggccgcgagacgatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctcctggagaaggggaagttcccgctgttccagtcctacgcgcaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagaaggagctgaagtccttcgacatctcccagtgccccaagatcgggggccacggcagcaagaagtgcaccggggacgccgccttctgctccgcctacgagtgcaccgcccagtacgccaacgcctactgcagccacgccaacggcagcgggatcgtgcagatccaggtgagcggcgtgtggaagaagcccctgtgcgtggggtacgagcgggtcgtggtcaagcgcgagctgtccgccaagccgatccagcgggtggagccctgcacgacctgcatcaccaagtgcgagccccacggcctggtggtccgcagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtggtgttcgtcttctccagcatcgccatcatctgcctggccatcctgtaccgggtgctcaagtgcctgaagatcgcgccccgcaaggtgctgaaccccctcatgtggatcaccgccttcatccggtgggtctacaagaagatggtggcccgcgtggccgacaacatcaaccaggtcaaccgggagatcggctggatggagggcgggcagctggtgctgggcaaccccgccccgatcccccgccacgcgcccatcccccgctactccacctacctcatgctgctgctcatcgtgagctacgcctccgcctgcagcgagctgatccaggcctccagccggatcaccacgtgctccaccgagggggtcaacaccaagtgccgcctgagcggcaccgcgctgatccgggccgggtccgtgggcgccgaggcctgcctcatgctgaagggggtgaaggaggaccagacgaagttcctgaagatcaagaccgtcagctccgagctcagctgccgcgagggccagtcctactggaccggcagcttcagcccgaagtgcctgtccagccggcgctgccacctggtgggggagtgccacgtgaaccggtgcctctcctggcgcgacaacgagaccagcgccgagttctccttcgtcggcgagagcacgatcatgcgggagaacaagtgcttcgagcagtgcgggggctgggggtgcggctgcttcaacgtgaacccctcctgcctgttcgtgcacacctacctgcagagcgtccgcaaggaggcgctccgggtgttcaactgcatcgactgggtgcacaagctgaccctggagatcaccgacttcgacggctccgtcagcaccatcgacctcggggcctccagctcccgcttcacgaactggggcagcgtgtccctgagcctggacgccgaggggatctccggcagcaactccttcagcttcatcgagagccccgggaagggctacgccatcgtggacgagcccttctccgagatcccgcggcagggcttcctcggggagatccgctgcaacagcgagtccagcgtcctgtccgcccacgagagctgcctgcgggcgcccaacctcatctcctacaagcccatgatcgaccagctggagtgcaccaccaacctgatcgaccccttcgtggtgttcgagcgcggcagcctcccgcagacccggaacgacaagacgttcgccgcctccaaggggaaccgcggcgtccaggccttcagcaaggggtccgtgcaggccgacctgaccctgatgttcgacaacttcgaggtggacttcgtcggcgcggccgtgagctgcgacgccgccttcctcaacctgaccggctgctactcctgcaacgcgggggcccgggtgtgcctgagcatcacctccacgggcaccgggaccctcagcgcccacaacaaggacggctccctgcacatcgtcctgcccagcgagaacggcaccaaggaccagtgccagatcctccacttcacggtgcccgaggtggaggaggagttcatgtactcctgcgacggggacgagcgccccctgctggtcaagggcaccctcatcgccatcgacccgttcgacgaccgccgggaggccgggggcgagagcaccgtggtcaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcgcacgggcctgtccaagatgtggctcgccgccaccaagaaggccagctga

SEQ ID NO: 12826 - RNA, 3480 nt, synthetic construct
  misc_feature 1..3480: note = derived and/or modified CDS sequence (opt1) from RVFV(1260/78)__DQ380214.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcatcgccatcatctgcctggccatcctgcaccgcgtcctcaagtgcctgaagatcgcgccccggaaggtgctgaaccccctcatgtggatcaccgccttcatccgctgggtgtacaagaagatggtcgcccgggtggccgacaacatcaaccaggtgaaccgcgagatcggctggatggagggcgggcagctggtcctgggcaaccccgccccgatcccccgccacgcgcccatcccccggtactccacctacctcatgctgctgctcatcgtgagctacgcctccgcctgcagcgagctgatccaggcctccagccgcatcaccacgtgctccaccgagggggtgaacaccaagtgccggctgagcggcaccgcgctgatccgcgccgggtccgtcggcgccgaggcctgcctcatgctgaagggggtgaaggacgaccagacgaagttcctgaagatcaagaccgtgagctccgagctcagctgccgggagggccagtcctactggaccggcagcttcagcccgaagtgcctgtccagccgccggtgccacctggtcggggagtgccacgtgaaccgctgcctctcctggcgggacaacgagaccagcgccgagttctccttcgtgggcgagagcacgaccatgcgcgagaacaagtgcttcgagcagtgcgggggctgggggtgcggctgcttcaacgtcaacccctcctgcctgttcgtgcacacctacctgcagagcgtgcggaaggaggcgctccgcgtcttcaactgcatcgactgggtgcacaagctgaccctggagatcaccgacttcgacggctccgtgagcacgatcgacctcggggcctccagctcccggttcaccaactggggcagcgtctccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtgctgtccgcccacgagagctgcctgcgcgcgcccaacctcatctcctacaagcccatgatcgaccagctggagtgcaccaccaacctgatcgaccccttcgtcgtgttcgagcggggcagcctcccgcagacgcgcaacgacaagaccttcgccgcctccaaggggaaccggggcgtgcaggccttcagcaaggggtccgtccaggccgacctgaccctgatgttcgacaacttcgaggtggacttcgtgggcgcggccgtcagctgcgacgccgccttcctcaacctgaccggctgctactcctgcaacgcgggggcccgcgtgtgcctgagcatcacgtccaccggcaccgggaccctcagcgcccacaacaaggacggctccctgcacatcgtgctgcccagcgagaacggcacgaaggaccagtgccagatcctccacttcaccgtccccgaggtggaggaggagttcatgtactcctgcgacggggacgagcgccccctgctggtgaagggcaccctcatcgccatcgacccgttcgacgaccggcgcgaggccgggggcgagagcaccgtcgtgaaccccaagagcgggtcctggaacttcttcgactggttcagcggcctgatgtcctggttcggcgggcccctgaagacgatcctcctgatctgcctgtacgtcgcgctcagcatcggcctgttcttcctgctcatctacctggggcggaccggcctgtccaagatgtggctcgccgccaccaagaaggccagctga

SEQ ID NO: 12827 - RNA, 3480 nt, synthetic construct
  misc_feature 1..3480: note = derived and/or modified CDS sequence (opt1) from RVFV(ZC-3349)__DQ380207.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcgcaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccaggccgtgagcagcaagatcgtggcgcactgcccgccccaggacccctgcctggtccacggctgcatcgtgtgcgcccacgggctgatcaactaccagtgccacacggccctctccgccttcgtggtcgtgttcgtgttcagctccatcgccatcatctgcctggcgatcctgtaccgcgtcctcaagtgcctgaagatcgcgccccggaaggtgctgaaccccctcatgtggatcaccgccttcatccgctggatctacaagaagatggtggcccgggtcgccgacaacatcaaccacgtgaaccgcgagatcggctggatggagggcgggcagctggtgctgggcaaccccgccccgatcccccgccacgcccccatcccccggtacagcacctacctcatgctgctgctcatcgtctcctacgccagcgcctgctccgagctgatccaggcgagctcccgcatcaccacgtgcagcaccgagggggtgaacaccaagtgccggctgtccggcaccgccctgatccgcgccgggagcgtgggcgccgaggcctgcctcatgctgaagggggtcaaggaggaccagacgaagttcctgaagatcaagaccgtgtccagcgagctctcctgccgggagggccagagctactggaccggctccttcagcccgaagtgcctgagctcccgccggtgccacctggtgggggagtgccacgtcaaccgctgcctcagctggcgggacaacgagacctccgcggagttcagcttcgtgggcgagtccacgaccatgcgcgagaacaagtgcttcgagcagtgcgggggctgggggtgcggctgcttcaacgtgaaccccagctgcctgttcgtccacacctacctgcagtccgtgcggaaggaggccctccgcgtgttcaactgcatcgactgggtccacaagctgaccctggagatcaccgacttcgacggcagcgtgtccacgatcgacctcggggccagctccagccggttcaccaactggggctccgtgagcctgtccctggacgccgaggggatcagcggctccaacagcttctccttcatcgagagccccgggaagggctacgccatcgtcgacgagcccttcagcgagatcccgcgccagggcttcctcggggagatccggtgcaactccgagagctccgtgctgagcgcgcacgagtcctgcctgaaggcccccaacctcatcagctacaagcccatgatcgaccagctggagtgcaccaccaacctgatcgaccccttcgtggtcttcgagcgcggctccctcccgcagacgcggaacgacaagaccttcgccgccagcaaggggaaccgcggcgtgcaggccttctccaaggggagcgtgcaggcggacctgaccctgatgttcgacaacttcgaggtcgacttcgtgggcgccgccgtgtcctgcgacgccgcgttcctcaacctgaccggctgctacagctgcaacgccggggcccgggtctgcctgtccatcacgagcaccggcaccgggtccctcagcgcccacaacaaggacggctccctgcacatcgtgctgcccagcgagaacggcaccaaggaccagtgccagatcctccacttcacggtgcccgaggtcgaggaggagttcatgtactcctgcgacggggacgagcgccccctgctggtgaagggcaccctcatcgccatcgacccgttcgacgaccgccgggaggccgggggcgagagcaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcgcacgggcctgtccaagatgtggctcgccgccaccaagaaggccagctga

SEQ ID NO: 12828 - RNA, 3480 nt, synthetic construct
  misc_feature 1..3480: note = derived and/or modified CDS sequence (opt1) from RVFV(Sudan 85-2010)__JQ820488.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtggtgttcgtcttctccagcatcgccatcatctgcctggccatcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggtgctgggcaaccccgccccgatcccccgccacgcgcccatcccccggtactccacctacctcatgctgctgctcatcgtgagctacgcctccgcctgcagcgagctgatccaggcctccagccgcatcaccacgtgctccaccgagggggtcaacaccaagtgccggctgagcggcaccgcgctgatccgcgccgggtccgtgggcgccgaggcctgcctcatgctgaagggggtgaaggaggaccagacgaagttcctgaagatcaagaccgtcagctccgagctcagctgccgggagggccagtcctactggaccggcagcttcagcccgaagtgcctgtccagccgccggtgccacctggtgggggagtgccacgtgaaccgctgcctctcctggcgggacaacgagaccagcgccgagttctccttcgtcggcgagagcacgaccatgcgcgagaacaagtgcttcgagcagtgcgggggctgggggtgcggctgcttcaacgtgaacccctcctgcctgttcgtgcacacctacctgcagagcgtccggaaggaggcgctccgcgtgttcaactgcatcgactgggtgcacaagctgaccctggagatcaccgacttcgacggctccgtcagcacgatcgacctcggggcctccagctcccggttcaccaactggggcagcgtgtccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtcctgtccgcccacgagagctgcctgcgcgcgcccaacctcatctcctacaagcccatgatcgaccagctggagtgcaccaccaacctgatcgaccccttcgtggtgttcgagcggggcagcctcccgcagacgcgcaacgagaagaccttcgccgcctccaaggggaaccggggcgtccaggccttcagcaaggggtccgtgcaggccgacctgaccctgatgttcgacaacttcgaggtggacttcgtcggcgcggccgtgagctgcgacgccgccttcctcaacctgaccggctgctactcctgcaacgcgggggcccgcgtgtgcctgagcatcacgtccaccggcaccgggaccctcagcgcccacaacaaggacggctccctgcacatcgtcctgcccagcgagaacggcacgaaggaccagtgccagatcctccacttcaccgtgcccgaggtggaggaggagttcatgtactcctgcgacggggacgagcgccccctgctggtcaagggcaccctcatcgccatcgacccgttcgacgaccggcgcgaggccgggggcgagagcaccgtggtcaaccccaagagcgggtcctggaacttcttcgactggttcagcggcctgatgtcctggttcggcgggcccctgaagacgatcctcctgatctgcctgtacgtggcgctcagcatcggcctgttcttcctgctcatctacctggggcggaccggcctgtccaagatgtggctcgccgccaccaagaaggccagctga

SEQ ID NO: 12829 - RNA, 3480 nt, synthetic construct
  misc_feature 1..3480: note = derived and/or modified CDS sequence (opt1) from RVFV(2007000324)__JF326195.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcgcaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtgatcttcgtgttctccagcaccgccatcatctgcctggccgtcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggccctgggcaaccccgcgccgatcccccgccacgcccccatcccccggtactccacctacctcatgctgctgctcatcgtgagctacgcctccgcctgcagcgagctgatccaggcgtccagccgcatcacgacctgctccaccgagggggtgaacaccaagtgccggctgagcggcacggccctgatccgcgccgggtccgtcggcgccgaggcctgcctcatgctgaagggggtgaaggaggaccagaccaagttcctgaagatcaagaccgtgagctccgagctcagctgccgggagggccagtcctactggaccggcagcttcagcccgaagtgcctgtccagccgccggtgccacctggtcggggagtgccacgtgaaccgctgcctctcctggcgggacaacgagacgagcgcggagttctccttcgtgggcgagagcaccaccatgcgcgagaacaagtgcttcgagcagtgcgggggctgggggtgcggctgcttcaacgtcaacccctcctgcctgttcgtgcacacctacctgcagagcgtgcggaaggaggccctccgcgtcttcaactgcatcgactgggtgcacaagctgaccctggagatcacggacttcgacggctccgtgagcaccatcgacctcggggcctccagctcccggttcaccaactggggcagcgtctccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtgctgtccgcgcacgagagctgcctgcgcgcccccaacctcgtctcctacaagcccatgatcgaccagctggagtgcaccacgaacctgatcgaccccttcgtggtgttcgagcggggcagcctcccgcagacccgcaacgacaagaccttcgccgcctccaaggggaaccggggcgtccaggccttcagcaaggggtccgtgcaggcggacctgaccctgatgttcgacaacttcgaggtggacttcgtcggcgccgccgtgagctgcgacgccgcgttcctcaacctgacgggctgctactcctgcaacgccggggcccgcgtgtgcctgagcatcacctccaccggcaccgggacgctcagcgcccacaacaaggacggctccctgcacatcgtcctgcccagcgagaacggcaccaaggaccagtgccagatcctccacttcaccgtgcccgaggtggaggaggagttcatgtactcctgcgacggggacgagcgccccctgctggtcaagggcaccctcatcgccatcgacccgttcgacgaccggcgcgaggccgggggcgagagcacggtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggaccggcctgtccaagatgtggctcgccgccaccaagaaggccagctga

SEQ ID NO: 12830 - RNA, 3480 nt, synthetic construct
  misc_feature 1..3480: note = derived and/or modified CDS sequence (opt1) from RVFV(OS-8)__DQ380185.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcgcaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccggggtggtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtggtgttcgtcttctccagcgtggccatcatctgcctggccatcctgtacaaggtgctcaagtgcctgaagatcgcgccccgcaaggtcctgaaccccctcatgtggatcaccgccttcatccggtgggtgtacaagaagatggtggcccgcgtcgccgacaacatcaaccaggtgaaccgggagatcggctggatggagggcgggcagctggccctgggcaaccccgcgccgatcccccgccacgcccccatcccccgctactccacctacctcatgctgctgctcatcgtgagctacgcctccgcctgcagcgagctgatccaggcgtccagccggatcaccacgtgctccaccgagggggtcaacaccaagtgccgcctgagcggcaccgccctgatccgggccgggtccgtgggcgccgaggcctgcctcatgctgaagggggtgaaggaggaccagacgaagttcctgcgcatcaagaccgtcagctccgagctcagctgccgggagggccagtcctactggaccggcagcttcagcccgaagtgcctgtccagccgccggtgccacctggtgggggagtgccacgtgaaccgctgcctctcctggcgggacaacgagaccagcgcggagttctccttcgtcggcgagagcacgaccatgcgcgagaacaagtgcttcgagcagtgcgggggctgggggtgcggctgcttcaacgtgaacccctcctgcctgttcgtgcacacctacctgcagagcgtccggaaggaggccctccgcgtgttcaactgcatcgactgggtgcacaagctgaccctggagatcaccgacttcgacggctccgtcagcacgatcgacctcggggcctccagctcccggttcaccaactggggcagcgtgtccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtcctgtccgcgcacgagagctgcctgcgcgcccccaacctcatctcctacaagcccatgatcgaccagctggagtgcaccaccaacctgatcgaccccttcgtggtgttcgagcggggcagcctcccgcagacgcgcaacgacaagaccttcgccgcctccaaggggaaccggggcgtccaggccttcagcaaggggtccgtgcaggcggacctgaccctgatgttcgacaacttcgaggtggacttcgtcggcgccgccgtgagctgcgacgccgcgttcctcaacctgtccggctgctacagctgcaacgccggggcccgcgtgtgcctgtccatcaccagcacgggcaccgggaccctctccgcccacaacaaggacggcagcctgcacatcgtcctgccctccgagaacggcaccaaggaccagtgccagatcctccacttcacggtgcccgaggtggaggaggagttcatgtacagctgcgacggggacgagcgccccctgctggtcaagggcaccctcatcgccatcgacccgttcgacgaccggcgcgaggccgggggcgagagcaccgtggtcaaccccaagtccgggagctggaacttcttcgactggttctccggcctgatgagctggttcggcgggcccctgaagaccatcctcctgatctgcctgtacgtggccctctccatcggcctgttcttcctgctcatctacctggggcggacgggcctgagcaagatgtggctcgccgccaccaagaaggcctcctga

SEQ ID NO: 12831 - RNA, 3480 nt, synthetic construct
  misc_feature 1..3480: note = derived and/or modified CDS sequence (opt1) from RVFV(ZINGA J83 R1)__KU978776.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgcctcatgaccggggccagcctgaagaagggctcctaccccctgcaggacctcttctgccagagctccgaggacgacgggagcaagctgaagaccaagatgaagggcgtgtgcgaggtcggcgtgcaggccctgaagaagtgcgacgggcagctctccaccgcccacgaggtggtccccttcgcggtgttcaagaacagcaagaaggtgtacctggacaagctggacctcaagacggaggagaacctgctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctcgtggtgcggagcaccggcttcaagatctccagcgcggtcgcctgcgcctccggggtgtgcgtgaccggcagccagtcccccagcaccgagatcaccctgaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctcatcaactaccagtgccacacggccctgagcgccttcgtggtcgtgttcgtgttctccagcatcgccatcatctgcctggccatcctctaccgcgtcctgaagtgcctgaagatcgcgccccggaaggtgctcaaccccctgatgtggatcaccgccttcatccgctgggtgtaccggaagatggtcgcccgcgtggccgacaacatcaaccaggtgaaccgcgagatcggctggatggagggcgggcagctggtcctcggcaaccccgccccgatcccccggcacgtgcccatcccccgctactccacctacctgatgctgctcctgatcgtgagctacgcgtccgcctgcagcgagctgatccaggcctccagccggatcaccacgtgctccaccgagggggtcaacaccaagtgccgcctgagcggcaccgccctcatccgggcggggtccgtgggcgccgaggcctgcctgatgctgaagggggtgaaggaggaccagacgaagttcctcaagatcaagaccgtcagctccgagctgagctgccgcgagggccagtcctactggaccggcagcttcagcccgaagtgcctgtccagccggcgctgccacctcgtgggggagtgccacgtgaaccggtgcctgtcctggcgcgacaacgagaccagcgccgagttctccttcgtcggcgagagcacgaccatgcgggagaacaagtgcttcgagcagtgcgggggctgggggtgcggctgcttcaacgtgaacccctcctgcctgttcgtgcacacctacctccagagcgtccgcaaggaggccctgcgggtgttcaactgcatcgactgggtgcacaagctgaccctcgagatcaccgacttcgacggctccgtcagcacgatcgacctgggggcgtccagctcccgcttcaccaactggggcagcgtgtccctgagcctcgacgccgaggggatctccggcagcaactccttcagcttcatcgagagccccgggaagggctacgccatcgtggacgagcccttctccgagatcccgcggcagggcttcctgggggagatccgctgcaacagcgagtccagcgtcctgtccgcccacgagagctgcctccgggcccccaacctgatctcctacaagcccatgatcgaccagctggagtgcaccaccaacctcatcgaccccttcgtggtgttcgagcgcggcagcctgccgcagacgcggaacgacaagaccttcgcggcctccaaggggaaccgcggcgtccaggccttcagcaaggggtccgtgcaggccgacctgaccctcatgttcgacaacttcgaggtggacttcgtcggcgccgcggtgagctgcgacgccgccttcctgaacctgaccggctgctactcctgcaacgccggggcgcgcgtgtgcctcagcatcacgtccaccggcaccgggaccctgagcgcccacaacaaggacggctccctgcacatcgtcctccccagcgagaacggcacgaaggaccagtgccagatcctgcacttcaccgtgcccgaggtggaggaggagttcatgtactcctgcgacggggacgagcggcccctgctcgtccgcggcaccctgatcgccatcgacccgttcgacgaccggcgcgaggccgggggcgagagcaccgtggtcaaccccaagagcgggtcctggaacttcttcgactggttcagcggcctgatgtcctggttcggcgggcccctcaagacgatcctgctgatctgcctctacgtggccctgagcatcggcctgttcttcctcctgatctacctggggcggaccggcctctccaagatgtggctggcggccaccaagaaggccagctga

SEQ ID NO: 12832 - RNA, 3480 nt, synthetic construct
  misc_feature 1..3480: note = derived and/or modified CDS sequence (opt1) from RVFV(2007000253)__JF326192.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtgatcttcgtgttctccagcaccgccatcatctgcctggccgtcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggccctgggcaaccccgcgccgatcccccgccacgcccccatcccccggtactccacctacctcatgctgctgctcatcgtgagctacgcctccgcctgcagcgagctgatccaggcgtccagccgcatcacgacctgctccaccgagggggtgaacaccaagtgccggctgagcggcacggccctgatccgcgccgggtccgccggcgccgaggcgtgcctcatgctgaagggggtcaaggaggaccagaccaagttcctgaagatcaagaccgtgagctccgagctcagctgccgggagggccagtcctactggaccggcagcttcagcccgaagtgcctgtccagccgccggtgccacctggtgggggagtgccacgtcaaccgctgcctctcctggcgggacaacgagacgagcgccgagttctccttcgtgggcgagagcaccaccatgcgcgagaacaagtgcttcgagcagtgcgggggctgggggtgcggctgcttcaacgtgaacccctcctgcctgttcgtccacacctacctgcagagcgtgcggaaggaggccctccgcgtgttcaactgcatcgactgggtccacaagctgaccctggagatcacggacttcgacggctccgtgagcaccatcgacctcggggcctccagctcccggttcaccaactggggcagcgtgtccctgagcctggacgccgaggggatctccggcagcaactccttcagcttcatcgagagccccgggaagggctacgcgatcgtcgacgagcccttctccgagatcccgcgccagggcttcctcggggagatccggtgcaacagcgagtccagcgtgctgtccgcccacgagagctgcctgcgcgcccccaacctcgtgtcctacaagcccatgatcgaccagctggagtgcaccacgaacctgatcgaccccttcgtcgtgttcgagcggggcagcctcccgcagacccgcaacgacaagaccttcgccgcctccaaggggaaccggggcgtgcaggcgttcagcaaggggtccgtccaggccgacctgaccctgatgttcgacaacttcgaggtggacttcgtgggcgccgccgtcagctgcgacgcggccttcctcaacctgacgggctgctactcctgcaacgccggggcccgcgtgtgcctgagcatcacctccaccggcaccgggacgctcagcgcccacaacaaggacggctccctgcacatcgtgctgcccagcgagaacggcaccaaggaccagtgccagatcctccacttcaccgtccccgaggtggaggaggagttcatgtactcctgcgacggggacgagcgccccctgctggtgaagggcaccctcatcgcgatcgacccgttcgacgaccggcgcgaggccgggggcgagagcacggtcgtgaaccccaagagcgggtcctggaacttcttcgactggttcagcggcctgatgtcctggttcggcgggcccctgaagaccatcctcctgatctgcctgtacgtcgccctcagcatcggcctgttcttcctgctcatctacctggggcggaccggcctgtccaagatgtggctcgccgccaccaagaaggcgagctga

SEQ ID NO: 12833 - RNA, 3480 nt, synthetic construct
  misc_feature 1..3480: note = derived and/or modified CDS sequence (opt1) from RVFV(MP12)__Z30318.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcaagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctcctggagaaggggaagttcccgctgttccagtcctacgcccaccaccggaccctcctggaggccgtgcacgacaccatcatcgccaaggccgacccgcccagctgcgacctgctctccgcccacggcaacccctgcatgaaggagaagctggtcatgaagacccactgccccaacgactaccagagcgcgcaccacctgaacaacgacggcaagatggcctccgtgaagtgcccgcccaagtacgagctcacggaggactgcaacttctgccgccagatgaccggggccagcctgaagaagggctcctaccccctgcaggacctcttctgccagagctccgaggacgacgggagcaagctgaagaccaagatgaagggcgtgtgcgaggtcggcgtgcaggccctgaagaagtgcgacgggcagctctccaccgcccacgaggtggtccccttcgcggtgttcaagaacagcaagaaggtgtacctggacaagctggacctcaagacggaggagaacctgctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctcgtggtgcggagcaccggcttcaagatctccagcgcggtcgcctgcgcctccggggtgtgcgtgaccggcagccagtcccccagcaccgagatcaccctgaagtacccggggatctcccagagctccggcggggacatcggcgtccacatggcccacgacgaccagagcgtgagctccaagatcgtggcccactgcccgccccaggacccctgcctggtccacgactgcatcgtgtgcgcgcacggcctcatcaactaccagtgccacacggccctgagcgccttcgtggtcgtgttcgtgttctccagcatcgccatcatctgcctggccatcctctaccgcgtcctgaagtgcctgaagatcgcgccccggaaggtgctcaaccccctgatgtggatcaccgccttcatccgctggatctacaagaagatggtggcccgggtcgcccacaacatcaaccaggtgaaccgcgagatcgggtggatggagggcgggcagctggtgctcggcaaccccgccccgatcccccgccacgcgcccatcccccggtactccacctacctgatgctgctcctgatcgtcagctacgcctccgcctgcagcgagctgatccaggcctccagccgcatcaccacgtgctccaccgagggcgtgaacaccaagtgccggctgagcgggaccgcgctcatccgcgccggctccgtgggggccgaggcctgcctgatgctgaagggcgtcaaggaggaccagacgaagttcctcaagctgaagaccgtgagctccgagctgagctgccgggaggggcagtcctactggaccggcagcttcagcccgaagtgcctctccagccgccggtgccacctggtgggcgagtgccacgtcaaccgctgcctgtcctggcgggacaacgagaccagcgccgagttctccttcgtgggggagagcacgaccatgcgcgagaacaagtgcttcgagcagtgcggcgggtggggctgcgggtgcttcaacgtgaacccctcctgcctcttcgtccacacctacctgcagagcgtgcggaaggaggcgctgcgcgtgttcaactgcatcgactgggtccacaagctcaccctggagatcaccgacttcgacggctccgtgagcacgatcgacctgggcgcctccagctcccggttcaccaactgggggagcgtgtccctcagcctggacgccgagggcatctccgggagcaactccttcagcttcatcgagagccccggcaaggggtacgccatcgtcgacgagcccttctccgagatcccgcgccagggcttcctgggcgagatccggtgcaacagcgagtccagcgtgctctccgcccacgagagctgcctgcgcgcgcccaacctgatctcctacaagcccatgatcgaccagctcgagtgcaccaccaacctgatcgaccccttcgtggtcttcgagcgggggagcctgccgcagacgcgcaacgacaagaccttcgccgcctccaagggcaaccgcggggtgcaggccttcagcaagggctccgtgcaggccgacctcaccctgatgttcgacaacttcgaggtcgacttcgtgggggcggccgtgagctgcgacgccgccttcctgaacctcaccggctgctactcctgcaacgcgggcgcccgggtctgcctgagcatcacgtccaccgggaccggcagcctgtccgcccacaacaaggacgggagcctccacatcgtgctgccctccgagaacggcaccaaggaccagtgccagatcctgcacttcacggtgcccgaggtcgaggaggagttcatgtacagctgcgacggcgacgagcgccccctcctggtgaaggggaccctgatcgccatcgacccgttcgacgaccggcgcgaggccggcggggagagcaccgtggtcaaccccaagtccggcagctggaacttcttcgactggttctccgggctcatgagctggttcggcggccccctgaagaccatcctgctcatctgcctgtacgtggcgctgtccatcgggctgttcttcctgctgatctacctcggcgggacgggcctgagcaagatgtggctggccgccaccaagaaggcctcctga

SEQ ID NO: 12834 - RNA, 3480 nt, synthetic construct
  misc_feature 1..3480: note = derived and/or modified CDS sequence (opt1) from RVFV(BIME-01)__KX609032.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcgcaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcgtcgccatcatctgcctggccatcctgtacaaggtgctccgctgcctgaagatcgcgcccaagaaggtgctgaaccccctcatgtggatcaccgccttcatccggtgggtctacaagaagatggtggcccgcgtggccgacaacatcaaccaggtcaaccgggagatcggctggatggagggcgggcagctggccctgggcaaccccgcgccgatcccccgccacgcccccatcccccgctactccacctacctcatgctgctgctcatcatcagctacgcctccgcctgcagcgagctgatccaggcgtccagccggatcaccacgtgctccaccgagggggtgaacaccaagtgccgcctgagcggcaccgccctgatccgggccgggtccgtgggcgccgaggcctgcctcatgctgaagggggtcaaggaggaccagacgaagttcctgaagatcaagaccgtgagctccgagctcagctgccgcgagggccagtcctactggaccggcagcttcagcccgaagtgcctgtccagccggcgctgccacctggtgggggagtgccacgtcaaccggtgcctctcctggcgcgacaacgagaccagcgcggagttctccttcgtgggcgagagcacgaccatgcgggagaacaagtgcttcgagcagtgcgggggctgggggtgcggctgcttcaacgtgaacccctcctgcctgttcgtccacacctacctgcagagcgtgcgcaaggaggccctccgggtgttcaactgcatcgactgggtccacaagctgaccctggagatcaccgacttcgacggctccgtgagcacgatcgacctcggggcctccagctcccgcttcaccaactggggcagcgtgtccctgagcctggacgccgaggggatctccggcagcaactccttcagcttcatcgagagccccgggaagggctacgccatcgtcgacgagcccttctccgagatcccgcggcagggcttcctcggggagatccgctgcaacagcgagtccagcgtgctgtccgcgcacgagagctgcctgcgggcccccaacctcatctcctacaagcccatgatcgaccagctggagtgcaccaccaacctgatcgaccccttcgtggtcttcgagcgcggcagcctcccgcagacgcggaacgacaagaccttcgccgcctccaaggggaaccgcggcgtgcaggccttcagcaaggggtccgtgcaggcggacctgaccctgatgttcgacaacttcgaggtcgacttcgtgggcgccgccgtgagctgcgacgccgcgttcctcaacctgaccggctgctactcctgcaacgccggggcccgggtctgcctgagcatcacgtccaccggcaccgggaccctcagcgcccacaacaaggacggctccctgcacatcgtgctgcccagcgagaacggcacgaaggaccagtgccagatcctccacttcaccgtgcccgaggtcgaggaggagttcatgtactcctgcgacggggacgagcgccccctgctggtgaagggcaccctcatcgccatcgacccgttcgacgaccgccgggaggccgggggcgagagcaccgtggtcaaccccaagagcgggtcctggaacttcttcgactggttcagcggcctgatgtcctggttcggcgggcccctgaagacgatcctcctgatctgcctgtacgtggccctcagcatcggcctgttcttcctgctcatctacctggggcgcaccggcctgtccaagatgtggctcgccgccaccaagaaggccagctga

SEQ ID NO: 12835 - RNA, 3480 nt, synthetic construct
  misc_feature 1..3480: note = derived and/or modified CDS sequence (opt1) from RVFV(200803166)__JF311381.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctgaagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtggtgttcgtcttctccagcatcgccatcatctgcctggccatcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggtgctgggcaaccccgccccgatcccccgccacgcgcccatcccccggtactccacctacctcatgctgctgctcatcgtgagctacgccaccgcctgctccgagctgatccaggccagctcccgcatcacgacctgcagcaccgagggggtcaacaccaagtgccggctgtccggcacggcgctgatccgcgccgggagcgtgggcgccgaggcctgcctcatgctgaagggggtgaaggaggaccagaccaagttcctgaagatcaagaccgtctccagcgagctctcctgccgggagggccagagctactggaccggctccttcagcccgaagtgcctgagctcccgccggtgccacctggtgggggagtgccacgtgaaccgctgcctcagctggcgggacaacgagacgtccgccgagttcagcttcgtcggcgagtccaccaccatgcgcgagaacaagtgcttcgagcagtgcgggggctgggggtgcggctgcttcaacgtgaaccccagctgcctgttcgtgcacacctacctgcagtccgtccggaaggaggcgctccgcgtgttcaactgcatcgactgggtgcacaagctgaccctggagatcacggacttcgacggcagcgtctccaccatcgacctcggggccagctccagccggttcaccaactggggctccgtgagcctgtccctggacgccgaggggatcagcggctccaacagcttctccttcatcgagagccccgggaagggctacgccatcgtggacgagcccttcagcgagatcccgcgccagggcttcctcggggagatccggtgcaactccgagagctccgtcctgagcgcccacgagtcctgcctgcgcgcgcccaacctcatcagctacaagcccatgatcgaccagctggagtgcaccacgaacctgatcgaccccttcgtggtgttcgagcggggctccctcccgcagacccgcaacgacaagaccttcgccgccagcaaggggaaccggggcgtccaggccttctccaaggggagcgtgcaggccgacctgaccctgatgttcgacaacttcgaggtggacttcgtcggcgcggccgtgtcctgcgacgccgccttcctcaacctgacgggctgctacagctgcaacgcgggggcccgcgtgtgcctgtccatcaccagcaccggcaccgggacgctctccgcccacaacaaggacggcagcctgcacgtcgtgctgccctccgagaacggcaccaaggaccagtgccagatcctccacttcaccgtgcccgaggtcgaggaggagttcatgtacagctgcgacggggacgagcgccccctgctggtgaagggcaccctcatcgccatcgacccgttcgacgaccggcgcgaggccgggggcgagtccacggtcgtgaaccccaagagcgggagctggaacttcttcgactggttctccggcctgatgagctggttcggcgggcccctgaagaccatcctcctgatctgcctgtacgtggcgctctccatcggcctgttcttcctgctcatctacctggggcggaccggcctgagcaagatgtggctcgccgccaccaagaaggcctcctga

SEQ ID NO: 12836 - RNA, 3480 nt, synthetic construct
  misc_feature 1..3480: note = derived and/or modified CDS sequence (opt1) from RVFV(Kenya 83 (21445))__DQ380198.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaagaacccggagaacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcgcaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcatcgccatcatctgcctggccatcctgtaccgcgtcctcaagtgcctgaagatcgcgccccggaaggtgctgaaccccctcatgtggatcaccgccttcatccgctgggtgtacaagaagatggtcgcccgggtggccgacaacatcaaccaggtgaaccgcgagatcggctggatggagggcgggcagctggccctgggcaaccccgcgccgatcccccgccacgcccccatcccccggtactccacctacctcatgctgctgctcatcgtcagctacgcctccgcctgcagcgagctgatccaggcgtccagccgcatcaccacgtgctccaccgagggggtgaacaccaagtgccggctgagcggcaccgccctgatccgcgccgggtccgtgggcgccgaggcctgcctcatgctgaagggggtcaaggaggaccagacgaagttcctgaagatcaagaccgtgagctccgagctcagctgccgggagggccagtcctactggaccggcagcttcagcccgaagtgcctgtccagccgccggtgccacctggtgggggagtgccacgtcaaccgctgcctctcctggcgggacaacgagaccagcgcggagttctccttcgtgggcgagagcacgaccatgcgcgagaacaagtgcttcgagcagtgcgggggctgggggtgcggctgcttcaacgtgaacccctcctgcctgttcgtccacacctacctgcagagcgtgcggaaggaggccctccgcgtgttcaactgcatcgactgggtccacaagctgaccctggagatcaccgacttcgacggctccgtgagcacgatcgacctcggggcctccagctcccggttcaccaactggggcagcgtgtccctgagcctggacgccgaggggatctccggcagcaactccttcagcttcatcgagagccccgggaagggctacgccatcgtcgacgagcccttctccgagatcccgcgccagggcttcctcggggagatccggtgcaacagcgagtccagcgtgctgtccgcgcacgagagctgcctgcgcgcccccaacctcatctcctacaagcccatgatcgaccagctggagtgcaccaccaacctgatcgaccccttcgtggtcttcgagcggggcagcctcccgcagacgcgcaacgacaagaccttcgccgcctccaaggggaaccggggcgtgcaggccttcagcaaggggtccgtgcaggcggacctgaccctgatgttcgacaacttcgaggtcgacttcgtgggcgccgccgtgagctgcgacgccgcgttcctcaacctgaccggctgctactcctgcaacgccggggcccgcgtctgcctgagcatcacgtccaccggcaccgggaccctcagcgcccacaacaaggacggctccctgcacatcgtgctgcccagcgagaacggcacgaaggaccagtgccagatcctccacttcaccgtgcccgaggtcgaggaggagttcatgtactcctgcgacggggacgagcgccccctgctggtgaagggcaccctcatcgccatcgacccgttcgacgaccggcgcgaggccgggggcgagagcaccgtggtcaaccccaagagcgggtcctggaacttcttcgactggttcagcggcctgatgtcctggttcggcgggcccctgaagacgatcctcctgatctgcctgtacgtggccctcagcatcggcctgttcttcctgctcatctacctggggcggaccggcctgtccaagatgtggctcgccgccaccaagaaggccagctga

SEQ ID NO: 12837 - RNA, 3480 nt, synthetic construct
  misc_feature 1..3480: note = derived and/or modified CDS sequence (opt1) from RVFV(Entebbe)__DQ380191.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgcaccgcgccctgaaggcgatcatcgccgccgacggcctcaacaacatcacgtgccacgggaaggacccggaggacaagatcagcctgatcaagggcccgccccacaagaagcgggtcggggtggtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagatcaagcgggagctcaagagcttcgacatctcccagtgccccaagatcgggggccacggcagcaagaagtgcaccggggacgccgccttctgctccgcctacgagtgcaccgcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcacgggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacaccgccctcagcgccttcgtcgtggtgttcgtcttctccagcgtggccatcatctgcctggccatcctgtacaaggtgctcaagtgcctgaagatcgcgccccgcaaggtcctgaaccccctcatgtggatcacggccttcatccggtgggtgtacaagaagatggtggcccgcgtcgccgacaacatcaaccaggtgaaccgggagatcggctggatggagggcgggcagctggtgctgggcaaccccgccccgatcccccgccacgcgcccatcccccgctactccacctacctcatgctgctgctcatcgtcagctacgcctccgcctgcagcgagctgatccaggcctccagccggatcacgacctgctccaccgagggggtgaacaccaagtgccgcctgagcggcaccgcgctgatccgggccgggtccgtgggcgccgaggcctgcctcatgctgaagggggtcaaggaggaccagaccaagttcctgaagatcaagacggtgagctccgagctcagctgccgcgagggccagtcctactggaccggcagcttcagcccgaagtgcctgtccagccggcgctgccacctggtgggggagtgccacgtcaaccggtgcctctcctggcgcgacaacgagaccagcgccgagttctccttcgtgggcgagagcaccacgatgcgggagaacaagtgcttcgagcagtgcgggggctgggggtgcggctgcttcaacgtgaacccctcctgcctgttcgtccacacctacctgcagagcgtgcgcaaggaggcgctccgggtgttcaactgcatcgactgggtccacaagctgaccctggagatcaccgacttcgacggctccgtgagcaccgtggacctcggggcctccagctcccgcttcacgaactggggcagcgtctccctgagcctggacgccgaggggatctccggcagcaactccttcagcttcatcgagagccccgggaagggctacgccatcgtggacgagcccttctccgagatcccgcggcagggcttcctcggggagatccgctgcaacagcgagtccagcgtgctgtccgcccacgagagctgcctgcgggcgcccaacctcatctcctacaagcccatgatcgaccagctggagtgcaccaccaacctgatcgaccccttcgtcgtgttcgagcgcggcagcctcccgcagacccggaacgacaagacgttcgccgcctccaaggggaaccgcggcgtgcaggccttcagcaaggggtccgtccaggccgacctgaccctgatgttcgacaacttcgaggtggacttcgtgggcgcggccgtcagctgcgacgccgccttcctcaacctgaccggctgctactcctgcaacgcgggggcccgggtgtgcctgagcatcacctccacgggcaccgggaccctcagcgcccacaacaaggacggctccctgcacatcgtgctgcccagcgagaacggcaccaaggaccagtgccagatcctccacttcacggtccccgaggtggaggaggagttcatgtactcctgcgacggggacgagcgccccctgctggtcaagggcaccctcatcgccatcgacccgttcgacgaccgccgggaggccgggggcgagagcaccgtggtgaaccccaagagcgggtcctggaacttcttcgactggttcagcggcctgatgtcctggttcggcgggcccctgaagaccatcctcctgatctgcctgtacgtcgcgctcagcatcggcctgttcttcctgctcatctacctggggcgcacgggcctgtccaagatgtggctcgccgccaccaagaaggccagctga

SEQ ID NO: 12838 - RNA, 3480 nt, synthetic construct
  misc_feature 1..3480: note = derived and/or modified CDS sequence (opt1) from RVFV(763/70)__DQ380188.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctggtcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgggctgacggaggactgcaacttctgccgccagatgaccggcgccagcctcaagaaggggtcctaccccctgcaggacctgttctgccagagctccgaggacgacggcagcaagctcaagaccaagatgaagggcgtctgcgaggtgggggtgcaggccctgaagaagtgcgacggccagctgtccaccgcccacgaggtcgtgcccttcgcggtgttcaagaacagcaagaaggtctacctcgacaagctggacctgaagacggaggagaacctcctgcccgacagcttcgtgtgcttcgagcacaaggggcagtacaagggcaccatggactccgggcagaccaagcgggagctcaagagcttcgacatctcccagtgccccaagatcggcggccacgggagcaagaagtgcaccggcgacgccgccttctgctccgcctacgagtgcacggcccagtacgcgaacgcctactgcagccacgccaacgggtccggcatcgtgcagatccaggtcagcggggtgtggaagaagcccctgtgcgtgggctacgagcgcgtcgtggtcaagcgggagctgtccgccaagccgatccagcgcgtggagccctgcacgacctgcatcaccaagtgcgagccccacggcctggtggtccggagcaccgggttcaagatctccagcgcggtggcctgcgcctccggcgtgtgcgtcaccgggagccagtcccccagcaccgagatcaccctcaagtacccgggcatctcccagagctccgggggcgacatcggcgtgcacatggcccacgacgaccagagcgtgagctccaagatcgtcgcccactgcccgccccaggacccctgcctggtgcacgggtgcatcgtgtgcgcgcacggcctgatcaactaccagtgccacacggccctcagcgccttcgtcgtggtgttcgtcttctccagcgtggccatcatctgcctggccatcctgtacaaggtgctcaagtgcctgaagatcgcgccccgcaaggtcctgaaccccctcatgtggatcaccgccttcatccggtgggtgtacaagaagatggtggcccgcgtcgccgacaacatcaaccaggtgaaccgggagatcgggtggatggagggcggccagctggccctggggaaccccgcgccgatcccccgccacgcccccatcccccgctactccacctacctcatgctgctgctcatcgtgagctacgcctccgcctgcagcgagctgatccaggcgtccagccggatcaccacgtgctccaccgagggcgtcaacaccaagtgccgcctgagcgggaccgccctgatccgggccggctccgtgggggccgaggcctgcctcatgctgaagggcgtgaaggaggaccagacgaagttcctgaagatcaagaccgtcagctccgagctcagctgccgcgagggccagtcctactggaccgggagcttcagcccgaagtgcctgtccagccggcgctgccacctggtgggcgagtgccacgtgaaccggtgcctctcctggcgcgacaacgagaccagcgcggagttctccttcgtcggggagagcacgaccatgcgggagaacaagtgcttcgagcagtgcggcgggtggggctgcggctgcttcaacgtgaacccctcctgcctgttcgtgcacacctacctgcagagcgtccgcaaggaggccctccgggtgttcaactgcatcgactgggtgcacaagctgaccctggagatcaccgacttcgacgggtccgtcagcacgatcgacctcggcgcctccagctcccgcttcaccaactgggggagcgtgtccctgagcctggacgccgagggcatctccgggagcaactccttcagcttcatcgagagccccggcaagggctacgccatcgtggacgagcccttctccgagatcccgcggcaggggttcctcggcgagatccgctgcaacagcgagtccagcgtcctgtccgcgcacgagagctgcctgcgggcccccaacctcatctcctacaagcccatgatcgaccagctggagtgcaccaccaacctgatcgaccccttcgtggtgttcgagcgcgggagcctcccgcagacgcggaacgacaagaccttcgccgcctccaagggcaaccgcggggtccaggccttcagcaagggctccgtgcaggcggacctgaccctgatgttcgacaacttcgaggtggacttcgtcggcgccgccgtgagctgcgacgccgcgttcctcaacctgaccgggtgctactcctgcaacgccggcgcccgggtgtgcctgagcatcacgtccaccgggaccggcaccctcagcgcccacaacaaggacggctccctgcacatcgtcctgcccagcgagaacgggacgaaggaccagtgccagatcctccacttcaccgtgcccgaggtggaggaggagttcatgtactcctgcgacggcgacgagcgccccctgctggtcaaggggaccctcatcgccatcgacccgttcgacgaccgccgggaggcgggcggggagagcaccgtggtcaaccccaagagcggctcctggaacttcttcgactggttcagcggcctgatgtcctggttcgggggccccctgaagacgatcctcctgatctgcctgtacgtggccctcagcatcgggctgttcttcctgctcatctacctgggccgcaccgggctgtccaagatgtggctcgccgccaccaagaaggccagctga

SEQ ID NO: 12839 - RNA, 3480 nt, synthetic construct
  misc_feature 1..3480: note = derived and/or modified CDS sequence (opt1) from RVFV(OS-1)__DQ380186.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcagcgcgacgccaagcagatcggccgggagaccatggccggcatcgcgatgaccgtgctgcccgccctcgccgtcttcgccctggcgcccgtggtgttcgccgaggacccccacctccgcaaccggcccgggaagggccacaactacatcgacgggatgacccaggaggacgcgacctgcaagcccgtcacgtacgccggcgcctgctccagcttcgacgtgctgctggagaaggggaagttcccgctgttccagtcctacgcgcaccaccgcaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccggcagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccggggtggtgcagatccaggtcagcggcgtgtggaagaagcccctgtgcgtggggtacgagcgggtcgtggtcaagcgcgagctgtccgccaagccgatccagcgggtggagccctgcacgacctgcatcaccaagtgcgagccccacggcctggtggtccgcagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtggtgttcgtcttctccagcgtggccatcatctgcctggccatcctgtacaaggtgctcaagtgcctgaagatcgcgccccggaaggtcctgaaccccctcatgtggatcaccgccttcatccgctgggtgtacaagaagatggtggcccgggtcgccgacaacatcaaccaggtgaaccgcgagatcggctggatggagggcgggcagctggccctgggcaaccccgcgccgatcccccggcacgcccccatcccccgctactccacctacctcatgctgctgctcatcgtgagctacgcctccgcctgcagcgagctgatccaggcgtccagccgcatcaccacgtgctccaccgagggggtcaacaccaagtgccggctgagcggcaccgccctgatccgcgccgggtccgtgggcgccgaggcctgcctcatgctgaagggggtgaaggaggaccagacgaagttcctgaagatcaagaccgtcagctccgagctcagctgccgggagggccagtcctactggaccggcagcttcagcccgaagtgcctgtccagccgccggtgccacctggtgggggagtgccacgtgaaccgctgcctctcctggcgggacaacgagaccagcgcggagttctccttcgtcggcgagagcacgaccatgcgcgagaacaagtgcttcgagcagtgcgggggctgggggtgcggctgcttcaacgtgaacccctcctgcctgttcgtgcacacctacctgcagagcgtccggaaggaggccctcaaggtgttcaactgcatcgactgggtgcacaagctgaccctggagatcaccgacttcgacggctccgtcagcacgatcgacctcggggcctccagctcccgcttcaccaactggggcagcgtgtccctgagcctggacgccgaggggatctccggcagcaactccttcagcttcatcgagagccccgggaagggctacgccatcgtggacgagcccttctccgagatcccgcggcagggcttcctcggggagatccgctgcaacagcgagtccagcgtcctgtccgcgcacgagagctgcctgcgggcccccaacctcatctcctacaagcccatgatcgaccagctggagtgcaccaccaacctgatcgaccccttcgtggtgttcgagcgcggcagcctcccgcagacgcggaacgacaagaccttcgccgcctccaaggggaaccgcggcgtccaggccttcagcaaggggtccgtgcaggcggacctgaccctgatgttcgacaacttcgaggtggacttcgtcggcgccgccgtgagctgcgacgccgcgttcctcaacctgaccggctgctactcctgcaacgccggggcccgggtgtgcctgagcatcacgtccaccggcaccgggaccctcagcgcccacaacaaggacggctccctgcacatcgtcctgcccagcgagaacggcacgaaggaccagtgccagatcctccacttcaccgtgcccgaggtggaggaggagttcatgtactcctgcgacggggacgagcgccccctgctggtcaagggcaccctcatcgccatcgacccgttcgacgaccggcgcgaggccgggggcgagagcaccgtggtcaaccccaagagcgggtcctggaacttcttcgactggttcagcggcctgatgtcctggttcggcgggcccctgaagacgatcctcctgatctgcctgtacgtggccctcagcatcggcctgttcttcctgctcatctacctggggcgcaccggcctgtccaagatgtggctcgccgccaccaagaaggccagctga

SEQ ID NO: 12840 - RNA, 3480 nt, synthetic construct
  misc_feature 1..3480: note = derived and/or modified CDS sequence (opt1) from RVFV(2008/00101)__HE687306.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcgcaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtgatcttcgtgttctccagcaccgccatcatctgcctggccgtcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggccctgggcaaccccgcgccgatcccccgccacgcccccatcccccggtactccacctacctcatgctgctgctcatcgtgagctacgcctccgcctgcagcgagctgatccaggcgtccagccgcatcacgacctgctccaccgagggggtgaacaccaagtgccggctgagcggcacggccctgatccgcgccgggtccgtcggcgccgaggcctgcctcatgctgaagggggtgaaggaggaccagaccaagttcctgaagatcaagaccgtgagctccgagctcagctgccgggagggccagtcctactggaccggcagcttcagcccgaagtgcctgtccagccgccggtgccacctggtcggggagtgccacgtgaaccgctgcctctcctggcgggacaacgagacgagcgcggagttctccttcgtgggcgagagcaccaccatgcgcgagaacaagtgcttcgagcagtgcgggggctgggggtgcggctgcttcaacgtcaacccctcctgcctgttcgtgcacacctacctgcagagcgtgcggaaggaggccctccgcgtcttcaactgcatcgactgggtgcacaagctgaccctggagatcacggacttcgacggctccgtgagcaccatcgacctcggggcctccagctcccggttcaccaactggggcagcgtctccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtgctgtccgcgcacgagagctgcctgcgcgcccccaacctcgtctcctacaagcccatgatcgaccagctggagtgcaccacgaacctgatcgaccccttcgtggtgttcgagcggggcagcctcccgcagacccgcaacgacaagaccttcgccgcctccaaggggaaccggggcgtccaggccttcagcaaggggtccgtgcaggcggacctgaccctgatgttcgacaacttcgaggtggacttcgtcggcgccgccgtgagctgcgacgccgcgttcctcaacctgacgggctgctactcctgcaacgccggggcccgcgtgtgcctgagcatcacctccaccggcaccgggacgctcagcgcccacaacaaggacggctccctgcacatcgtcctgcccagcgagaacggcaccaaggaccagtgccagatcctccacttcaccgtgcccgaggtggaggaggagttcatgtactcctgcgacggggacgagcgccccctgctggtcaagggcaccctcatcgccatcgacccgttcgacgaccggcgcgaggccgggggcgagagcacggtggtcaaccccaagagcgggtcctggaacttcttcgactggttcagcggcctgatgtcctggttcggcgggcccctgaagaccaccctcctgatctgcctgtacgtggccctcagcatcggcctgttcttcctgctcatctacctggggcggaccggcctgtccaagatgtggctcgccgccacgaagaaggccagctga

SEQ ID NO: 12841 - RNA, 3480 nt, synthetic construct
  misc_feature 1..3480: note = derived and/or modified CDS sequence (opt1) from RVFV(200803162)__JF311377.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcgcgaagtgcgagccccacggcctggtggtccggagcaccggcttcaagatctccagcgccgtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcgcactgcccgccccaggacccctgcctggtgcacgactgcatcgtgtgcgcccacggcctgatcaactaccagtgccacaccgccctcagcgccttcgtcgtgatcttcgtgttctccagcacggccatcatctgcctggcggtcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcgggtggatggagggcgggcagctggccctgcgcaaccccgccccgatcccccggcacgcccccatcccccgctactccacctacctcatgctgctgctcatcgtgagctacgcctccgcgtgcagcgagctgatccaggcctccagccggatcaccacgtgctccaccgagggcgtgaacaccaagtgccgcctgagcggcaccgccctgatccgggccgggtccgtcggcgccgaggcgtgcctcatgctgaagggggtgaaggaggaccagacgaagttcctgaagatcaagaccgtgagctccgagctcagctgccgcgagggccagtcctactggaccgggagcttcagcccgaagtgcctgtccagccggcgctgccacctggtcggcgagtgccacgtgaaccggtgcctctcctggcgcgacaacgagaccagcgccgagttctccttcgtgggcgagagcacgaccatgcgggagaacaagtgcttcgagcagtgcgggggctgggggtgcggctgcttcaacgtcaacccctcctgcctgttcgtgcacacctacctgcagagcgtgcgcaaggaggccctccgggtcttcaactgcatcgactgggtgcacaagctgaccctggagatcaccgacttcgacgggtccgtgagcacgatcgacctcggcgcctccagctcccgcttcaccaactggggcagcgtctccctgagcctggacgccgaggggatctccggcagcaactccttcagcttcatcgagagccccgggaagggctacgcgatcgtggacgagcccttctccgagatcccgcggcaggggttcctcggcgagatccgctgcaacagcgagtccagcgtgctgtccgcccacgagagctgcctgcgggcccccaacctcgtctcctacaagcccatgatcgaccagctggagtgcaccaccaacctgatcgaccccttcgtggtgttcgagcgcggcagcctcccgcagacgcggaacgacaagaccttcgccgcctccaaggggaaccgcggcgtccaggcgttcagcaaggggtccgtgcaggccgacctgaccctgatgttcgacaacttcgaggtggacttcgtcggcgccgccgtgagctgcgacgcggccttcctcaacctgaccgggtgctactcctgcaacgccggcgcccgcgtgtgcctgagcatcacgtccaccggcaccgggaccctcagcgcccacaacaaggacggctccctgcacatcgtcctgcccagcgagaacgggacgaaggaccagtgccagatcctccacttcaccgtgcccgaggtggaggaggagttcatgtactcctgcgacggcgacgagcggcccctgctggtcaagggcaccctcatcgcgatcgacccgttcgacgaccgccgggaggccgggggcgagagcaccgtggtcaaccccaagagcgggtcctggaacttcttcgactggttcagcggcctgatgtcctggttcgggggccccctgaagacgatcctcctgatctgcctgtacgtggccctcagcatcggcctgttcttcctgctcatctacctggggcgcaccggcctgtccaagatgtggctcgccgccaccaagaaggcgagctga

SEQ ID NO: 12842 - RNA, 3480 nt, synthetic construct
  misc_feature 1..3480: note = derived and/or modified CDS sequence (opt1) from RVFV(2007002060)__EU574039.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgcaaggacgccaagcagatcggccgggagaccatggccggcatcgcgatgaccgtcctgcccgccctcgccgtgttcgccctggcgcccgtggtcttcgccgaggacccccacctccgcaaccggcccgggaagggccacaactacatcgacgggatgacccaggaggacgcgacctgcaagcccgtgacgtacgccggcgcctgctccagcttcgacgtgctgctggagaaggggaagttcccgctgttccagtcctacgcgcaccaccgcaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccggcagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgcgagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgggtcgtggtcaagcgcgagctgtccgccaagccgatccagcgggtggagccctgcacgacctgcatcaccaagtgcgagccccacggcctggtggtccgcagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtgatcttcgtgttctccagcaccgccatcatctgcctggccgtcctgtaccgggtgctcaagtgcctgaagatcgcgccccgcaaggtgctgaaccccctcatgtggatcaccgccttcatccggtgggtctacaagaagatggtggcccgcgtggccgacaacatcaaccaggtcaaccgggagatcggctggatggagggcgggcagctggccctgggcaaccccgcgccgatcccccgccacgcccccatcccccgctactccacctacctcatgctgctgctcatcgtgagctacgcctccgcctgcagcgagctgatccaggcgtccagccggatcacgacctgctccaccgagggggtgaacaccaagtgccgcctgagcggcacggccctgatccgggccgggtccgtcggcgccgaggcctgcctcatgctgaagggggtgaaggaggaccagaccaagttcctgaagatcaagaccgtgagctccgagctcagctgccgcgagggccagtcctactggaccggcagcttcagcccgaagtgcctgtccagccggcgctgccacctggtcggggagtgccacgtgaaccggtgcctctcctggcgcgacaacgagacgagcgcggagttctccttcgtgggcgagagcaccaccatgcgggagaacaagtgcttcgagcagtgcgggggctgggggtgcggctgcttcaacgtcaacccctcctgcctgttcgtgcacacctacctgcagagcgtgcgcaaggaggccctccgggtcttcaactgcatcgactgggtgcacaagctgaccctggagatcacggacttcgacggctccgtgagcaccatcgacctcggggcctccagctcccgcttcaccaactggggcagcgtctccctgagcctggacgccgaggggatctccggcagcaactccttcagcttcatcgagagccccgggaagggctacgccatcgtggacgagcccttctccgagatcccgcggcagggcttcctcggggagatccgctgcaacagcgagtccagcgtgctgtccgcgcacgagagctgcctgcgggcccccaacctcgtctcctacaagcccatgatcgaccagctggagtgcaccacgaacctgatcgaccccttcgtggtgttcgagcgcggcagcctcccgcagacccggaacgacaagaccttcgccgcctccaaggggaaccgcggcgtccaggccttcagcaaggggtccgtgcaggcggacctgaccctgatgttcgacaacttcgaggtggacttcgtcggcgccgccgtgagctgcgacgccgcgttcctcaacctgacgggctgctactcctgcaacgccggggcccgggtgtgcctgagcatcacctccaccggcaccgggacgctcagcgcccacaacaaggacggctccctgcacatcgtcctgcccagcgagaacggcaccaaggaccagtgccagatcctccacttcaccgtgcccgaggtggaggaggagttcatgtactcctgcgacggggacgagcgccccctgctggtcaagggcaccctcatcgccatcgacccgttcgacgaccgccgggaggccgggggcgagagcacggtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcgcaccggcctgtccaagatgtggctcgccgccaccaagaaggccagctga

SEQ ID NO: 12843 - RNA, 3480 nt, synthetic construct
  misc_feature 1..3480: note = derived and/or modified CDS sequence (opt1) from RVFV(2007002476)__EU574036.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcgcaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtgatcttcgtgttctccagcaccgccatcatctgcctggccgtcctgtaccgcgtgctcaagtgcctgaagatcgcgccccggaaggtgctgaaccccctcatgtggatcaccgccttcatcaagtgggtctacaagaagatggtggcccgcgtggccgacaacatcaaccaggtcaaccgggagatcggctggatggagggcgggcagctggccctgggcaaccccgcgccgatcccccgccacgcccccatcccccgctactccacctacctcatgctgctgctcatcgtgagctacgcctccgcctgcagcgagctgatccaggcgtccagccggatcacgacctgctccaccgagggggtgaacaccaagtgccgcctgagcggcacggccctgatccgggccgggtccgtcggcgccgaggcctgcctcatgctgaagggggtgaaggaggaccagaccaagttcctgaagatcaagaccgtgagctccgagctcagctgccgcgagggccagtcctactggaccggcagcttcagcccgaagtgcctgtccagccggcgctgccacctggtcggggagtgccacgtgaaccggtgcctctcctggcgcgacaacgagacgagcgcggagttctccttcgtgggcgagagcaccaccatgcgggagaacaagtgcttcgagcagtgcgggggctgggggtgcggctgcttcaacgtcaacccctcctgcctgttcgtgcacacctacctgcagagcgtgcgcaaggaggccctccgggtcttcaactgcatcgactgggtgcacaagctgaccctggagatcacggacttcgacggctccgtgagcaccatcgacctcggggcctccagctcccgcttcaccaactggggcagcgtctccctgagcctggacgccgaggggatctccggcagcaactccttcagcttcatcgagagccccgggaagggctacgccatcgtggacgagcccttctccgagatcccgcggcagggcttcctcggggagatccgctgcaacagcgagtccagcgtgctgtccgcgcacgagagctgcctgcgggcccccaacctcgtctcctacaagcccatgatcgaccagctggagtgcaccacgaacctgatcgaccccttcgtggtgttcgagcgcggcagcctcccgcagacccggaacgacaagaccttcgccgcctccaaggggaaccgcggcgtccaggccttcagcaaggggtccgtgcaggcggacctgaccctgatgttcgacaacttcgaggtggacttcgtcggcgccgccgtgagctgcgacgccgcgttcctcaacctgacgggctgctactcctgcaacgccggggcccgggtgtgcctgagcatcacctccaccggcaccgggacgctcagcgcccacaacaaggacggctccctgcacatcgtcctgcccagcgagaacggcaccaaggaccagtgccagatcctccacttcaccgtgcccgaggtggaggaggagttcatgtactcctgcgacggggacgagcgccccctgctggtcaagggcaccctcatcgccatcgacccgttcgacgaccgccgggaggccgggggcgagagcacggtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcgcaccggcctgtccaagatgtggctcgccgccaccaagaaggccagctga

SEQ ID NO: 12844 - RNA, 3480 nt, synthetic construct
  misc_feature 1..3480: note = derived and/or modified CDS sequence (opt1) from RVFV(2269/74)__DQ380222.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcgcaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagcacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcgtcgccatcatctgcctggccatcctgtacaaggtgctcaagtgcctgaagatcgcgcccaagaaggtgctgaaccccctcatgtggatcaccgccttcatccgctgggtctacaagaagatggtggcccgggtggccgacaacatcaaccaggtcaaccgcgagatcggctggatggagggcgggcagctggccctgggcaaccccgcgccgatcccccggcacgcccccatcccccgctactccacctacctcatgctgctgctcatcgtgagctacgcctccgcctgcagcgagctgatccaggcgtccagccgcatcaccacgtgctccaccgagggggtgaacaccaagtgccggctgagcggcaccgccctgatccgcgccgggtccgtcggcgccgaggcctgcctcatgctgaagggggtgaaggaggaccagacgaagttcctgaagatcaagaccgtgagctccgagctcagctgccgggagggccagtcctactggaccggcagcttcagcccgaagtgcctgtccagccgccggtgccacctggtcggggagtgccacgtgaaccgctgcctctcctggcgggacaacgagaccagcgcggagttctccttcgtgggcgagagcacgaccatgcgcgagaacaagtgcttcgagcagtgcgggggctgggggtgcggctgcttcaacgtcaacccctcctgcctgttcgtgcacacctacctgcagagcgtgcggaaggaggccctccgcgtcttcaactgcatcgactgggtgcacaagctgaccctggagatcaccgacttcgacggctccgtgagcacgatcgacctcggggcctccagctcccggttcaccaactggggcagcgtctccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtgctgtccgcgcacgagagctgcctgcgcgcccccaacctcatctcctacaagcccatgatcgaccagctggagtgcaccaccaacctgatcgaccccttcgtcgtgttcgagcggggcagcctcccgcagacgcgcaacgacaagaccttcgccgcctccaaggggaaccggggcgtgcaggccttcagcaaggggtccgtccaggcggacctgaccctgatgttcgacaacttcgaggtggacttcgtgggcgccgccgtcagctgcgacgccgcgttcctcaacctgaccggctgctactcctgcaacgccggggcccgcgtgtgcctgagcatcacgtccaccggcaccgggaccctcagcgcccacaacaaggacggctccctgcacatcgtgctgcccagcgagaacggcacgaaggaccagtgccagatcctccacttcaccgtccccgaggtggaggaggagttcatgtactcctgcgacggggacgagcggcccctgctggtgaagggcaccctcatcgccatcgacccgttcgacgaccgccgcgaggccgggggcgagagcaccgtcgtgaaccccaagagcgggtcctggaacttcttcgactggttcagcggcctgatgtcctggttcggcgggcccctgaagacgatcctcctgatctgcctgtacgtcgccctcagcatcggcctgttcttcctgctcatctacctggggcggaccggcctgtccaagatgtggctcgccgccaccaagaaggccagctga

SEQ ID NO: 12845 - RNA, 3480 nt, synthetic construct
  misc_feature 1..3480: note = derived and/or modified CDS sequence (opt1) from RVFV(73HB1449)__DQ380211.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagaacccctccaccgagatcaccctcaagtacccggggatcagccagtccagcggcggggacatcggcgtccacatggcccacgacgaccagtccgtgagcagcaagatcgtggcccactgcccgccccaggacccctgcctggtccacggctgcatcgtgtgcgcgcacgggctgatcaactaccagtgccacacggccctctccgccttcgtggtcgtgttcgtgttcagctccatcgccatcatctgcctggccatcctgtaccgcgtcctcaagtgcctgaagatcgcgccccggaaggtgctgaaccccctcatgtggatcaccgccttcatccgctgggtgtacaagaagatggtcgcccgggtggccgacaacatcaaccaggtgaaccgcgagatcggctggatggagggcgggcagctggtcctgggcaaccccgccccgatcccccgccacgcgcccatcccccggtacagcacctacctcatgctgctgctcatcgtgtcctacgccagcgcctgctccgagctgatccaggccagctcccgcatcaccacgtgcagcaccgagggggtgaacaccaagtgccggctgtccggcaccgcgctgatccgcgccgggagcgtcggcgccgaggcctgcctcatgctgaagggggtgaaggacgaccagacgaagttcctgaagatcaagaccgtgtccagcgagctctcctgccgggagggccagagctactggaccggctccttcagcccgaagtgcctgagctcccgccggtgccacctggtcggggagtgccacgtgaaccgctgcctcagctggcgggacaacgagacctccgccgagttcagcttcgtgggcgagtccacgaccatgcgcgagaacaagtgcttcgagcagtgcgggggctgggggtgcggctgcttcaacgtcaaccccagctgcctgttcgtgcacacctacctgcagtccgtgcggaaggaggcgctccgcgtcttcaactgcatcgactgggtgcacaagctgaccctggagatcaccgacttcgacggcagcgtgtccacgatcgacctcggggccagctccagccggttcaccaactggggctccgtcagcctgtccctggacgccgaggggatcagcggctccaacagcttctccttcatcgagagccccgggaagggctacgccatcgtggacgagcccttcagcgagatcccgcgccagggcttcctcggggagatccggtgcaactccgagagctccgtgctgagcgcccacgagtcctgcctgcgcgcgcccaacctcatcagctacaagcccatgatcgaccagctggagtgcaccaccaacctgatcgaccccttcgtcgtgttcgagcggggctccctcccgcagacgcgcaacgagaagaccttcgccgccagcaaggggaaccggggcgtgcaggccttctccaaggggagcgtccaggccgacctgaccctgatgttcgacaacttcgaggtggacttcgtgggcgcggccgtctcctgcgacgccgccttcctcaacctgaccggctgctacagctgcaacgcgggggcccgcgtgtgcctgtccatcacgagcaccggcaccgggaccctctccgcccacaacaaggacggcagcctgcacatcgtgctgccctccgagaacggcacgaaggaccagtgccagatcctccacttcaccgtccccgaggtggaggaggagttcatgtacagctgcgacggggacgagcgccccctgctggtgaagggcaccctcatcgccatcgacccgttcgacgaccggcgcgaggccgggggcgagtccaccgtcgtgaaccccaagagcgggagctggaacttcttcgactggttctccggcctgatgagctggttcggcgggcccctgaagacgatcctcctgatctgcctgtacgtcgcgctctccatcggcctgttcttcctgctcatctacctggggcggaccggcctgagcaagatgtggctcgccgccaccaagaaggcctcctga

SEQ ID NO: 12846 - RNA, 3480 nt, synthetic construct
  misc_feature 1..3480: note = derived and/or modified CDS sequence (opt1) from RVFV(SA-51 (Van Wyck))__DQ380195.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcgcaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccgcggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgggtggtcgtgaagcgcgagctgtccgccaagccgatccagcgggtcgagccctgcacgacctgcatcaccaagtgcgagccccacggcctggtggtgcgcagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcgtcgccatcatctgcctggccatcctgtacaaggtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggccctgggcaaccccgcgccgatcccccgccacgcccccatcccccggtactccacctacctcatgctgctgctcatcgtgagctacgcctccgcctgcagcgagctgatccaggcgtccagccgcatcaccacgtgctccaccgagggggtgaacaccaagtgccggctgagcggcaccgccctgatccgcgccgggtccgtcggcgccgaggcctgcctcatgctgaagggggtgaaggaggaccagacgaagttcctgaagatcaagaccgtgagctccgagctcagctgccgggagggccagtcctactggaccggcagcttcagcccgaagtgcctgtccagccgccggtgccacctggtcggggagtgccacgtgaaccgctgcctctcctggcgggacaacgagaccagcgcggagttctccttcgtgggcgagagcacgaccatgcgcgagaacaagtgcttcgagcagtgcgggggctgggggtgcggctgcttcaacgtcaacccctcctgcctgttcgtgcacacctacctgcagagcgtgcggaaggaggccctccgcgtcttcaactgcatcgactgggtgcacaagctgaccctggaggtgaccgacttcgacggctccgtcagcacgatcgacctcggggcctccagctcccggttcaccaactggggcagcgtgtccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtcctgtccgcgcacgagagctgcctgcgcgcccccaacctcatctcctacaagcccatgatcgaccagctggagtgcaccaccaacctgatcgaccccttcgtggtgttcgagcggggcagcctcccgcagacgcgcaacgacaagaccttcgccgcctccaaggggaaccggggcgtccaggccttcagcaaggggtccgtgcaggcggacctgaccctgatgttcgacaacttcgaggtggacttcgtcggcgccgccgtgagctgcgacgccgcgttcctcaacctgaccggctgctactcctgcaacgccggggcccgcgtgtgcctgagcatcacgtccaccggcaccgggaccctcagcgcccacaacaaggacggctccctgcacatcgtcctgcccagcgagaacggcacgaaggaccagtgccagatcctccacttcaccgtgcccgaggtggaggaggagttcatgtactcctgcgacggggacgagcgccccctgctggtcaagggcaccctcatcgccatcgacccgttcgacgaccggcgcgaggccgggggcgagagcaccgtggtcaaccccaagagcgggtcctggaacttcttcgactggttcagcggcctgatgtcctggttcggcgggcccctgaagacgatcctcctgatctgcctgtacgtggccctcagcatcggcctgttcttcctgctcatctacctggggcggaccggcctgtccaagatgtggctcgccgccaccaagaaggccagctga

SEQ ID NO: 12847 - RNA, 3480 nt, synthetic construct
  misc_feature 1..3480: note = derived and/or modified CDS sequence (opt1) from RVFV(KEN/Gar-Msq/131B-04/06)__HM586972.1__NSm-Gn-Gc
  source 1..3480: mol_type = other RNA
atgatcgagggcgcctgggacagcttccgcgaggaggagatgcccgaggagctgtcctgcagcgtgtccgggatccgggaggtcaagaccagctcccaggagctctaccgcgccctgaaggcgatcatcgccgccgacggcctgaacaacatcacgtgccacgggaagaacccggaggacaagatcagcctcatcaagggcccgccccacaagaagcgggtggggatcgtgcgctgcgagcggcgccgggacgccaagcagatcggccgcgagaccatggccggcatcgcgatgaccgtcctgcccgccctggccgtgttcgccctcgcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcgcaccaccggaccctgctcgaggccgtccacgacaccatcatcgccaaggccgacccgcccagctgcgacctgcagtccgcccacggcaacccctgcatgaaggagaagctggtgatgaagacccactgccccaacgactaccagagcgcgcactacctcaacaacgacggcaagatggcctccgtgaagtgcccgcccaagtacgagctgacggaggactgcaacttctgccgccagatgaccggggccagcctgaagaagggctcctaccccctccaggacctgttctgccagagctccgaggacgacgggagcaagctgaagaccaagatgaagggcgtctgcgaggtgggcgtgcaggccctcaagaagtgcgacgggcagctgtccaccgcccacgaggtcgtgcccttcgcggtgttcaagaacagcaagaaggtctacctggacaagctcgacctgaagacggaggagaacctgctccccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctgaagtacccggggatctcccagagctccggcggggacatcggcgtgcacatggcccacgacgaccagagcgtgagctccaagatcgtcgcccactgcccgccccaggacccctgcctcgtgcacggctgcatcgtgtgcgcgcacgggctgatcaactaccagtgccacacggccctgagcgccttcgtcgtgatcttcgtgttctccagcaccgccatcatctgcctcgccgtcctgtaccgcgtgctgaagtgcctcaagatcgcgccccggaaggtgctgaaccccctgatgtggatcaccgccttcatccgctgggtctacaagaagatggtggcccgggtggccgacaacatcaaccaggtcaaccgcgagatcggctggatggagggcgggcagctcgccctgggcaaccccgcgccgatcccccgccacgcccccatcccccggtactccacctacctgatgctcctgctgatcgtgagctacgcctccgcctgcagcgagctcatccaggcgtccagccgcatcacgacctgctccaccgagggggtgaacaccaagtgccggctgagcggcacggccctgatccgcgccgggtccgtcggcgccgaggcctgcctgatgctcaagggggtgaaggaggaccagaccaagttcctgaagatcaagaccgtgagctccgagctgagctgccgggagggccagtcctactggaccggcagcttcagcccgaagtgcctctccagccgccggtgccacctggtcggggagtgccacgtgaaccgctgcctgtcctggcgggacaacgagacgagcgcggagttctccttcgtgggcgagagcaccaccatgcgcgagaacaagtgcttcgagcagtgcgggggctgggggtgcggctgcttcaacgtcaacccctcctgcctcttcgtgcacacctacctgcagagcgtgcggaaggaggccctgcgcgtcttcaactgcatcgactgggtgcacaagctcaccctggagatcacggacttcgacggctccgtgagcaccatcgacctgggggcctccagctcccggttcaccaactggggcagcgtctccctcagcctggacgccgaggggatctccggcagcaactccttcagcttcatcgagagccccgggaagggctacgccatcgtggacgagcccttctccgagatcccgcgccagggcttcctgggggagatccggtgcaacagcgagtccagcgtgctctccgcgcacgagagctgcctgcgcgcccccaacctggtctcctacaagcccatgatcgaccagctcgagtgcaccacgaacctgatcgaccccttcgtggtgttcgagcggggcagcctgccgcagacccgcaacgacaagaccttcgccgcctccaaggggaaccggggcgtccaggccttcagcaaggggtccgtgcaggcggacctcaccctgatgttcgacaacttcgaggtggacttcgtcggcgccgccgtgagctgcgacgccgcgttcctgaacctcacgggctgctactcctgcaacgccggggcccgcgtgtgcctgagcatcacctccaccggcaccgggacgctgagcgcccacaacaaggacggctccctccacatcgtcctgcccagcgagaacggcaccaaggaccagtgccagatcctgcacttcaccgtgcccgaggtggaggaggagttcatgtactcctgcgacggggacgagcgccccctcctggtcaagggcaccctgatcgccatcgacccgttcgacgaccggcgcgaggccgggggcgagagcacggtggtcaaccccaagagcgggtcctggaacttcttcgactggttcagcggcctcatgtcctggttcggcgggcccctgaagaccatcctgctcatctgcctgtacgtggccctgagcatcggcctcttcttcctgctgatctacctcgggcggaccggcctgtccaagatgtggctggccgccaccaagaaggccagctga

SEQ ID NO: 12848 - RNA, 3480 nt, synthetic construct
  misc_feature 1..3480: note = derived and/or modified CDS sequence (opt1) from RVFV(2007001107)__EU574047.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagcaaccaggagctgtaccgcgccctgaaggcgatcatcgccgccgacggcctcaacaacatcacgtgccacgggaagaacccggaggacaagatctccctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgcagctccttcgacgtgctgctggagaaggggaagttcccgctgttccagagctacgcgcaccaccggaccctcctggaggccgtccacgacaccatcatcgccaaggccgacccgccctcctgcgacctgcagagcgcccacggcaacccctgcatgaaggagaagctcgtgatgaagacccactgccccaacgactaccagtccgcgcactacctgaacaacgacggcaagatggccagcgtgaagtgcccgcccaagtacgagctgacggaggactgcaacttctgccgccagatgaccggggcctccctcaagaagggcagctaccccctgcaggacctgttctgccagtccagcgaggacgacgggtccaagctcaagaccaagatgaagggcgtctgcgaggtgggcgtgcaggccctgaagaagtgcgacgggcagctgagcaccgcccacgaggtcgtgcccttcgcggtgttcaagaactccaagaaggtctacctcgacaagctggacctgaagacggaggagaacctcctgcccgacagcttcgtgtgcttcgagcacaagggccagtacaaggggaccatggacagcggccagaccaagcgggagctgaagtccttcgacatcagccagtgccccaagatcgggggccacggctccaagaagtgcaccggggacgccgccttctgcagcgcctacgagtgcacggcccagtacgcgaacgcctactgctcccacgccaacggcagcgggatcgtgcagatccaggtctccggcgtgtggaagaagcccctctgcgtggggtacgagcgcgtcgtggtcaagcgggagctgagcgccaagccgatccagcgcgtggagccctgcacgacctgcatcaccaagtgcgagccccacggcctggtggtccggtccaccggcttcaagatcagctccgcggtggcctgcgccagcggggtgtgcgtcaccggctcccagagcccctccaccgagatcaccctcaagtacccggggatcagccagtccagcggcggggacatcggcgtgcacatggcccacgacgaccagtccgtgagcagcaagatcgtcgcccactgcccgccccaggacccctgcctggtgcacggctgcatcgtgtgcgcgcacgggctgatcaactaccagtgccacacggccctctccgccttcgtcgtgatcttcgtgttcagctccaccgccatcatctgcctggccgtcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggccctgggcaaccccgcgccgatcccccgccacgcccccatcccccggtacagcacctacctcatgctgctgctcatcgtgtcctacgccagcgcctgctccgagctgatccaggcgagctcccgcatcacgacctgcagcaccgagggggtgaacaccaagtgccggctgtccggcacggccctgatccgcgccgggagcgtcggcgccgaggcctgcctcatgctgaagggggtgaaggaggaccagaccaagttcctgaagatcaagaccgtgtccagcgagctctcctgccgggagggccagagctactggaccggctccttcagcccgaagtgcctgagctcccgccggtgccacctggtcggggagtgccacgtgaaccgctgcctcagctggcgggacaacgagacgtccgcggagttcagcttcgtgggcgagtccaccaccatgcgcgagaacaagtgcttcgagcagtgcgggggctgggggtgcggctgcttcaacgtcaaccccagctgcctgttcgtgcacacctacctgcagtccgtgcggaaggaggccctccgcgtcttcaactgcatcgactgggtgcacaagctgaccctggagatcacggacttcgacggcagcgtgtccaccatcgacctcggggccagctccagccggttcaccaactggggctccgtcagcctgtccctggacgccgaggggatcagcggctccaacagcttctccttcatcgagagccccgggaagggctacgccatcgtggacgagcccttcagcgagatcccgcgccagggcttcctcggggagatccggtgcaactccgagagctccgtgctgagcgcgcacgagtcctgcctgcgcgcccccaacctcgtcagctacaagcccatgatcgaccagctggagtgcaccacgaacctgatcgaccccttcgtggtgttcgagcggggctccctcccgcagacccgcaacgacaagaccttcgccgccagcaaggggaaccggggcgtccaggccttctccaaggggagcgtgcaggcggacctgaccctgatgttcgacaacttcgaggtggacttcgtcggcgccgccgtgtcctgcgacgccgcgttcctcaacctgacgggctgctacagctgcaacgccggggcccgcgtgtgcctgtccatcaccagcaccggcaccgggacgctctccgcccacaacaaggacggcagcctgcacatcgtcctgccctccgagaacggcaccaaggaccagtgccagatcctccacttcaccgtgcccgaggtggaggaggagttcatgtacagctgcgacggggacgagcgccccctgctggtcaagggcaccctcatcgccatcgacccgttcgacgaccggcgcgaggccgggggcgagtccacggtggtcaaccccaagagcgggagctggaacttcttcgactggttctccggcctgatgagctggttcggcgggcccctgaagaccatcctcctgatctgcctgtacgtggccctctccatcggcctgttcttcctgctcatctacctggggcggaccggcctgagcaagatgtggctcgccgccaccaagaaggcctcctga

SEQ ID NO: 12849 - RNA, 3480 nt, synthetic construct
  misc_feature 1..3480: note = derived and/or modified CDS sequence (opt1) from RVFV(ANK-3837)__DQ380215.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaagctggactccggccagaccaagcgggagctcaagagcttcgacatctcccagtgccccaagatcgggggccacggcagcaagaagtgcaccggggacgccgccttctgctccgcctacgagtgcaccgcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctcgtggtgcggagcaccggcttcaagatctccagcgcggtcgcctgcgcctccggggtgtgcgtgacgggcagccagtcccccagcaccgagatcaccctgaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctcatcaactaccagtgccacaccgccctgagcgccttcgtggtcgtgttcgtgttctccagcatcgccatcatctgcctggccatcctctaccgcgtcctgaagtgcctgaagatcgcgccccggaaggtgctcaaccccctgatgtggatcacggccttcatccgctgggtgtaccggaagatggtcgcccgcgtggccgacaacatcaaccaggtgaaccgcgagatcggctggatggagggcgggcagctggtcctcggcaaccccgccccgatcccccggcacgtgcccatcccccgctactccacctacctgatgctgctcctgatcgtgagctacgcgtccgcctgcagcgagctgatccaggcctccagccggatcacgacctgctccaccgagggggtcaacaccaagtgccgcctgagcggcaccgccctcatccgggcggggtccgtgggcgccgaggcctgcctgatgctgaagggggtgaaggaggaccagaccaagttcctcaagatcaagacggtcagctccgagctgagctgccgcgagggccagtcctactggaccggcagcttcagcccgaagtgcctgtccagccggcgctgccacctcgtgggggagtgccacgtgaaccggtgcctgtcctggcgcgacaacgagaccagcgccgagttctccttcgtcggcgagagcaccacgatgcgggagaacaagtgcttcgagcagtgcgggggctgggggtgcggctgcttcaacgtgaacccctcctgcctgttcgtgcacacctacctccagagcgtccgcaaggaggccctgcgggtgttcaactgcatcgactgggtgcacaagctgaccctcgagatcaccgacttcgacggctccgtcagcaccatcgacctgggggcgtccagctcccgcttcacgaactggggcagcgtgtccctgagcctcgacgccgaggggatctccggcagcaactccttcagcttcatcgagagccccgggaagggctacgccatcgtggacgagcccttctccgagatcccgcggcagggcttcctgggggagatccgctgcaacagcgagtccagcgtcctgtccgcccacgagagctgcctccgggcccccaacctgatctcctacaagcccatgatcgaccagctggagtgcaccaccaacctcatcgaccccttcgtggtgttcgagcgcggcagcctgccgcagacccggaacgacaagacgttcgcggcctccaaggggaaccgcggcgtccaggccttcagcaaggggtccgtgcaggccgacctgaccctcatgttcgacaacttcgaggtggacttcgtcggcgccgcggtgagctgcgacgccgccttcctgaacctgaccggctgctactcctgcaacgccggggcgcgcgtgtgcctcagcatcacctccacgggcaccgggaccctgagcgcccacaacaaggacggctccctgcacatcgtcctccccagcgagaacggcaccaaggaccagtgccagatcctgcacttcacggtgcccgaggtggaggaggagttcatgtactcctgcgacggggacgagcggcccctgctcgtccgcggcaccctgatcgccatcgacccgttcgacgaccggcgcgaggccgggggcgagagcaccgtggtcaaccccaagagcgggtcctggaacttcttcgactggttcagcggcctgatgtcctggttcggcgggcccctcaagaccatcctgctgatctgcctctacgtggccctgagcatcggcctgttcttcctcctgatctacctggggcggacgggcctctccaagatgtggctggcggccaccaagaaggccagctga

SEQ ID NO: 12850 - RNA, 3480 nt, synthetic construct
  misc_feature 1..3480: note = derived and/or modified CDS sequence (opt1) from RVFV(Lunyo)__KU167026.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcgcaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggtgtccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtggtgttcgtcttctccagcgtggccatcatctgcctggccatcctgtacaaggtgctcaagtgcctgaagatcgcgccccgcaaggtcctgaaccccctcatgtggatcaccgccttcatccggtgggtgtacaagaagatggtggcccgcgtcgccgacaacatcaaccaggtgaaccgggagatcggctggatggagggcgggcagctggccctgggcaaccccgcgccgatcccccgccacgcccccatcccccgctactccacctacctcatgctgctgctcatcgtgagctacgcctccgcctgcagcgagctgatccaggcgtccagccggatcaccacgtgctccaccgagggggtcaacacccgctgccggctgagcggcaccgccctgatccgcgccgggtccgtgggcgccgaggcctgcctcatgctgaagggggtgaaggaggaccagacgaagttcctgaagatcaagaccgtcagctccgagctcagctgccgggagggccagtcctactggaccggcagcttcagcccgaagtgcctgtccagccgccggtgccacctggtgggggagtgccacgtgaaccgctgcctctcctggcgggacaacgagaccagcgcggagttctccttcgtcggcgagagcacgaccatgcgcgagaacaagtgcttcgagcagtgcgggggctgggggtgcggctgcttcaacgtgaacccctcctgcctgttcgtgcacacctacctgcagagcgtccggaaggaggccctccgcgtgttcaactgcatcgactgggtgcacaagctgaccctggagatcaccgacttcgacggctccgtcagcacgatcgacctcggggcctccagctcccggttcaccaactggggcagcgtgtccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtcctgtccgcgcacgagagctgcctgcgcgcccccaacctcatctcctacaagcccatgatcgaccagctggagtgcaccaccaacctgatcgaccccttcgtggtgttcgagcggggcagcctcccgcagacgcgcaacgacaagaccttcgccgcctccaaggggaaccggggcgtccaggccttcagcaaggggtccgtgcaggcggacctgaccctgatgttcgacaacttcgaggtggacttcgtcggcgccgccgtgagctgcgacgccgcgttcctcaacctgaccggctgctactcctgcaacgccggggcccgcgtgtgcctgagcatcacgtccaccggcaccgggaccctcagcgcccacaacaaggacggctccctgcacatcgtcctgcccagcgagaacggcacgaaggaccagtgccagatcctccacttcaccgtgcccgaggtggaggaggagttcatgtactcctgcgacggggacgagcgccccctgctggtcaagggcaccctcatcgccatcgacccgttcgacgaccggcgcgaggccgggggcgagagcaccgtggtcaaccccaagagcgggtcctggaacttcttcgactggttcagcggcctgatgtcctggttcggcgggcccctgaagacgatcctcctgatctgcctgtacgtggccctcagcatcggcctgttcttcctgctcatctacctggggcggaccggcctgtccaagatgtggctcgccgccaccaagaaggccagctga

SEQ ID NO: 12851 - RNA, 3480 nt, synthetic construct
  misc_feature 1..3480: note = derived and/or modified CDS sequence (opt1) from RVFV(RVFBJ01/2016)__KX785331.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcgcaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagcacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcgtcgccatcatctgcctggccatcctgtacaaggtgctccgctgcctgaagatcgcgcccaagaaggtgctgaaccccctcatgtggatcaccgccttcatccggtgggtctacaagaagatggtggcccgcgtggccgacaacatcaaccaggtcaaccgggagatcggctggatggagggcgggcagctggccctgggcaaccccgcgccgatcccccgccacgcccccatcccccgctactccacctacctcatgctgctgctcatcatcagctacgcctccgcctgcagcgagctgatccaggcgtccagccggatcaccacgtgctccaccgagggggtgaacaccaagtgccgcctgagcggcaccgccctgatccgggccgggtccgtgggcgccgaggcctgcctcatgctgaagggggtcaaggaggaccagacgaagttcctgaagatcaagaccgtgagctccgagctcagctgccgcgagggccagtcctactggaccggcagcttcagcccgaagtgcctgtccagccggcgctgccacctggtgggggagtgccacgtcaaccggtgcctctcctggcgcgacaacgagaccagcgcggagttctccttcgtgggcgagagcacgaccatgcgggagaacaagtgcttcgagcagtgcgggggctgggggtgcggctgcttcaacgtgaacccctcctgcctgttcgtccacacctacctgcagagcgtgcgcaaggaggccctccgggtgttcaactgcatcgactgggtccacaagctgaccctggagatcaccgacttcgacggctccgtgagcacgatcgacctcggggcctccagctcccgcttcaccaactggggcagcgtgtccctgagcctggacgccgaggggatctccggcagcaactccttcagcttcatcgagagccccgggaagggctacgccatcgtcgacgagcccttctccgagatcccgcggcagggcttcctcggggagatccgctgcaacagcgagtccagcgtgctgtccgcgcacgagagctgcctgcgggcccccaacctcatctcctacaagcccatgatcgaccagctggagtgcaccaccaacctgatcgaccccttcgtggtcttcgagcgcggcagcctcccgcagacgcggaacgacaagaccttcgccgcctccaaggggaaccgcggcgtgcaggccttcagcaaggggtccgtgcaggcggacctgaccctgatgttcgacaacttcgaggtcgacttcgtgggcgccgccgtgagctgcgacgccgcgttcctcaacctgaccggctgctactcctgcaacgccggggcccgggtctgcctgagcatcacgtccaccggcaccgggaccctcagcgcccacaacaaggacggctccctgcacatcgtgctgcccagcgagaacggcacgaaggaccagtgccagatcctccacttcaccgtgcccgaggtcgaggaggagttcatgtactcctgcgacggggacgagcgccccctgctggtgaagggcaccctcatcgccatcgacccgttcgacgaccgccgggaggccgggggcgagagcaccgtggtcaaccccaagagcgggtcctggaacttcttcgactggttcagcggcctgatgtcctggttcggcgggcccctgaagacgatcctcctgatctgcctgtacgtggccctcagcatcggcctgttcttcctgctcatctacctggggcgcaccggcctgtccaagatgtggctcgccgccaccaagaaggccagctga

SEQ ID NO: 12852 - RNA, 3480 nt, synthetic construct
  misc_feature 1..3480: note = derived and/or modified CDS sequence (opt1) from RVFV(Ken 199800523)__KU978777.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacaccaagcagatcggccgcgagaccatggccggcatcgccatgaccgtcctgcccgcgctcgccgtgttcgccctggcccccgtggtcttcgcggaggacccccacctccggaaccgccccgggaagggccacaactacatcgacgggatgacccaggaggacgccacgtgcaagcccgtgacctacgccggcgcctgctccagcttcgacgtgctgctggagaaggggaagttcccgctgttccagtcctacgcccaccaccggaccctcctggaggcggtccacgacaccatcatcgccaaggccgacccgcccagctgcgacctgcagtccgcccacggcaacccctgcatgaaggagaagctcgtgatgaagacgcactgccccaacgactaccagagcgcccactacctgaacaacgacggcaagatggcgtccgtgaagtgcccgcccaagtacgagctgaccgaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccacggcccacgaggtcgtgcccttcgccgtgttcaagaacagcaagaaggtctacctcgacaagctggacctgaagaccgaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcacgggggacgcggccttctgctccgcctacgagtgcaccgcccagtacgccaacgcgttctgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgccgtggcgtgcgcctccggggtgtgcgtcaccggcagccagtcccccagcaccgagatcacgctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcccacgggctgatcaactaccagtgccacaccgcgctcagcgccttcgtcgtggtgttcgtcttctccagcatcgccatcatctgcctggccatcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggtgctgggcaaccccgccccgatcccccgccacgcccccatcccccggtactccacctacctcatgctgctgctcatcgtgagctacgcgtccgcctgcagcgagctgatccaggcctccagccgcatcacgacctgctccaccgagggggtcaacaccaagtgccggctgagcggcacggccctgatccgcgcggggtccgtgggcgccgaggcctgcctcatgctgaagggggtgaaggaggaccagaccaagttcctgaagatcaagaccgtcagctccgagctcagctgccgggagggccagtcctactggaccggcagcttcagcccgaagtgcctgtccagccgccggtgccacctggtgggggagtgccacgtgaaccgctgcctctcctggcgggacaacgagacgagcgccgagttctccttcgtcggcgagagcaccaccatgcgcgagaacaagtgcttcgagcagtgcgggggctgggggtgcggctgcttcaacgtgaacccctcctgcctgttcgtgcacacctacctgcagagcgtccggaaggaggccctccgcgtgttcaactgcatcgactgggtgcacaagctgaccctggagatcacggacttcgacggctccgtcagcaccatcgacctcggggcgtccagctcccggttcaccaactggggcagcgtgtccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtcctgaacgcccacgagtcctgcctgcgcgcccccaacctcatcagctacaagcccatgatcgaccagctggagtgcaccacgaacctgatcgaccccttcgtggtgttcgagcggggctccctcccgcagacccgcaacgacaagaccttcgcggccagcaaggggaaccggggcgtccaggccttctccaaggggagcgtgcaggccgacctgaccctgatgttcgacaacttcgaggtggacttcgtcggcgccgcggtgtcctgcgacgccgccttcctcaacctgacgggctgctacagctgcaacgccggggcgcgcgtgtgcctgtccatcaccagcaccggcaccgggacgctctccgcccacaacaaggagggcagcctgcacatcgtcctgccctccgagaacggcaccaaggaccagtgccagatcctccacttcaccgtgcccgaggtggaggaggagttcatgtacagctgcgacggggacgagcgccccctgctggtcaagggcaccctcatcgccatcgacccgttcgacgaccggcgcgaggccgggggcgagtccacggtggtcaaccccaagagcgggagctggaacttcttcgactggttctccggcctgatgagctggttcggcgggcccctgaagaccatcctcctgatctgcctgtacgtggccctctccatcggcctgttcttcctgctcatctacctggggcggaccggcctgagcaagatgtggctcgcggccaccaagaaggcctcctga

SEQ ID NO: 12853 - RNA, 3480 nt, synthetic construct
  misc_feature 1..3480: note = derived and/or modified CDS sequence (opt1) from RVFV__JQ068143.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcgcaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatcgactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctgatcaactaccagtgccacacggccctcagcgccttcgtggtcgtgttcgtgttctccagcgtcgccatcatctgcctggccatcctgtacaaggtgctccgctgcctgaagatcgcgcccaagaaggtgctgaaccccctcatgtggatcaccgccttcatccggtgggtctacaagaagatggtggcccgcgtggccgacaacatcaaccaggtcaaccgggagatcggctggatggagggcgggcagctggccctgggcaaccccgcgccgatcccccgccacgcccccatcccccgctactccacctacctcatgctgctgctcatcatcagctacgcctccgcctgcagcgagctgatccaggcgtccagccggatcaccacgtgctccaccgagggggtgaacaccaagtgccgcctgagcggcaccgccctgatccgggccgggtccgtgggcgccgaggcctgcctcatgctgaagggggtcaaggaggaccagacgaagttcctgaagatcaagaccgtgagctccgagctcagctgccgcgagggccagtcctactggaccggcagcttcagcccgaagtgcctgtccagccggcgctgccacctggtgggggagtgccacgtcaaccggtgcctctcctggcgcgacaacgagaccagcgcggagttctccttcgtgggcgagagcacgaccatgcgggagaacaagtgcttcgagcagtgcgggggctgggggtgcggctgcttcaacgtgaacccctcctgcctgttcgtccacacctacctgcagagcgtgcgcaaggaggccctccgggtgttcaactgcatcgactgggtccacaagctgaccctggagatcaccgacttcgacggctccgtgagcacgatcgacctcggggcctccagctcccgcttcaccaactggggcagcgtgtccctgagcctggacgccgaggggatctccggcagcaactccttcagcttcatcgagagccccgggaagggctacgccatcgtcgacgagcccttctccgagatcccgcggcagggcttcctcggggagatccgctgcaacagcgagtccagcgtgctgtccgcgcacgagagctgcctgcgggcccccaacctcatctcctacaagcccatgatcgaccagctggagtgcaccaccaacctgatcgaccccttcgtggtcttcgagcgcggcagcctcccgcagacgcggaacgacaagaccttcgccgcctccaaggggaaccgcggcgtgcaggccttcagcaaggggtccgtgcaggcggacctgaccctgatgttcgacaacttcgaggtcgacttcgtgggcgccgccgtgagctgcgacgccgcgttcctcaacctgaccggctgctactcctgcaacgccggggcccgggtctgcctgagcatcacgtccaccggcaccgggaccctcagcgcccacaacaaggacggctccctgcacatcgtgctgcccagcgagaacggcacgaaggaccagtgccagatcctccacttcaccgtgcccgaggtcgaggaggagttcatgtactcctgcgacggggacgagcgccccctgctggtgaagggcaccctcatcgccatcgacccgttcgacgaccgccgggaggccgggggcgagagcaccgtggtcaaccccaagagcgggtcctggaacttcttcgactggttcagcggcctgatgtcctggttcggcgggcccctgaagacgatcctcctgatctgcctgtacgtggccctcagcatcggcctgttcttcctgctcatctacctggggcgcaccggcctgtccaagatgtggctcgccgccaccaagaaggccagctga

SEQ ID NO: 12854 - RNA, 3480 nt, synthetic construct
  misc_feature 1..3480: note = derived and/or modified CDS sequence (opt1) from RVFV(200803169)__JF311384.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcgcaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtgatcttcgtgttctccagcaccgccatcatctgcctggccgtcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggccctgggcaaccccgcgccgatcccccgccacgcccccatcccccggtactccacctacctcatgctgctgctcatcgtgagctacgcctccgcctgcagcgagctgatccaggcgtccagccgcatcacgacctgctccaccgagggggtgaacaccaagtgccggctgagcggcacggccctgatccgcgccgggtccgtcggcgccgaggcctgcctcatgctgaagggggtgaaggtggaccagaccaagttcctgaagatcaagaccgtcagctccgagctcagctgccgggagggccagtcctactggaccggcagcttcagcccgaagtgcctgtccagccgccggtgccacctggtgggggagtgccacgtgaaccgctgcctctcctggcgggacaacgagacgagcgcggagttctccttcgtcggcgagagcaccaccatgcgcgagaacaagtgcttcgagcagtgcgggggctgggggtgcggctgcttcaacgtgaacccctcctgcctgttcgtgcacacctacctgcagagcgtccggaaggaggccctccgcgtgttcaactgcatcgactgggtgcacaagctgaccctggagatcacggacttcgacggctccgtcagcaccatcgacctcggggcctccagctcccggttcaccaactggggcagcgtgtccctgagcctggacgccgaggggatctccggcagcaactccttcagcttcatcgagagccccgggaagggctacgccatcgtggacgagcccttctccgagatcccgcgccagggcttcctcggggaggtccggtgcaacagcgagtccagcgtgctgtccgcgcacgagagctgcctgcgcgcccccaacctcgtgtcctacaagcccatgatcgaccagctggagtgcaccacgaacctgatcgaccccttcgtcgtgttcgagcggggcagcctcccgcagacccgcaacgacaagaccttcgccgcctccaaggggaaccggggcgtgcaggccttcagcaaggggtccgtccaggcggacctgaccctgatgttcgacaacttcgaggtggacttcgtgggcgccgccgtcagctgcgacgccgcgttcctcaacctgacgggctgctactcctgcaacgccggggcccgcgtgtgcctgagcatcacctccaccggcaccgggacgctcagcgcccacaacaaggacggctccctgcacatcgtgctgcccagcgagaacggcaccaaggaccagtgccagatcctccacttcaccgtccccgaggtggaggaggagttcatgtactcctgcgacggggacgagcgccccctgctggtcaagggcaccctcatcgccatcgacccgttcgacgaccggcgcgaggccgggggcgagagcacggtggtgaaccccaagagcgggtcctggaacttcttcgactggttcagcggcctgatgtcctggttcggcgggcccctgaagaccatcctcctgatctgcctgtacgtcgccctcagcatcggcctgttcttcctgctcatctacctggggcggaccggcctgtccaagatgtggctcgccgccaccaagaaggccagctga

SEQ ID NO: 12855 - RNA, 3480 nt, synthetic construct
  misc_feature 1..3480: note = derived and/or modified CDS sequence (opt1) from RVFV(2007002445)__EU574037.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcgcaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtgatcttcgtgttctccagcaccgccatcatctgcctggccgtcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggccctgggcaaccccgcgccgatcccccgccacgcccccatcccccggtactccacctacctcatgctgctgctcatcgtgagctacgcctccgcctgcagcgagctgatccaggcgtccagccgcatcacgacctgctccaccgagggggtgaacaccaagtgccggctgagcggcacggccctgatccgcgccgggtccgtcggcgccgaggcctgcctcatgctgaagggggtgaaggaggaccagaccaagttcctgaagatcaagaccgtgagctccgagctcagctgccgggagggccagtcctactggaccggcagcttcagcccgaagtgcctgtccagccgccggtgccacctggtcggggagtgccacgtgaaccgctgcctctcctggcgggacaacgagacgagcgcggagttctccttcgtgggcgagagcaccaccatgcgcgagaacaagtgcttcgagcagtgcgggggctgggggtgcggctgcttcaacgtcaacccctcctgcctgttcgtgcacacctacctgcagagcgtgcggaaggaggccctccgcgtcttcaactgcatcgactgggtgcacaagctgaccctggagatcacggacttcgacggctccgtgagcaccatcgacctcggggcctccagctcccggttcaccaactggggcagcgtctccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtgctgtccgcgcacgagagctgcctgcgcgcccccaacctcgtctcctacaagcccatgatcgaccagctggagtgcaccacgaacctgatcgaccccttcgtggtgttcgagcggggcagcctcccgcagacccgcaacgagaagaccttcgccgcctccaaggggaaccggggcgtccaggccttcagcaaggggtccatccaggcggacctgaccctgatgttcgacaacttcgaggtggacttcgtgggcgccgccgtcagctgcgacgccgcgttcctcaacctgacgggctgctactcctgcaacgccggggcccgcgtgtgcctgagcatcacctccaccggcaccgggacgctcagcgcccacaacaaggacggctccctgcacatcgtgctgcccagcgagaacggcaccaaggaccagtgccagatcctccacttcaccgtccccgaggtggaggaggagttcatgtactcctgcgacggggacgagcgccccctgctggtgaagggcaccctcatcgccatcgacccgttcgacgaccggcgcgaggccgggggcgagagcacggtcgtgaaccccaagagcgggtcctggaacttcttcgactggttcagcggcctgatgtcctggttcggcgggcccctgaagaccatcctcctgatctgcctgtacgtcgccctcagcatcggcctgttcttcctgctcatctacctggggcggaccggcctgtccaagatgtggctcgccgccaccaagaaggccagctga

SEQ ID NO: 12856 - RNA, 3480 nt, synthetic construct
  misc_feature 1..3480: note = derived and/or modified CDS sequence (opt1) from RVFV(Hv-B375)__DQ380218.1__NSm-Gn-Gc
  source 1..3480: mol_type = other RNA
atgatcgagggcgcctgggacagcctgcgcgagggggagatgcccgaggagctctcctgcagcatctccggcatccgggaggtgaagaccagctcccaggagctgtaccgcgccctgaaggcgatcatcgccgccgacgggctcaacaacatcacgtgccacggcaaggacccggaggacaagatcagcctgatcaaggggccgccccacaagaagcgggtcggcatcgtgcgctgcgagcggcgccgggacgccaagcagatcggccgcgagaccatggccgggatcgcgatgaccgtgctgcccgccctcgccgtcttcgccctggcgcccgtggtgttcgccgaggacccccacctccggaaccgccccggcaaggggcacaactacatcgacggcatgacccaggaggacgcgacctgcaagcccgtcacgtacgccggggcctgctccagcttcgacgtgctgctggagaagggcaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacgggaagatggcctccgtgaagtgcccgcccaagaacgagctgacggaggactgcaacttctgccgccagatgaccggcgccagcctcaagaaggggtcctaccccctgcaggacctgttctgccagagctccgaggacgacggcagcaagctcaagaccaagatgaagggcgtgtgcgaggtcggggtgcaggccctgaagaagtgcgacggccagctgtccaccgcccacgaggtggtccccttcgcggtgttcaagaacagcaagaaggtgtacctcgacaagctggacctgaagacggaggagaacctcctgcccgacagcttcgtctgcttcgagcacaaggggcagtacaagggcaccatggactccgggcagaccaagcgggagctcaagagcttcgacatctcccagtgccccaagatcggcggccacgggagcaagaagtgcaccggcgacgccgccttctgctccgcctacgagtgcacggcccagtacgcgaacgcctactgcagccacgccaacgggtccggcatcgtgcagatccaggtgagcggggtctggaagaagcccctgtgcgtgggctacgagcgcgtggtcgtgaagcgggagctgtccgccaagccgatccagcgcgtcgagccctgcacgacctgcatcaccaagtgcgagccccacggcctggtggtgcggagcaccgggttcaagatctccagcgcggtcgcctgcgcctccggcgtgtgcgtgaccgggagccagtcccccagcaccgagatcaccctcaagtacccgggcatctcccagagctccgggggcgacatcggcgtccacatggcccacgacgaccagagcgtgagctccaagatcgtggcccactgcccgccccaggacccctgcctggtccacgggtgcatcgtgtgcgcgcacggcctgatcaactaccagtgccacacggccctcagcgccttcgtggtcgtgttcgtgttctccagcatcgccatcatctgcctggccatcctgtaccgcgtcctcaagtgcctgaagatcgcgccccggaaggtgctgaaccccctcatgtggatcaccgccttcatccgctgggtgtacaagaagatggtcgcccgggtggccgacaacatcaaccaggtgaaccgcgagatcgggtggatggagggcggccagctggtcctggggaaccccgccccgatcccccgccacgcgcccatcccccggtactccacctacctcatgctgctgctcatcgtgagctacgcctccgcctgcagcgagctgatccaggcctccagccgcatcaccacgtgctccaccgagggcgtgaacaccaagtgccggctgagcgggaccgcgctgatccgcgccggctccgtcggggccgaggcctgcctcatgctgaagggcgtgaaggaggaccagacgaagttcctgaagatcaagaccgtgagctccgagctcagctgccgggagggccagtcctactggaccgggagcttcagcccgaagtgcctgtccagccgccggtgccacctggtcggcgagtgccacgtgaaccgctgcctctcctggcgggacaacgagaccagcgccgagttctccttcgtgggggagagcacgaccatgcgcgagaacaagtgcttcgagcagtgcggcgggtggggctgcggctgcttcaacgtcaacccctcctgcctgttcgtgcacacctacctgcagagcgtgcggaaggaggcgctccgcgtcttcaactgcatcgactgggtgcacaagctgaccctggagatcaccgacttcgacgggtccgtgagcacgatcgacctcggcgcctccagctcccggttcaccaactgggggagcgtctccctgagcctggacgccgagggcatctccgggagcaactccttcagcttcatcgagagccccggcaagggctacgccatcgtggacgagcccttctccgagatcccgcgccaggggttcctcggcgagatccggtgcaacagcgagtccagcgtgctgtccgcccacgagagctgcctgcgcgcgcccaacctcatctcctacaagcccatgatcgaccagctggagtgcaccaccaacctgatcgaccccttcgtcgtgttcgagcgggggagcctcccgcagacgcgcaacgacaagaccttcgccgcctccaagggcaaccgcggggtgcaggccttcagcaagggctccgtccaggccgacctgaccctgatgttcgacaacttcgaggtggacttcgtgggcgcggccgtcagctgcgacgccgccttcctcaacctgaccgggtgctactcctgcaacgcgggcgcccgggtgtgcctgagcatcacgtccaccgggaccggcaccctcagcgcccacaacaaggacggctccctgcacatcgtgctgcccagcgagaacgggacgaaggaccagtgccagatcctccacttcaccgtccccgaggtggaggaggagttcatgtactcctgcgacggcgacgagcgccccctgctggtgaaggggaccctcatcgccatcgacccgttcgacgaccggcgcgaggccggcggggagagcaccgtcgtgaaccccaagagcggctcctggaacttcttcgactggttcagcggcctgatgtcctggttcgggggccccctgaagacgatcctcctgatctgcctgtacgtcgcgctcagcatcgggctgttcttcctgctcatctacctgggccggaccgggctgtccaagatgtggctcgccgccaccaagaaggccagctga

SEQ ID NO: 12857 - RNA, 3480 nt, synthetic construct
  misc_feature 1..3480: note = derived and/or modified CDS sequence (opt1) from RVFV(clone 13)__DQ380213.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagcacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagaacccctccaccgagatcaccctcaagtacccggggatcagccagtccagcggcggggacatcggcgtccacatggcccacgacgaccagtccgtgagcagcaagatcgtggcccactgcccgccccaggacccctgcctggtccacggctgcatcgtgtgcgcgcacgggctgatcaactaccagtgccacacggccctctccgccttcgtggtcgtgttcgtgttcagctccatcgccatcatctgcctggccatcctgtaccgcgtcctcaagtgcctgaagatcgcgccccggaaggtgctgaaccccctcatgtggatcaccgccttcatccgctgggtgtacaagaagatggtcgcccgggtggccgacaacatcaaccaggtgaaccgcgagatcggctggatggagggcgggcagctggtcctgggcaaccccgccccgatcccccgccacgcgcccatcccccggtacagcacctacctcatgctgctgctcatcgtgtcctacgccagcgcctgctccgagctgatccaggccagctcccgcatcaccacgtgcagcaccgagggggtgaacaccaagtgccggctgtccggcaccgcgctgatccgcgccgggagcgtcggcgccgaggcctgcctcatgctgaagggggtgaaggacgaccagacgaagttcctgaagatcaagaccgtgtccagcgagctctcctgccgggagggccagagctactggaccggctccttcagcccgaagtgcctgagctcccgccggtgccacctggtcggggagtgccacgtgaaccgctgcctcagctggcgggacaacgagacctccgccgagttcagcttcgtgggcgagtccacgaccatgcgcgagaacaagtgcttcgagcagtgcgggggctgggggtgcggctgcttcaacgtcaaccccagctgcctgttcgtgcacacctacctgcagtccgtgcggaaggaggcgctccgcgtcttcaactgcatcgactgggtgcacaagctgaccctggagatcaccgacttcgacggcagcgtgtccacgatcgacctcggggccagctccagccggttcaccaactggggctccgtcagcctgtccctggacgccgaggggatcagcggctccaacagcttctccttcatcgagagccccgggaagggctacgccatcgtggacgagcccttcagcgagatcccgcgccagggcttcctcggggagatccggtgcaactccgagagctccgtgctgagcgcccacgagtcctgcctgcgcgcgcccaacctcatcagctacaagcccatgatcgaccagctggagtgcaccaccaacctgatcgaccccttcgtcgtgttcgagcggggctccctcccgcagacgcgcaacgagaagaccttcgccgccagcaaggggaaccggggcgtgcaggccttctccaaggggagcgtccaggccgacctgaccctgatgttcgacaacttcgaggtggacttcgtgggcgcggccgtctcctgcgacgccgccttcctcaacctgaccggctgctacagctgcaacgcgggggcccgcgtgtgcctgtccatcacgagcaccggcaccgggaccctctccgcccacaacaaggacggcagcctgcacatcgtgctgccctccgagaacggcacgaaggaccagtgccagatcctccacttcaccgtccccgaggtggaggaggagttcatgtacagctgcgacggggacgagcgccccctgctggtgaagggcaccctcatcgccatcgacccgttcgacgaccggcgcgaggccgggggcgagtccaccgtcgtgaaccccaagagcgggagctggaacttcttcgactggttctccggcctgatgagctggttcggcgggcccctgaagacgatcctcctgatctgcctgtacgtcgcgctctccatcggcctgttcttcctgctcatctacctggggcggaccggcctgagcaagatgtggctcgccgccaccaagaaggcctcctga

SEQ ID NO: 12858 - RNA, 3480 nt, synthetic construct
  misc_feature 1..3480: note = derived and/or modified CDS sequence (opt1) from RVFV(Kenya 57 (Rintoul))__DQ380192.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgcaccgcgccctgaaggcgatcatcgccgccgacggcctcaacaacatcacgtgccacgggaaggacccggaggacaagatcagcctgatcaagggcccgccccacaagaagcgggtcggggtggtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagatcaagcgggagctcaagagcttcgacatctcccagtgccccaagatcgggggccacggcagcaagaagtgcaccggggacgccgccttctgctccgcctacgagtgcaccgcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcacgggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacaccgccctcagcgccttcgtcgtggtgttcgtcttctccagcgtggccatcatctgcctggccatcctgtacaaggtgctcaagtgcctgaagatcgcgccccgcaaggtcctgaaccccctcatgtggatcacggccttcatccggtgggtgtacaagaagatggtggcccgcgtcgccgacaacatcaaccaggtgaaccgggagatcggctggatggagggcgggcagctggtgctgggcaaccccgccccgatcccccgccacgcgcccatcccccgctactccacctacctcatgctgctgctcatcgtcagctacgcctccgcctgcagcgagctgatccaggcctccagccggatcacgacctgctccaccgagggggtgaacaccaagtgccgcctgagcggcaccgcgctgatccgggccgggtccgtgggcgccgaggcctgcctcatgctgaagggggtcaaggaggaccagaccaagttcctgaagatcaagacggtgagctccgagctcagctgccgcgagggccagtcctactggaccggcagcttcagcccgaagtgcctgtccagccggcgctgccacctggtgggggagtgccacgtcaaccggtgcctctcctggcgcgacaacgagaccagcgccgagttctccttcgtgggcgagagcaccacgatgcgggagaacaagtgcttcgagcagtgcgggggctgggggtgcggctgcttcaacgtgaacccctcctgcctgttcgtccacacctacctgcagagcgtgcgcaaggaggcgctccgggtgttcaactgcatcgactgggtccacaagctgaccctggagatcaccgacttcgacggctccgtgagcaccgtggacctcggggcctccagctcccgcttcacgaactggggcagcgtctccctgagcctggacgccgaggggatctccggcagcaactccttcagcttcatcgagagccccgggaagggctacgccatcgtggacgagcccttctccgagatcagccggcagggcttcctcggggagatccgctgcaactccgagagctccgtgctgagcgcccacgagtcctgcctgcgggcgccgaacctcatcagctacaagcccatgatcgaccagctggagtgcaccaccaacctgatcgaccccttcgtcgtgttcgagcgcggctccctcccccagacccggaacgacaagacgttcgccgccagcaaggggaaccgcggcgtgcaggccttctccaaggggagcgtccaggccgacctgaccctgatgttcgacaacttcgaggtggacttcgtgggcgcggccgtctcctgcgacgccgccttcctcaacctgaccggctgctacagctgcaacgcgggggcccgggtgtgcctgtccatcaccagcacgggcaccgggaccctctccgcccacaacaaggacggcagcctgcacatcgtgctgccgtccgagaacggcaccaaggaccagtgccagatcctccacttcacggtccccgaggtggaggaggagttcatgtacagctgcgacggggacgagcgccccctgctggtcaagggcaccctcatcgccatcgaccccttcgacgaccgccgggaggccgggggcgagagcaccgtggtgaacccgaagtccgggagctggaacttcttcgactggttctccggcctgatgagctggttcggcgggcccctgaagaccatcctcctgatctgcctgtacgtcgcgctctccatcggcctgttcttcctgctcatctacctggggcgcacgggcctgagcaagatgtggctcgccgccaccaagaaggcctcctga

SEQ ID NO: 12859 - RNA, 3480 nt, synthetic construct
  misc_feature 1..3480: note = derived and/or modified CDS sequence (opt1) from RVFV(2007001292)__EU574046.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcgcaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtgatcttcgtgttctccagcaccgccatcatctgcctggccgtcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggccctgggcaaccccgcgccgatcccccgccacgcccccatcccccggtactccacctacctcatgctgctgctcatcgtgagctacgcctccgcctgcagcgagctgatccaggcgtccagccgcatcacgacctgctccaccgagggggtgaacaccaagtgccggctgagcggcacggccctgatccgcgccgggtccgtcggcgccgaggcctgcctcatgctgaagggggtgaaggaggaccagaccaagttcctgaagatcaagaccgtgagctccgagctcagctgccgggagggccagtcctactggaccggcagcttcagcccgaagtgcctgtccagccgccggtgccacctggtcggggagtgccacgtgaaccgctgcctctcctggcgggacaacgagacgagcgcggagttctccttcgtgggcgagagcaccaccatgcgcgagaacaagtgcttcgagcagtgcgggggctgggggtgcggctgcttcaacgtcaacccctcctgcctgttcgtgcacacctacctgcagagcgtgcggaaggaggccctccgcgtcttcaactgcatcgactgggtgcacaagctgaccctggagatcacggacttcgacggctccgtgagcaccatcgacctcggggcctccagctcccggttcaccaactggggcagcgtctccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtgctgtccgcgcacgagagctgcctgcgcgcccccaacctcgtctcctacaagcccatgatcgaccagctggagtgcaccacgaacctgatcgaccccttcgtggtgttcgagcggggcagcctcccgcagacccgcaacgacaagaccttcgccgcctccaaggggaaccggggcgtccaggccttcagcaaggggtccgtgcaggcggacctgaccctgatgttcgacaacttcgaggtggacttcgtcggcgccgccgtgagctgcgacgccgcgttcctcaacctgacgggctgctactcctgcaacgccggggcccgcgtgtgcctgagcatcacctccaccggcaccgggacgctcagcgcccacaacaaggacggctccctgcacatcgtcctgcccagcgagaacggcaccaaggaccagtgccagatcctccacttcaccgtgcccgaggtggaggaggagttcatgtactcctgcgacggggacgagcgccccctgctggtcaagggcaccctcatcgccatcgacccgttcgacgaccggcgcgaggccgggggcgagagcacggtggtcaaccccaagagcgggtcctggaacctgttcgactggttcagcggcctgatgtcctggttcggcgggcccctcaagaccatcctgctgatctgcctctacgtggccctgagcatcggcctgttcttcctcctgatctacctggggcggaccggcctctccaagatgtggctggccgccaccaagaaggccagctga

SEQ ID NO: 12860 - RNA, 3480 nt, synthetic construct
  misc_feature 1..3480: note = derived and/or modified CDS sequence (opt1) from RVFV(2007001811)__EU574040.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtggtgttcgtcttctccagcatcgccatcatctgcctggccatcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggtgctgggcaaccccgccccgatcccccgccacgcgcccatcccccggtactccacctacctcatgctgctgctcatcgtgagctacgcctccgcctgcagcgagctgatccaggcctccagccgcatcaccacgtgctccaccgagggggtcaacaccaagtgccggctgagcggcaccgcgctgatccgcgccgggtccgtgggcgccgaggcctgcctcatgctgaagggggtgaaggaggaccagacgaagttcctgatgatcaagaccgtcagctccgagctcagctgccgggagggccagtcctactggaccggcagcttcagcccgaagtgcctgtccagccgccggtgccacctggtgggggagtgccacgtgaaccgctgcctctcctggcgggacaacgagaccagcgccgagttctccttcgtcggcgagagcacgaccatgcgcgagaacaagtgcttcgagcagtgcgggggctgggggtgcggctgcttcaacgtgaacccctcctgcctgttcgtgcacacctacctgcagagcgtccggaaggaggcgctccgcgtgttcaactgcatcgactgggtgcacaagctgaccctggagatcaccgacttcgacggctccgtcagcacgatcgacctcggggcctccagctcccggttcaccaactggggcagcgtgtccctgagcctggacgccgaggggatctccggcagcaactccttcagcttcatcgagagccccgggaagggctacgccatcgtggacgagcccttctccgagatcccgcgccagggcttcctcggggagatccggtgcaacagcgagtccagcgtcctgtccgcccacgagagctgcctgcgcgcgcccaacctcatctcctacaagcccatgatcgaccagctggagtgcaccaccaacctgatcgaccccttcgtggtgttcgagcggggcagcctcccgcagacgcgcaacgagaagaccttcgccgcctccaaggggaaccggggcgtccaggccttcagcaaggggtccgtgcaggccgacctgaccctgatgttcgacaacttcgaggtggacttcgtcggcgcggccgtgagctgcgacgccgccttcctcaacctgaccggctgctactcctgcaacgcgggggcccgcgtgtgcctgagcatcacgtccaccggcaccgggaccctcagcgcccacaacaaggacggctccctgcacatcgtcctgcccagcgagaacggcacgaaggaccagtgccagatcctccacttcaccgtgcccgaggtggaggaggagttcatgtactcctgcgacggggacgagcgccccctgctggtcaagggcaccctcatcgccatcgacccgttcgacgaccggcgcgaggccgggggcgagagcaccgtggtcaaccccaagagcgggtcctggaacttcttcgactggttcagcggcctgatgtcctggttcggcgggcccctgaagacgatcctcctgatctgcctgtacgtggcgctcagcatcggcctgttcttcctgctcatctacctggggcggaccggcctgtccaagatgtggctcgccgccaccaagaaggccagctga

SEQ ID NO: 12861 - RNA, 3480 nt, synthetic construct
  misc_feature 1..3480: note = derived and/or modified CDS sequence (opt1) from RVFV(ANK-6087)__DQ380216.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaagctggactccggccagaccaagcgggagctcaagagcttcgacatctcccagtgccccaagatcgggggccacggcagcaagaagtgcaccggggacgccgccttctgctccgcctacgagtgcaccgcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctcgtggtgcggagcaccggcttcaagatctccagcgcggtcgcctgcgcctccggggtgtgcgtgacgggcagccagtcccccagcaccgagatcaccctgaagtacccggggatctcccagagctccggcggggacatcggcgtccacatggcccacgacgaccagagcgtgagctccaagatcgtggcccactgcccgccccaggacccctgcctggtccacggctgcatcgtgtgcgcgcacgggctcatcaactaccagtgccacaccgccctgagcgccttcgtggtcgtgttcgtgttctccagcatcgccatcatctgcctggccatcctctaccgcgtcctgaagtgcctgaagatcgcgccccggaaggtgctcaaccccctgatgtggatcacggccttcatccgctgggtgtaccggaagatggtcgcccgcgtggccgacaacatcaaccaggtgaaccgcgagatcggctggatggagggcgggcagctggtcctcggcaaccccgccccgatcccccggcacgtgcccatcccccgctactccacctacctgatgctgctcctgatcgtgagctacgcgtccgcctgcagcgagctgatccaggcctccagccggatcacgacctgctccaccgagggggtcaacaccaagtgccgcctgagcggcaccgccctcatccgggcggggtccgtgggcgccgaggcctgcctgatgctgaagggggtgaaggaggaccagaccaagttcctcaagatcaagacggtcagctccgagctgagctgccgcgagggccagtcctactggaccggcagcttcagcccgaagtgcctgtccagccggcgctgccacctcgtgggggagtgccacgtgaaccggtgcctgtcctggcgcgacaacgagaccagcgccgagttctccttcgtcggcgagagcaccacgatgcgggagaacaagtgcttcgagcagtgcgggggctgggggtgcggctgcttcaacgtgaacccctcctgcctgttcgtgcacacctacctccagagcgtccgcaaggaggccctgcgggtgttcaactgcatcgactgggtgcacaagctgaccctcgagatcaccgacttcgacggctccgtcagcaccatcgacctgggggcgtccagctcccgcttcacgaactggggcagcgtgtccctgagcctcgacgccgaggggatctccggcagcaactccttcagcttcatcgagagccccgggaagggctacgccatcgtggacgagcccttctccgagatcccgcggcagggcttcctgggggagatccgctgcaacagcgagtccagcgtcctgtccgcccacgagagctgcctccgggcccccaacctgatctcctacaagcccatgatcgaccagctggagtgcagcaccaacctcatcgaccccttcgtggtgttcaagcgcggctccctgccgcagacccggaacgacaagaccttcgcggccagcaaggggaaccgcggcgtccaggccttctccaaggggagcgtgcaggccgacctgacgctcatgttcgacaacttcgaggtggacttcgtcggcgccgcggtgtcctgcgacgccgccttcctgaacctgaccggctgctacagctgcaacgccggggcgcgcgtgtgcctctccatcaccagcaccggcacggggaccctgtccgcccacaacaaggacggcagcctgcacatcgtcctcccctccgagaacggcaccaaggaccagtgccagatcctgcacttcaccgtgcccgaggtggaggaggagttcatgtacagctgcgacggggacgagcggcccctgctcgtccgcggcacgctgatcgccatcgacccgttcgacgaccggcgcgaggccgggggcgagagcaccgtggtcaaccccaagtccgggagctggaacttcttcgactggttctccggcctgatgagctggttcggcgggcccctcaagaccatcctgctgatctgcctctacgtggccctgtccatcggcctgttcttcctcctgatctacctggggcggaccggcctcagcaagatgtggctggcggccacgaagaaggcctcctga

SEQ ID NO: 12862 - RNA, 3480 nt, synthetic construct
  misc_feature 1..3480: note = derived and/or modified CDS sequence (opt1) from RVFV(2007000234)__JF326191.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatccgccgggagaccatggccggcatcgcgatgaccgtcctgcccgccctcgccgtgttcgccctggcgcccgtggtcttcgccgaggacccccacctccgcaaccggcccggcaaggggcacaactacatcgacggcatgacccaggaggacgcgacctgcaagcccgtgacgtacgccggggcctgctccagcttcgacgtgctgctggagaagggcaagttcccgctgttccagtcctacgcccaccaccgcaccctcctggaggccgtccacgacaccatcatcgccaaggccgacccgcccagctgcgacctgcagtccgcccacgggaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccggcagatgaccggcgccagcctcaagaaggggtcctaccccctgcaggacctgttctgccagagctccgaggacgacggcagcaagctcaagaccaagatgaagggggtctgcgaggtgggcgtgcaggccctgaagaagtgcgacggccagctgtccaccgcccacgaggtcgtgcccttcgcggtgttcaagaacagcaagaaggtctacctcgacaagctggacctgaagacggaggagaacctcctgcccgacagcttcgtgtgcttcgagcacaaggggcagtacaagggcaccatggactccgggcagaccaagcgcgagctcaagagcttcgacatctcccagtgccccaagatcggcgggcacggcagcaagaagtgcaccggcgacgccgccttctgctccgcctacgagtgcacggcccagtacgcgaacgcctactgcagccacgccaacgggtccggcatcgtgcagatccaggtcagcggggtgtggaagaagcccctgtgcgtgggctacgagcgggtcgtggtcaagcgcgagctgtccgccaagccgatccagcgggtggagccctgcacgacctgcatcaccaagtgcgagccccacgggctggtggtccgcagcaccggcttcaagatctccagcgcggtggcctgcgcctccggcgtgtgcgtcaccgggagccagtcccccagcaccgagatcaccctcaagtacccgggcatctcccagagctccgggggcgacatcggggtgcacatggcccacgacgaccagagcgtgagctccaagatcgtcgcccactgcccgccccaggacccctgcctggtgcacggctgcatcgtgtgcgcgcacggcctgatcaactaccagtgccacacggccctcagcgccttcgtcgtgatcttcgtgttctccagcaccgccatcatctgcctggccgtcctgtaccgggtgctcaagtgcctgaagatcgcgccccgcaaggtgctgaaccccctcatgtggatcaccgccttcatccggtgggtctacaagaagatggtggcccgcgtggccgacaacatcaaccaggtcaaccgcgagatcgggtggatggagggcgggcagctggccctgggcaaccccgcgccgatcccccggcacgcccccatcccccgctactccacctacctcatgctgctgctcatcgtgagctacgcctccgcctgcagcgagctgatccaggcgtccagccggatcacgacctgctccaccgagggcgtgaacaccaagtgccgcctgagcgggacggccctgatccgggccggctccgtcggggccgaggcctgcctcatgctgaagggcgtgaaggaggaccagaccaagttcctgaagatcaagaccgtgagctccgagctcagctgccgcgaggggcagtcctactggaccggcagcttcagcccgaagtgcctgtccagccggcgctgccacctggtcggcgagtgccacgtgaaccggtgcctctcctggcgcgacaacgagacgagcgcggagttctccttcgtgggggagagcaccaccatgcgggagaacaagtgcttcgagcagtgcggcgggtggggctgcgggtgcttcaacgtcaacccctcctgcctgttcgtgcacacctacctgcagagcgtgcgcaaggaggccctccgggtcttcaactgcatcgactgggtgcacaagctgaccctggagatcacggacttcgacggctccgtgagcaccatcgacctcggcgcctccagctcccgcttcaccaactgggggagcgtctccctgagcctggacgccgagggcatctccgggagcaactccttcagcttcatcgagagccccggcaaggggtacgccatcgtggacgagcccttctccgagatcccgcggcagggcttcctcggcgagatccgctgcaacagcgagtccagcgtgctgtccgcgcacgagagctgcctgcgggcccccaacctcgtctcctacaagcccatgatcgaccagctggagtgcaccacgaacctgatcgaccccttcgtggtgttcgagcgcgggagcctcccgcagacccggaacgacaagaccttcgccgcctccaagggcaaccgcggggtccaggccttcagcaagggctccgtgcaggcggacctgaccctgatgttcgacaacttcgaggtggacttcgtcggggccgccgtgagctgcgacgccgcgttcctcaacctgacgggctgctactcctgcaacgccggcgcccgcgtgtgcctgagcatcacctccaccgggaccggcacgctcagcgcccacaacaaggacgggtccctgcacatcgtcctgcccagcgagaacggcaccaaggaccagtgccagatcctccacttcaccgtgcccgaggtggaggaggagttcatgtactcctgcgacggcgacgagcggcccctgctggtcaaggggaccctcatcgccatcgacccgttcgacgaccgccgggaggcgggcggggagagcacggtggtcaaccccaagagcggctcctggaacttcttcgactggttcagcgggctgatgtcctggttcggcggccccctgaagaccatcctcctgatctgcctgtacgtggccctcagcatcgggctgttcttcctgctcatctacctgggccgcaccgggctgtccaagatgtggctcgccgccaccaagaaggccagctga

SEQ ID NO: 12863 - RNA, 3480 nt, synthetic construct
  misc_feature 1..3480: note = derived and/or modified CDS sequence (opt1) from RVFV(SA-75)__DQ380189.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctggtcaagggcccgccccacaagaagcgggtggggatcgtgcgctgcgagcggcgccgggacgccaagcagatcggccgcgagaccatggcccggatcgcgatgaccgtcctgcccgccctcgccgtgttcgccctggcgcccgtggtcttcgccgaggacccccacctccgcaaccggcccggcaaggggcacaactacatcgacggcatgacccaggaggacgcgacctgcaagcccgtgacgtacgccggggcctgctccagcttcgacgtgctgctggagaagggcaagttcccgctgttccagtcctacgcccaccaccgcaccctcctggaggccgtccacgacaccatcatcgccaaggccgacccgcccagctgcgacctgcagtccgcccacgggaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccggcagatgaccggcgccagcctcaagaaggggtcctaccccctgcaggacctgttctgccagagctccgaggacgacggcagcaagctcaagaccaagatgaagggggtctgcgaggtgggcgtgcaggccctgaagaagtgcgacggccagctgtccaccgcccacgaggtcgtgcccttcgcggtgttcaagaacagcaagaaggtctacctcgacaagctggacctgaagacggaggagaacctcctgcccgacagcttcgtgtgcttcgagcacaaggggcagtacaagggcaccatggactccgggcagaccaagcgcgagctcaagagcttcgacatctcccagtgccccaagatcggcgggcacggcagcaagaagtgcaccggcgacgccgccttctgctccgcctacgagtgcacggcccagtacgcgaacgcctactgcagccacgccaacgggtccggcgtggtccagatccaggtgagcggggtgtggaagaagcccctgtgcgtcggctacgagcgggtggtcgtgaagcgcgagctgtccgccaagccgatccagcgggtggagccctgcacgacctgcatcaccaagtgcgagccccacgggctggtcgtgcgcagcaccggcttcaagatctccagcgcggtggcctgcgcctccggcgtctgcgtgaccgggagccagtcccccagcaccgagatcaccctcaagtacccgggcatctcccagagctccgggggcgacatcggggtgcacatggcccacgacgaccagagcgtcagctccaagatcgtggcccactgcccgccccaggacccctgcctggtgcacggctgcatcgtctgcgcgcacggcctgatcaactaccagtgccacacggccctcagcgccttcgtggtggtcttcgtgttctccagcgtggccatcatctgcctggccatcctgtacaaggtcctcaagtgcctgaagatcgcgccccggaaggtgctgaaccccctcatgtggatcaccgtgttcatccgctgggtctacaagaagatggtggcccgggtggccgacaacatcaaccaggtcaaccgcgagatcgggtggatggagggcgggcagctggccctgggcaaccccgccccgatcccccgccacgcgcccatcccccggtactccacctacctcatgctgctgctcatcgtgagctacgcctccgcctgcagcgagctgatccaggcctccagccgcatcaccacgtgctccaccgagggcgtgaacaccaagtgccggctgagcgggaccgcgctgatccgcgccggctccgtcggggccgaggcctgcctcatgctgaagggcgtgaaggaggaccagacgaagttcctgaagatcaagaccgtgagctccgagctcagctgccgggaggggcagtcctactggaccggcagcttcagcccgaagtgcctgtccagccgccggtgccacctggtcggcgagtgccacgtgaaccgctgcctctcctggcgggacaacgagaccagcgccgagttctccttcgtgggggagagcacgaccatgcgcgagaacaagtgcttcgagcagtgcggcgggtggggctgcgggtgcttcaacgtcaacccctcctgcctgttcgtgcacacctacctgcagagcgtgcggaaggaggcgctccgcgtcttcaactgcatcgactgggtgcacaagctgaccctggagatcaccgacttcgacggctccgtgagcacgatcgacctcggcgcctccagctcccggttcaccaactgggggagcgtctccctgagcctggacgccgagggcatctccgggagcaactccttcagcttcatcgagagccccggcaaggggtacgccatcgtggacgagcccttctccgagatcccgcgccagggcttcctcggcgagatccggtgcaacagcgagtccagcgtgctgtccgcccacgagagctgcctgcgcgcgcccaacctcatctcctacaagcccatgatcgaccagctggagtgcaccaccaacctgatcgaccccttcgtcgtgttcgagcgggggagcctcccgcagacgcgcaacgacaagaccttcgccgcctccaagggcaaccgcggggtgcaggccttcagcaagggctccgtccaggccgacctgaccctgatgttcgacaacttcgaggtggacttcgtgggggcggccgtcagctgcgacgccgccttcctcaacctgaccggctgctactcctgcaacgcgggcgcccgggtgtgcctgagcatcacgtccaccgggaccggcaccctcagcgcccacaacaaggacgggtccctgcacatcgtgctgcccagcgagaacggcacgaaggaccagtgccagatcctccacttcaccgtccccgaggtggaggaggagttcatgtactcctgcgacggcgacgagcgccccctgctggtcaaggggaccctcatcgccatcgacccgttcgacgaccggcgcgaggccggcggggagagcaccgtggtgaaccccaagagcggctcctggaacttcttcgactggttcagcgggctgatgtcctggttcggcggccccctgaagacgatcctcctgatctgcctgtacgtcgcgctcagcatcgggctgttcttcctgctcatctacctgggccggaccgggctgtccaagatgtggctcgccgccaccaagaaggccagctga

SEQ ID NO: 12864 - RNA, 3480 nt, synthetic construct
  misc_feature 1..3480: note = derived and/or modified CDS sequence (opt1) from RVFV(KEN07-KUR340)__EF460404.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcgcaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctgatcaactaccagtgccacacggccctcagcgccttcgtcgtgatcttcgtgttctccagcaccgccatcatctgcctggccgtcctgtaccgcatgctcaagtgcctgaagatcgcgccccggatcgtgctgaaccccctcatgtggatcaccgccttcatccgctgggtgtacaagaagatggtcgcccgggtggccgacaacatcaaccaggtgaaccgcgagatcggctggatggagggcgggcagctggccctgggcaaccccgcgccgatcccccgccacgcccccatcccccggtactccacctacctcatgctgctgctcatcgtcagctacgcctccgcctgcagcgagctgatccaggcgtccagccgcatcacgacctgctccaccgagggggtgaacaccaagtgccggctgagcggcacggccctgatccgcgccgggtccgtgggcgccgaggcctgcctcatgctgaagggggtcaaggaggaccagaccaagttcctgaagatcaagaccgtgagctccgagctcagctgccgggagggccagtcctactggaccggcagcttcagcccgaagtgcctgtccagccgccggtgccacctggtgggggagtgccacgtcaaccgctgcctctcctggcgggacaacgagacgagcgcggagttctccttcgtgggcgagagcaccaccatgcgcgagaacaagtgcttcgagcagtgcgggggctgggggtgcggctgcttcaacgtgaacccctcctgcctgttcgtccacacctacctgcagagcgtgcggaaggaggccctccgcgtgttcaactgcatcgactgggtccacaagctgaccctggagatcacggacttcgacggctccgtgagcaccatcgacctcggggcctccagctcccggttcaccaactggggcagcgtgtccctgagcctggacgccgaggggatctccggcagcaactccttcagcttcatcgagagccccgggaagggctacgccatcgtcgacgagcccttctccgagatcccgcgccagggcttcctcggggagatccggtgcaacagcgagtccagcgtgctgtccgcgcacgagagctgcctgcgcgcccccaacctcgtgtcctacaagcccatgatcgaccagctggagtgcaccacgaacctgatcgaccccttcgtcgtgttcgagcggggcagcctcccgcagacccgcaacgacaagaccttcgccgcctccaaggggaaccggggcgtgcaggccttcagcaaggggtccgtccaggcggacctgaccctgatgttcgacaacttcgaggtggacttcgtgggcgccgccgtcagctgcgacgccgcgttcctcaacctgacgggctgctactcctgcaacgccggggcccgcgtgtgcctgagcatcacctccaccggcaccgggacgctcagcgcccacaacaaggacggctccctgcacatcgtgctgcccagcgagaacggcaccaaggaccagtgccagatcctccacttcaccgtccccgaggtggaggaggagttcatgtactcctgcgacggggacgagcgccccctgctggtgaagggcaccctcatcgccatcgacccgttcgacgaccggcgcgaggccgggggcgagagcacggtcgtgaaccccaagagcgggtcctggaacttcttcgactggttcagcggcctgatgtcctggttcggcgggcccctgaagaccatcctcctgatctgcctgtacgtcgccctcagcatcggcctgttcttcctgctcatctacctggggcggaccggcctgtccaagatgtggctcgccgccaccaagaaggccagctga

SEQ ID NO: 12865 - RNA, 3480 nt, synthetic construct
  misc_feature 1..3480: note = derived and/or modified CDS sequence (opt1) from RVFV(35/74)__JF784387.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctggtcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccggggtggtccagatccaggtgagcggcgtgtggaagaagcccctgtgcgtcgggtacgagcgcgtggtcgtgaagcgggagctgtccgccaagccgatccagcgcgtggagccctgcacgacctgcatcaccaagtgcgagccccacggcctggtcgtgcggagcaccggcttcaagatctccagcgcggtggcctgcgcctccggggtctgcgtgaccggcagccagtcccccagcaccgagatcaccctcaagtacccggggatctcccagagctccggcggggacatcggcgtgcacatggcccacgacgaccagagcgtcagctccaagatcgtggcccactgcccgccccaggacccctgcctggtgcacggctgcatcgtctgcgcgcacgggctgatcaactaccagtgccacacggccctcagcgccttcgtggtggtcttcgtgttctccagcgtggccatcatctgcctggccatcctgtacaaggtcctcaagtgcctgaagatcgcgccccgcaaggtgctggaccccctcatgtggatcaccgtgttcatccggtgggtctacaagaagatggtggcccgcgtggccgacaacatcaaccaggtcaaccgggagatcggctggatggagggcgggcagctggccctgggcaaccccgccccgatcccccgccacgcgcccatcccccgctactccacctacctcatgctgctgctcatcgtgagctacgcctccgcctgcagcgagctgatccaggcctccagccggatcaccacgtgctccaccgagggggtgaacaccaagtgccgcctgagcggcaccgcgctgatccgggccgggtccgtcggcgccgaggcctgcctcatgctgaagggggtgaaggaggaccagacgaagttcctgaagatcaagaccgtgagctccgagctcagctgccgcgagggccagtcctactggaccggcagcttcagcccgaagtgcctgtccagccggcgctgccacctggtcggggagtgccacgtgaaccggtgcctctcctggcgcgacaacgagaccagcgccgagttctccttcgtgggcgagagcacgaccatgcgggagaacaagtgcttcgagcagtgcgggggctgggggtgcggctgcttcaacgtcaacccctcctgcctgttcgtgcacacctacctgcagagcgtgcgcaaggaggcgctccgggtcttcaactgcatcgactgggtgcacaagctgaccctggagatcaccgacttcgacggctccgtgagcacgatcgacctcggggcctccagctcccgcttcaccaactggggcagcgtctccctgagcctggacgccgaggggatctccggcagcaactccttcagcttcatcgagagccccgggaagggctacgccatcgtggacgagcccttctccgagatcccgcggcagggcttcctcggggagatccgctgcaacagcgagtccagcgtgctgtccgcccacgagagctgcctgcgggcgcccaacctcatctcctacaagcccatgatcgaccagctggagtgcaccaccaacctgatcgaccccttcgtcgtgttcgagcgcggcagcctcccgcagacgcggaacgacaagaccttcgccgcctccaaggggaaccgcggcgtgcaggccttcagcaaggggtccgtccaggccgacctgaccctgatgttcgacaacttcgaggtggacttcgtgggcgcggccgtcagctgcgacgccgccttcctcaacctgaccggctgctactcctgcaacgcgggggcccgggtgtgcctgagcatcacgtccaccggcaccgggaccctcagcgcccacaacaaggacggctccctgcacatcgtgctgcccagcgagaacggcacgaaggaccagtgccagatcctccacttcaccgtccccgaggtggaggaggagttcatgtactcctgcgacggggacgagcgccccctgctggtcaagggcaccctcatcgccatcgacccgttcgacgaccgccgggaggccgggggcgagagcaccgtggtgaaccccaagagcgggtcctggaacttcttcgactggttcagcggcctgatgtcctggttcggcgggcccctgaagacgatcctcctgatctgcctgtacgtcgcgctcagcatcggcctgttcttcctgctcatctacctggggcgcaccggcctgtccaagatgtggctcgccgccaccaagaaggccagctga

SEQ ID NO: 12866 - RNA, 3480 nt, synthetic construct
  misc_feature 1..3480: note = derived and/or modified CDS sequence (opt1) from RVFV(200803167)__JF311382.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgccggtggtcttcgccgaggacctgcacctccggaaccgccccgggaagggccacaactacatcgacgggatgacccaggaggacgcgacctgcaagcccgtgacgtacgccggcgcctgctccagcttcgacgtgctgctggagaaggggaagttccccctcttccagtcctacgcgcaccaccggaccctgctggaggccgtccacgacaccatcatcgccaaggccgacccgcccagctgcgacctccagtccgcccacggcaacccctgcatgaaggagaagctggtgatgaagacccactgccccaacgactaccagagcgcgcactacctgaacaacgacggcaagatggcctccgtgaagtgcccgcccaagtacgagctcacggaggactgcaacttctgccgccagatgaccggggccagcctgaagaagggctcctaccccctgcaggacctcttctgccagagctccgaggacgacgggagcaagctgaagaccaagatgaagggcgtctgcgaggtgggcgtgcaggccctgaagaagtgcgacgggcagctctccaccgcccacgaggtcgtgcccttcgcggtgttcaagaacagcaagaaggtctacctggacaagctggacctcaagacggaggagaacctgctgccggacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagcccatccagcgcgtggagccgtgcacgacctgcatcaccaagtgcgagccccacggcctcgtggtccggagcaccggcttcaagatctccagcgcggtggcctgcgcctccggggtgtgcgtcaccggcagccagtcccccagcaccgagatcgccctgaagtaccccgggatctcccagagctccggcggggacatcggcgtgcacatggcccacgacgaccagagcgtgagctccaagatcgtcgcgcactgcccgccccaggacccctgcctggtgcacggctgcatcgtgtgcgcccacgggctcatcaactaccagtgccacaccgccctgagcgccttcgtcgtggtgttcgtcttctccagcatcgccatcatctgcctggcgatcctctaccgcgtgctgaagtgcctgaagatcgcgccccggaaggtgctcaacccgctgatgtggatcacggccttcatccgctgggtctacaagaagatggtggcccgggtggccgacaacatcaaccaggtcaaccgcgagatcggctggatggagggcgggcagctggtgctcggcaaccccgcccccatcccgcgccacgcccccatcccccggtactccacctacctgatgctgctcctgatcgtgagctacgcctccgcctgcagcgagctgatccaggcgtccagccgcatcacgacctgctccaccgagggggtcaacaccaagtgccggctgagcggcaccgccctcatccgcgccgggtccgtgggcgccgaggcctgcctgatgctgaagggggtgaaggaggaccagaccaagttcctcaagatcaagacggtcagctccgagctgagctgccgggagggccagtcctactggaccggcagcttcagccccaagtgcctgtccagccgccggtgccacctcgtgggggagtgccacgtgaaccgctgcctgtcctggcgggacaacgagaccagcgcggagttctccttcgtcggcgagagcaccacgatgcgcgagaacaagtgcttcgagcagtgcgggggctgggggtgcggctgcttcaacgtgaacccgtcctgcctgttcgtgcacacctacctccagagcgtccggaaggaggccctgcgcgtgttcaactgcatcgactgggtgcacaagctgaccctcgagatcaccgacttcgacggctccgtcagcaccatcgacctgggggcctccagctcccggttcacgaactggggcagcgtgtccctgagcctcgacgccgaggggatctccggcagcaactccttcagcttcatcgagagccccgggaagggctacgccatcgtggacgagcccttctccgagatcccccgccagggcttcctgggggagatccggtgcaacagcgagtccagcgtcctgtccgcgcacgagagctgcctccgcgccccgaacctgatctcctacaagcccatgatcgaccagctggagtgcaccaccaacctcatcgaccccttcgtggtgttcgagcggggcagcctgccccagacccgcaacgacaagacgttcgccgcctccaaggggaaccggggcgtccaggccttcagcaaggggtccgtgcaggcggacctgaccctcatgttcgacaacttcgaggtggacttcgtcggcgccgccgtgagctgcgacgccgcgttcctgaacctgaccggctgctactcctgcaacgccggggcccgcgtgtgcctcagcatcacctccacgggcaccgggaccctgagcgcccacaacaaggacggctccctgcacatcgtcctcccgagcgagaacggcaccaaggaccagtgccagatcctgcacttcacggtgcccgaggtggaggaggagttcatgtactcctgcgacggggacgagcgccccctgctcgtcaagggcaccctgatcgccatcgaccccttcgacgaccggcgcgaggccgggggcgagagcaccgtggtcaaccccaagagcgggtcctggaacttcttcgactggttcagcggcctgatgtcctggttcggcgggcccctcaagaccatgctgctgatctgcctctacgtggccctgagcatcggcctgttcttcctcctgatctacctggggcggacgggcctctccaagatgtggctggccgccaccaagaaggccagctga

SEQ ID NO: 12867 - RNA, 3480 nt, synthetic construct
  misc_feature 1..3480: note = derived and/or modified CDS sequence (opt1) from RVFV(25010-24)__KM210509.1__NSm-Gn-Gc
  source 1..3480: mol_type = other RNA
atgatcgagcgcgcctgggacagcctgcgggaggaggagatgcccgaggagctctcctgcagcatctccggcatccgcgaggtgaagaccagctcccaggagctgtaccgggccctgaaggcgatcatcgccgccgacgggctcaacaacatcacgtgccacggcaaggacccggaggacaagatcagcctgatcaaggggccgccccacaagaagcgcgtcggcatcgtgcggtgcgagcgccggcgcgacgccaagcaggtcgggcgggagaccatggccggcatcgcgatgaccgtgctgcccgccctcgccgtgttcgccctggcgcccgtggtcttcgccgaggacccccacctccgcaaccggcccggcaaggggcacaactacatcgacggcatgacccaggaggacgcgacctgcaagcccgtgacgtacgccggggcctgctccagcttcgacgtgctgctggagaagggcaagttcccgctgttccagtcctacgcccaccaccgcaccctcctggaggccgtccacgacaccatcatcgccaaggccgacccgcccagctgcgacctgcagtccgcccacgggaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccggcagatgaccggcgccagcctcaagaaggggtcctaccccctgcaggacctgttctgccagagctccgaggacgacggcagcaagctcaagaccaagatgaagggggtctgcgaggtgggcgtgcaggccctgaagaagtgcgacggccagctgtccaccgcccacgaggtcgtgcccttcgcggtgttcaagaacagcaagaaggtctacctcgacaagctggacctgaagacggaggagaacctcctgcccgacagcttcgtgtgcttcgagcacaaggggcagtacaagggcaccatggactccgggcagaccaagcgcgagctcaagagcttcgacatctcccagtgccccaagatcggcgggcacggcagcaagaagtgcaccggcgacgccgccttctgctccgcctacgagtgcacggcccagtacgcgaacgcctactgcagccacgccaacgggtccggcatcgtgcagatccaggtcagcggggtgtggaagaagcccctgtgcgtgggctacgagcgggtcgtggtcaagcgcgagctgtccgccaagccgatccagcgggtggagccctgcacgacctgcatcaccaagtgcgagccccacgggctgatcgtgcgcagcaccggcttcaagatctccagcgcggtcgcctgcgcctccggcgtgtgcgtgaccgggagccagtcccccagcaccgagatcaccctcaagtacccgggcatctcccagagctccgggggcgacatcggggtccacatggcccacgacgaccagagcgtgagctccaagatcgtggcccactgcccgccccaggacccctgcctggtccacggctgcatcgtgtgcgcgcacggcctgatcaactaccagtgccacacggccctcagcgccttcgtggtcgtgttcgtgttctccagcgtcgccatcatctgcctggccatcctgtacaaggtgctcaagtgcctgaagatcgcgcccaagaaggtgctgaaccccctcatgtggatcaccgccttcatccggtgggtctacaagaagatggtggcccgcgtggccgacaacatcaaccaggtcaaccgggagatcgggtggatggagggcgggcagctggccctgggcaaccccgcgccgatcccccgccacgcccccatcccccgctactccacctacctcatgctgctgctcatcgtgagctacgcctccgcctgcagcgagctgatccaggcgtccagccggatcaccacgtgctccaccgagggcgtgaacaccaagtgccgcctgagcgggaccgccctgatccgggccggctccgtcggggccgaggcctgcctcatgctgaagggcgtgaaggacgaccagacgaagttcctgaagatcaagaccgtgagctccgagctcagctgccgcgaggggcagtcctactggaccggcagcttcagcccgaagtgcctgtccagccggcgctgccacctggtcggcgagtgccacgtgaaccggtgcctctcctggcgcgacaacgagaccagcgcggagttctccttcgtgggggagagcacgaccatgcgggagaacaagtgcttcgagcagtgcggcgggtggggctgcgggtgcttcaacgtcaacccctcctgcctgttcgtgcacacctacctgcagagcgtgcgcaaggaggccctccgggtcttcaactgcatcgactgggtgcacaagctgaccctggagatcaccgacttcgacggctccgtgagcacgatcgacctcggcgcctccagctcccgcttcaccaactgggggagcgtctccctgagcctggacgccgagggcatctccgggagcaactccttcagcttcatcgagagccccggcaaggggtacgccatcgtggacgagcccttctccgagatcccgcggcagggcttcctcggcgagatccgctgcaacagcgagtccagcgtgctgtccgcgcacgagagctgcctgcgggcccccaacctcatctcctacaagcccatgatcgaccagctggagtgcaccaccaacctgatcgaccccttcgtcgtgttcgagcgcgggagcctcccgcagacgcggaacgacaagaccttcgccgcctccaagggcaaccgcggggtgcaggccttcagcaagggctccgtccaggcggacctgaccctgatgttcgacaacttcgaggtggacttcgtgggggccgccgtcagctgcgacgccgcgttcctcaacctgaccggctgctactcctgcaacgccggcgcccgggtgtgcctgagcatcacgtccaccgggaccggcaccctcagcgcccacaacaaggacgggtccctgcacatcgtgctgcccagcgagaacggcacgaaggaccagtgccagatcctccacttcaccgtccccgaggtggaggaggagttcatgtactcctgcgacggcgacgagcgccccctgctggtgaaggggaccctcatcgccatcgacccgttcgacgaccgccgggaggcgggcggggagagcaccgtcgtgaaccccaagagcggctcctggaacttcttcgactggttcagcgggctgatgtcctggttcggcggccccctgaagacgatcctcctgatctgcctgtacgtcgccctcagcatcgggctgttcttcctgctcatctacctgggccgcaccgggctgtccaagatgtggctcgccgccaccaagaaggccagctga

SEQ ID NO: 12868 - RNA, 3480 nt, synthetic construct
  misc_feature 1..3480: note = derived and/or modified CDS sequence (opt1) from RVFV(Sudan 2V-2007)__JQ820490.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgcgtcgtggtcaagcgggagctgtccgccaagccgatccagcgcgtggagccctgcacgacctgcatcaccaagtgcgagccccacggcctggtggtccggagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcgcccactgcccgccccaggacccctgcagcgtgcacggctgcatcgtgtgcgcgcacgggctgatcaactaccagtgccacacggccctgtccgccttcgtcgtggtgttcgtcttcagctccatcgccatcatctgcctcgccatcctgtaccgcgtgctgaagtgcctcaagatcgcgccccggaaggtgctgaaccccctgatgtggatcaccgccttcatccgctgggtctacaagaagatggtggcccgggtggccgacaacatcaaccaggtcaaccgcgagatcggctggatggagggcgggcagctcgtgctgggcaaccccgccccgatcccccgccacgcgcccatcccccggtacagcacctacctgatgctcctgctgatcgtgtcccacgccagcgcctgctccgagctcatccaggccagctcccgcatcaccacgtgcagcaccgagggggtcaacaccaagtgccggctgtccggcaccgcgctgatccgcgccgggagcgtgggcgccgaggcctgcctgatgctcaagggggtgaaggaggaccagacgaagttcctgaagatcaagaccgtctccagcgagctgtcctgccgggagggccagagctactggaccggcagcttctccccgaagtgcctcagctcccgccggtgccacctggtgggggagtgccacgtgaaccgctgcctgagctggcgggacaacgagacctccgccgagttcagcttcgtcggcgagtccacgaccatgcgcgagaacaagtgcttcgagcagtgcgggggctgggggtgcggctgcttcaacgtgaaccccagctgcctcttcgtgcacacctacctgcagtccgtccggaaggaggcgctgcgcgtgttcaactgcatcgactgggtgcacaagctcaccctggagatcaccgacttcgacggcagcgtctccacgatcgacctgggggccagctccagccggttcaccaactggggctccgtgagcctctccctggacgccgaggggatcagcggctccaacagcttcagcttcatcgagtcccccgggaagggctacgccatcgtggacgagcccttcagcgagatcccgcgccagggcttcctgggggagatccggtgcaactccgagagctccgtcctcagcgcccacgagtcctgcctgcgcgcgcccaacctgatcagctacaagcccatgatcgaccagctcgagtgcaccaccaacctgatcgaccccttcgtggtgttcgagcggggctccctgccgcagacgcgcaacgacaagaccttcgccgccagcaaggggaaccggggcgtccaggccttctccaaggggagcgtgcaggccgacctcaccctgatgttcgacaacttcgaggtggacttcgtcggcgcggccgtgtcctgcgacgccgccttcctgaacctcaccggctgctacagctgcaacgcgggggcccgcgtgtgcctgtccatcacgagcaccggcaccgggaccctgtccgcccacaacaaggacggcagcctccacatcgtcctgccctccgagaacggcacgaaggaccagtgccagatcctgcacttcaccgtgcccgaggtggaggaggagttcatgtacagctgcgacggggacgagcgccccctcctggtcaagggcaccctgatggccatcgacccgttcgacgaccggcgcgaggccgggggcgagagcaccgtggtcaaccccaagtccgggagctggaacttcttcgactggttctccggcctcatgagctggttcggcgggcccctgaagacgatcctgctcatctgcctgtacgtggcgctgtccatcggcctcttcttcctgctgatctacctcgggcggaccggcctgagcaagatgtggctggccgccaccaagaaggcctcctga

SEQ ID NO: 12869 - RNA, 3480 nt, synthetic construct
  misc_feature 1..3480: note = derived and/or modified CDS sequence (opt1) from RVFV(SAUDI 200010901)__KU978778.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcggccggcgccgggacaccaagcagatcggccgcgagaccatggccgggatcgccatgaccgtcctgcccgcgctcgccgtgttcgccctggcccccgtggtcttcgcggaggacccccacctccggaaccgccccggcaaggggcacaactacatcgacggcatgacccaggaggacgccacgtgcaagcccgtgacctacgccggggcctgctccagcttcgacgtgctgctggagaagggcaagttcccgctgttccagtcctacgcccaccaccggaccctcctggaggcggtccacgacaccatcatcgccaaggccgacccgcccagctgcgacctgcagtccgcccacggcaacccctgcatgaaggagaagctcgtgatgaagacgcactgccccaacgactaccagagcgcccactacctgaacaacgacgggaagatggcgtccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagaccaagatgaagggcgtctgcgaggtgggggtgcaggccctgaagaagtgcgacggccagctgtccacggcccacgaggtcgtgcccttcgccgtgttcaagaacagcaagaaggtctacctcgacaagctggacctgaagaccgaggagaacctcctgcccgacagcttcgtgtgcttcgagcacaaggggcagtacaagggcaccatggactccgggcagaccaagcgggagctcaagagcttcgacatctcccagtgccccaagatcggcggccacgggagcaagaagtgcacgggcgacgcggccttctgctccgcctacgagtgcaccgcccagtacgccaacgcgttctgcagccacgccaacgggtccggcatcgtgcagatccaggtcagcggggtgtggaagaagcccctgtgcgtgggctacgagcgcgtcgtggtcaagcgggagctgtccgccaagccgatccagcgcgtggagccctgcacgacctgcatcaccaagtgcgagccccacggcctggtggtccggagcaccgggttcaagatctccagcgccgtggcgtgcgcctccggcgtgtgcgtcaccgggagccagtcccccagcaccgagatcacgctcaagtacccgggcatctcccagagctccgggggcgacatcggcgtgcacatggcccacgacgaccagagcgtgagctccaagatcgtcgcccactgcccgccccaggacccctgcctggtgcacgggtgcatcgtgtgcgcccacggcctgatcaactaccagtgccacaccgcgctcagcgccttcgtcgtggtgttcgtcttctccagcatcgccatcatctgcctggccatcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcgggtggatggagggcggccagctggtgctggggaaccccgccccgatcccccgccacgcccccatcccccggtactccacctacctcatgctgctgctcatcatcagctacgcgtccgcctgcagcgagctgatccaggcctccagccgcatcacgacctgctccaccgagggcgtgaacaccaagtgccggctgagcgggacggccctgatccgcgcgggctccgtcggggccgaggcctgcctcatgctgaagggcgtgaaggaggaccagaccaagttcctgaagatcaagaccgtgagctccgagctcagctgccgggagggccagtcctactggaccgggagcttcagcccgaagtgcctgtccagccgccggtgccacctggtcggcgagtgccacgtgaaccgctgcctctcctggcgggacaacgagacgagcgccgagttctccttcgtgggggagagcaccaccatgcgcgagaacaagtgcttcgagcagtgcggcgggtggggctgcggctgcttcaacgtcaacccctcctgcctgttcgtgcacacctacctgcagagcgtgcggaaggaggccctccgcgtcttcaactgcatcgactgggtgcacaagctgaccctggagatcacggacttcgacgggtccgtgagcaccatcgacctcggcgcgtccagctcccggttcaccaactgggggagcgtctccctgagcctggacgccgagggcatctccgggagcaactccttcagcttcatcgagagccccggcaagggctacgccatcgtggacgagcccttctccgagatcccgcgccaggggttcctcggcgagatccggtgcaacagcgagtccagcgtgctgtccgcccacgagagctgcctgcgcgcccccaacctcatctcctacaagcccatgatcgaccagctggagtgcaccacgaacctgatcgaccccttcgtcgtgttcgagcgggggagcctcccgcagacccgcaacgagaagaccttcgcggcctccaagggcaaccgcggggtgcaggccttcagcaagggctccgtccaggccgacctgaccctgatgttcgacaacttcgaggtggacttcgtgggcgccgcggtcagctgcgacgccgccttcctcaacctgacggggtgctactcctgcaacgccggcgcgcgggtgtgcctgagcatcacctccaccgggaccggcacgctcagcgcccacaacaaggacggctccctgcacatcgtgctgcccagcgagaacgggaccaaggaccagtgccagatcctccacttcaccgtccccgaggtggaggaggagttcatgtactcctgcgacggcgacgagcgccccctgctggtgaaggggaccctcatcgccatcgacccgttcgacgaccggcgcgaggccggcggggagagcacggtcgtgaaccccaagagcggctcctggaacttcttcgactggttcagcggcctgatgtcctggttcgggggccccctgaagaccatcctcctgatctgcctgtacgtcgccctcagcatcgggctgttcttcctgctcatctacctgggccggaccgggctgtccaagatgtggctcgcggccaccaagaaggccagctga

SEQ ID NO: 12870 - RNA, 3480 nt, synthetic construct
  misc_feature 1..3480: note = derived and/or modified CDS sequence (opt1) from RVFV(2373/74)__DQ380194.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgctacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacgggatgacccaggaggacgcgacctgcaagcccgtcacgtacgccggcgcctgctccagcttcgacgtgctgctggagaaggggaagttcccgctgttccagtcctacgcgcaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtgagcggcgtctggaagaagcccctgtgcgtggggtacgagcgcgtggtcgtgaagcgggagctgtccgccaagccgatccagcgcgtcgagccctgcacgacctgcatcaccaagtgcgagccccacggcctggtggtgcggagcaccggcttcaagatctccagcgcggtcgcctgcgcctccggggtgtgcgtgaccggcagccagtcccccagcaccgagatcaccctcaagtacccggggatctcccagagctccggcggggacatcggcgtccacatggcccacgacgaccagagcgtgagctccaagatggtggcccactgcccgccccaggacccctgcctggtccacggctgcatcgtgtgcgcgcacgggctgatcaactaccagtgccacacggccctcagcgccttcgtggtcgtgttcgtgttctccagcgtcgccatcatctgcctggccatcctgtacaaggtgctcaagtgcctgaagatcgcgccccgcaaggtgctgaaccccctcatgtggatcaccgccttcatccggtgggtctacaagaagatggtggcccgcgtggccgacaacatcaaccaggtcaaccgggagatcggctggatggagggcgggcagctggccctgggcaaccccgcgccgatcccccgccacgcccccatcccccgctactccacctacctcatgctgctgctcatcgtgagctacgcctccgcctgcagcgagctgatccaggcgtccagccggatcaccacgtgctccaccgagggggtgaacaccaagtgccgcctgagcggcaccgccctgatccgggccgggtccgtcggcgccgaggcctgcctcatgctgaagggggtgaaggaggaccagacgaagttcctgaagatcaagaccgtgagctccgagctcagctgccgcgagggccagtcctactggaccggcagcttcagcccgaagtgcctgtccagccggcgctgccacctggtcggggagtgccacgtgaaccggtgcctctcctggcgcgacaacgagaccagcgcggagttctccttcgtgggcgagagcacgaccatgcgggagaacaagtgcttcgagcagtgcgggggctgggggtgcggctgcttcaacgtcaacccctcctgcctgttcgtgcacacctacctgcagagcgtgcgcaaggaggccctccgggtcttcaactgcatcgactgggtgcacaagctgaccctggagatcaccgacttcgacggctccgtgagcacgctcgacctgggggcctccagctcccgcttcaccaactggggcagcgtctccctgagcctcgacgccgaggggatctccggcagcaactccttcagcttcatcgagagccccgggaagggctacgccatcgtggacgagcccttctccgagatcccgcggcagggcttcctgggggagatccgctgcaacagcgagtccagcgtgctgtccgcgcacgagagctgcctccgggcccccaacctgatctcctacaagcccatgatcgaccagctggagtgcaccaccaacctcatcgaccccttcgtcgtgttcgagcgcggcagcctgccgcagacgcggaacgagaagaccttcgccgcctccaaggggaaccgcggcgtgcaggccttcagcaaggggtccgtccaggcggacctgaccctcatgttcgacaacttcgaggtggacttcgtgggcgccgccgtcagctgcgacgccgcgttcctgaacctgaccggctgctactcctgcaacgccggggcccgggtgtgcctcagcatcacgtccaccggcaccgggaccctgagcgcccacaacaaggacggctccctgcacatcgtgctccccagcgagaacggcacgaaggaccagtgccagatcctgcacttcaccgtccccgaggtggaggaggagttcatgtactcctgcgacggggacgagcgccccctgctcgtgaagggcaccctgatcgccatcgacccgttcgacgaccgccgggaggccgggggcgagagcaccgtcgtgaaccccaagagcgggtcctggaacttcttcgactggttcagcggcctgatgtcctggttcggcgggcccctcaagacgatcctgctgatctgcctctacgtcgccctgagcatcggcctgttcttcctcctgatctacctggggcgcaccggcctctccaagatgtggctggccgccaccaagaaggccagctga

SEQ ID NO: 12871 - RNA, 3480 nt, synthetic construct
  misc_feature 1..3480: note = derived and/or modified CDS sequence (opt1) from RVFV(KEN/Kil-006/07)__HM586966.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtgggggtggtccgctgcgagcggcgccgggacgccaagcagatcggccgcgagaccatggccggcatcgcgatgaccgtgctgcccgccctcgccgtgttcgccctggcgccggtcgtgttcgccgaggacccccacctccggaaccgccccgggaagggccacaactacatcgacgggatgacccaggaggacgcgacctgcaagcccgtgacgtacgccggcgcctgctccagcttcgacgtcctgctggagaaggggaagttcccgctgttccagtcctacgcgcaccaccggaccctcctggaggccgtgcacgacaccatcatcgccaaggccgacccgcccagctgcgacctgcagtccgccgacggcaacaagtgcatgaaggagaagctcgtgatgaagacccactgccccaacgactaccagagcgcgcactacctgaacaacgacggcaagatggcctccgtcaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtgggcgtccaggccctgaagaagtgcgacgggcagctgtccaccgcccacgaggtggtgcccttcgcggtcttcaagaacagcaagaaggtgtacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtccagatccaggtgagcggcgtgtggaagaagcccctgtgcgtcgggtacgagcgcgtggtcgtgaagcgggagctgtccgccaagcccatccagcgcgtggagccgtgcacgacctgcatcaccaagtgcgagccccacggcctggtcgtgcggagcaccggcttcaagatctccagcgcggtggcctgcgcctccggggtctgcgtgaccggcagccagtcccccagcaccgagatcaccctcaagtaccccgggatctcccagagctccggcggggacatcggcgtgcacatggcccacgacgaccagagcgtcagctccaagatcgtggcccactgcccgccccaggacccctgcctggtgcacggctgcatcgtctgcgcgcacgggctgatcaactaccagtgccacacggccctcagcgccttcgtggtgatcttcgtcttctccagcaccgccatcatctgcctggccgtgctgtaccgcgtgctcaagtgcctgaagatcgcgccccggaaggtcctgaacccgctcatgtggatcaccgccttcatccgctgggtgtacaagaagatggtggcccgggtcgccgacaacatcaaccaggtgaaccgcgagatcggctggatggagggcgggcagctggccctgggcaaccccgcgcccatcccgcgccacgcccccatcccccggtactccacctacctcatgctgctgctcatcgtgagctacgcctccgcctgcagcgagctgatccaggcgtccagccgcatcacgacctgctccaccgagggggtcaacaccaagtgccggctgagcggcacggccctgatccgcgccgggtccgtgggcgccgaggcctgcctcatgctgaagggggtgaaggaggaccagaccaagttcctgaagatcaagaccgtcagctccgagctcagctgccgggagggccagtcctactggaccggcagcttcagccccaagtgcctgtccagccgccggtgccacctggtgggggagtgccacgtgaaccgctgcctctcctggcgggacaacgagacgagcgcggagttctccttcgtcggcgagagcaccaccatgcgcgagaacaagtgcttcgagcagtgcgggggctgggggtgcggctgcttcaacgtgaacccgtcctgcctgttcgtgcacacctacctgcagagcgtccggaaggaggccctccgcgtgttcaactgcatcgactgggtgcacaagctgaccctggagatcacggacttcgacggctccgtcagcaccatcgacctcggggcctccagctcccggttcaccaactggggcagcgtgtccctgagcctggacgccgaggggatctccggcagcaactccttcagcttcatcgagagccccgggaagggctacgccatcgtggacgagcccttctccgagatcccccgccagggcttcctcggggagatccggtgcaacagcgagtccagcgtcctgtccgcgcacgagagctgcctgcgcgccccgaacctcgtgtcctacaagcccatgatcgaccagctggagtgcaccacgaacctgatcgaccccttcgtggtcttcgagcggggcagcctcccccagacccgcaacgacaagaccttcgccgcctccaaggggaaccggggcgtgcaggccttcagcaaggggtccgtgcaggcggacctgaccctgatgttcgacaacttcgaggtcgacttcgtgggcgccgccgtgagctgcgacgccgcgttcctcaacctgacgggctgctactcctgcaacgccggggcccgcgtctgcctgagcatcacctccaccggcaccgggacgctcagcgcccacaacaaggacggctccctgcacatcgtgctgccgagcgagaacggcaccaaggaccagtgccagatcctccacttcaccgtgcccgaggtcgaggaggagttcatgtactcctgcgacggggacgagcgccccctgctggtgaagggcaccctcatcgccatcgaccccttcgacgaccggcgcgaggccgggggcgagagcacggtcgtgaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggaccggcctgtccaagatgtggctcgccgccaccaagaaggccagctga

SEQ ID NO: 12872 - RNA, 3480 nt, synthetic construct
  misc_feature 1..3480: note = derived and/or modified CDS sequence (opt1) from RVFV(MgH824)__DQ380210.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggctacaactacatcgacgggatgacccaggaggacgcgacctgcaagcccgtcacgtacgccggcgcctgctccagcttcgacgtgctgctggagaaggggaagttcccgctgttccagtcctacgcccaccaccggaccctcctggaggccgtgcacgacaccatcatcgccaaggccgacccgcccagctgcgacctgcagtccgcccacggcaacccctgcatgaaggagaagctcgtcatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtgtgcgaggtcggcgtgcaggccctgaagaagtgcgacgggcagctgtccaccgcccacgaggtggtccccttcgcggtgttcaagaacagcaagaaggtgtacctcgacaagctggacctgaagacggaggagaacctcctgcccgacagcttcgtctgcttcgagcggaagggccagtacaaggggaccatggactccggccagaccaagcgcgagctcaagagcttcgacatctcccagtgccccaagatcgggggccacggcagcaagaagtgcaccggggacgccgccttctgctccgcctacgagtgcacgacccagtacgccaacgcgtactgcagccacgccaacggctccggggtggtgcagatccaggtcagcggcgtgtggaagaagcccctgtgcgtggggtacgagcgggtcgtggtcaagcgcgagctgtccgccaagccgatccagcgggtggagccctgcacgacctgcatcaccaagtgcgagccccacggcctggtggtccgcagcaccggcttcaagatctccagcgccgtggcgtgcgcctccggggtgtgcgtcaccggcagccagtcccccagcaccgagatcacgctcaagtacccggggatctcccagagctccggcggggacatcggcgtgcacatggcccacgacgaccagagcgtgagctccaagatcgtcgcccactgcccgccccaggacccctgcctggtgcacggctgcatcgtgtgcgcccacgggctgatcaactaccagtgccacaccgcgctcagcgccttcgtcgtggtgttcgtcttctccagcatcgccatcatctgcctggccatcctgtaccgggtgctcaagtgcctgaagatcgcgccccgcaaggtgctgaaccccctcatgtggatcaccgccttcatccggtggatctacaagaagatggtcgcccgcgtggccgacaacatcaaccaggtgaaccgcgagatcggctggatggagggcgggcagctggtcctgggcaaccccgccccgatcccccggcacgcccccatcccccgctactccacctacctcatgctgctgctcatcgtgagctacgcgtccgcctgcagcgagctgatccaggcctccagccggatcacgacctgctccaccgagggggtggacaccaagtgccgcctgagcggcacggccctgatccgggcggggtccgtcggcgccgaggcctgcctcatgctgaagggggtgaaggaggaccagaccaagttcctgaagatcaagaccgtgagctccgagctcagctgccgcgagggccagtcctactggaccggcagcttcagcccgaagtgcctgtccagccggcgctgccacctggtcggggagtgccacgtgaaccggtgcctctcctggcgcgacaacgagacgagcgccgagttctccttcgtgggcgagagcaccaccatgcgggagaacaagtgcttcgagcagtgcgggggctgggggtgcggctgcttcaacgtcaacccctcctgcctgttcgtgcacacctacctgcagagcgtgcgcaaggaggccctccgggtcttcaactgcatcgactgggtgcacaagctgaccctggagatcacggacttcgacggctccgtgagcaccatcgacctcggggcgtccagctcccgcttcaccaactggggcagcgtctccctgagcctggacgccgaggggatctccggcagcaactccttcagcttcatcgagagccccgggaagggctacgccatcgtggacgagcccttcccggagatcccccggcagggcttcctcggggagatccgctgcaactccgagagctccgtgctgagcgcccacgagtcctgcctgcgggcccccaacctcatcagctacaagcccatgatcgaccagctggagtgcaccacgaacctgatcgacccgttcgtcgtgttcgagcgcggctccctcccccagacccggaacgacaagaccttcgcggccagcaaggggaaccgcggcgtgcaggccttctccaaggggagcgtccaggccgacctgaccctgatgttcgacaacttcgaggtggacttcgtgggcgccgcggtctcctgcgacgccgccttcctcaacctgacgggctgctacagctgcaacgccggggcgcgcgtgtgcctgtccatcaccagcaccggcaccgggtccctcagcgcccacaacaaggacggctccctgcacatcgtgctgcccagcgagaacggcacgaaggaccagtgccagatcctccacttcaccgtccccgaggtggaggaggagttcatgtactcctgcgacggggacgagcggccgctgctggtgaagggcaccctcatcgccatcgaccccttcgacgaccgccgggaggccgggggcgagagcaccgtcgtgaaccccaagagcgggtcctggaacttcttcgactggttcagcggcctgatgtcctggttcggcgggcccctgaagacgatcctcctgatctgcctgtacgtcgccctcagcatcggcctgttcttcctgctcatctacctggggcgcaccggcctgtccaagatgtggctcgcggccaccaagaaggccagctga

SEQ ID NO: 12873 - RNA, 3480 nt, synthetic construct
  misc_feature 1..3480: note = derived and/or modified CDS sequence (opt1) from RVFV(SA01-1322)__KX096942.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcggccggcgccgggacaccaagcagatcggccgcgagaccatggccgggatcgccatgaccgtcctgcccgcgctcgccgtgttcgccctggcccccgtggtcttcgcggaggacccccacctccggaaccgccccggcaaggggcacaactacatcgacggcatgacccaggaggacgccacgtgcaagcccgtgacctacgccggggcctgctccagcttcgacgtgctgctggagaagggcaagttcccgctgttccagtcctacgcccaccaccggaccctcctggaggcggtccacgacaccatcatcgccaaggccgacccgcccagctgcgacctgcagtccgcccacggcaacccctgcatgaaggagaagctcgtgatgaagacgcactgccccaacgactaccagagcgcccactacctgaacaacgacgggaagatggcgtccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagaccaagatgaagggcgtctgcgaggtgggggtgcaggccctgaagaagtgcgacggccagctgtccacggcccacgaggtcgtgcccttcgccgtgttcaagaacagcaagaaggtctacctcgacaagctggacctgaagaccgaggagaacctcctgcccgacagcttcgtgtgcttcgagcacaaggggcagtacaagggcaccatggactccgggcagaccaagcgggagctcaagagcttcgacatctcccagtgccccaagatcggcggccacgggagcaagaagtgcacgggcgacgcggccttctgctccgcctacgagtgcaccgcccagtacgccaacgcgttctgcagccacgccaacgggtccggcatcgtgcagatccaggtcagcggggtgtggaagaagcccctgtgcgtgggctacgagcgcgtcgtggtcaagcgggagctgtccgccaagccgatccagcgcgtggagccctgcacgacctgcatcaccaagtgcgagccccacggcctggtggtccggagcaccgggttcaagatctccagcgccgtggcgtgcgcctccggcgtgtgcgtcaccgggagccagtcccccagcaccgagatcacgctcaagtacccgggcatctcccagagctccgggggcgacatcggcgtgcacatggcccacgacgaccagagcgtgagctccaagatcgtcgcccactgcccgccccaggacccctgcctggtgcacgggtgcatcgtgtgcgcccacggcctgatcaactaccagtgccacaccgcgctcagcgccttcgtcgtggtgttcgtcttctccagcatcgccatcatctgcctggccatcctgtaccgcgtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcgggtggatggagggcggccagctggtgctgggggaccccgccccgatcccccgccacgcccccatcccccggtactccacctacctcatgctgctgctcatcatcagctacgcgtccgcctgcagcgagctgatccaggcctccagccgcatcacgacctgctccaccgagggcgtgaacaccaagtgccggctgagcgggacggccctgatccgcgcgggctccgtcggggccgaggcctgcctcatgctgaagggcgtgaaggaggaccagaccaagttcctgaagatcaagaccgtgagctccgagctcagctgccgggagggccagtcctactggaccgggagcttcagcccgaagtgcctgtccagccgccggtgccacctggtcggcgagtgccacgtgaaccgctgcctctcctggcgggacaacgagacgagcgccgagttctccttcgtgggggagagcaccaccatgcgcgagaacaagtgcttcgagcagtgcggcgggtggggctgcggctgcttcaacgtcaacccctcctgcctgttcgtgcacacctacctgcagagcgtgcggaaggaggccctccgcgtcttcaactgcatcgactgggtgcacaagctgaccctggagatcacggacttcgacgggtccgtgagcaccatcgacctcggcgcgtccagctcccggttcaccaactgggggagcgtctccctgagcctggacgccgagggcatctccgggagcaactccttcagcttcatcgagagccccggcaagggctacgccatcgtggacgagcccttctccgagatcccgcgccaggggttcctcggcgagatccggtgcaacagcgagtccagcgtgctgtccgcccacgagagctgcctgcgcgcccccaacctcatctcctacaagcccatgatcgaccagctggagtgcaccacgaacctgatcgaccccttcgtcgtgttcgagcgggggagcctcccgcagacccgcaacgagaagaccttcgcggcctccaagggcaaccgcggggtgcaggccttcagcaagggctccgtccaggccgacctgaccctgatgttcgacaacttcgaggtggacttcgtgggcgccgcggtcagctgcgacgccgccttcctcaacctgacggggtgctactcctgcaacgccggcgcgcgggtgtgcctgagcatcacctccaccgggaccggcacgctcagcgcccacaacaaggacggctccctgcacatcgtgctgcccagcgagaacgggaccaaggaccagtgccagatcctccacttcaccgtccccgaggtggaggaggagttcatgtactcctgcgacggcgacgagcgccccctgctggtgaaggggaccctcatcgccatcgacccgttcgacgaccggcgcgaggccggcggggagagcacggtcgtgaaccccaagagcggctcctggaacttcttcgactggttcagcggcctgatgtcctggttcgggggccccctgaagaccatcctcctgatctgcctgtacgtcgccctcagcatcgggctgttcttcctgctcatctacctgggccggaccgggctgtccaagatgtggctcgcggccaccaagaaggccagctga

SEQ ID NO: 12874 - RNA, 3480 nt, synthetic construct
  misc_feature 1..3480: note = derived and/or modified CDS sequence (opt1) from RVFV(Kenya 56 (IB8))__DQ380190.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcaggtcgggatcgtgcggtgcgagcgccggcgcgacgccaagcagatcggccgggagaccatggccggcatcgcgatgaccgtgctgcccgccctcgccgtcttcgccctggcgcccgtggtgttcgccgaggacccccacctccgcaaccggcccgggaagggccacaactacatcgacgggatgacccagggcgacgcgacctgcaagcccgtcacgtacgccggggcctgctccagcttcgacgtgctcctggagaagggcaagttcccgctgttccagtcctacgcccaccaccgcaccctcctggaggccgtgcacgacaccatcatcgccaaggccgacccgcccagctgcgacctgcagtccgcccacggcaacccctgcatgaaggagaagctcgtcatgaagacccactgccccaaggactaccagagcgcgcactacctgaacaacgacgggaagatggcctccgtgaagtgcccgcccaagtacgagctgacggaggactgcaacttctgccggcagatgaccggcgccagcctcaagaaggggtcctaccccctgcaggacctgttctgccagagctccgaggacgacggcagcaagctcaagaccaagatgaagggcgtgtgcgaggtcggggtgcaggccctgaagaagtgcgacggccagctgtccaccgcccacgaggtggtccccttcgcggtgttcaagaacagcaagaaggtgtacctcgacaagctggacctgaagacggaggagaacctcctgcccgacagcttcgtctgcttcgagcacaaggggcagtacaagggcaccatggactccgggcagaccaagcgcgagctcaagagcttcgacatctcccagtgccccaagatcggcggccacgggagcaagaagtgcaccggcgacgccgccttctgctccgcctacgagtgcacggcccagtacgcgaacgcctactgcagccacgccaacgggtccggcatcgtgcagatccaggtgagcggggtctggaagcggcccctgtgcgtgggctacgagcgcgtggtcgtgaagcgggagctgtccgccaagccgatccagcgcgtcgagccctgcacgacctgcatcaccaagtgcgagccccacggcctggtggtgcggagcaccgggttcaagatctccagcgcggtcgcctgcgcctccggcgtgtgcgtgaccgggagccagtcccccagcaccgagatcaccctcaagtacccgggcatgtcccagagctccgggggcgacatcggcgtccacatggcccacgacgaccagagcgtgagctccaagatcgtggcccactgcccgccccaggacccctgcctggtccacgggtgcatcgtgtgcgcgcacggcctgatcaactaccagtgccacacggccctcagcgccttcgtggtcgtgttcgtgttctccagcgtcgccatcatctgcctggccatcctgtacaaggtgctcaagtgcctgaagatcgcgccccgcaaggtgctgaaccccctcatgtggatcaccgccttcatccggtgggtctacaagaagatggtggcccgcgtggccgacaacatcaaccaggtcaaccgggagatcgggtggatggagggcggccagcccgccctggggaacccggcgcccatcccccgccacgcccccatcccgcgctactccacctacctgatgctcctgctgatcgtgagctacgcctccgcctgcagcgagctcatccaggcgtccagccggatcaccacgtgctccaccgagggcgtgaacaccaagtgccgcctgagcgggaccgccctgatccgggccggctccgtcggggccgaggcctgcctgatgctcaagggcgtgaaggaggaccagacgaagttcctgaagatcaagaccgtgagctccgagctgagctgccgcgagggccagtcctactggaccgggagcttcagccccaagtgcctctccagccggcgctgccacctggtcggcgagtgccacgtgaaccggtgcctgtcctggcgcgacaacgagaccagcgcggagttctccttcgtgggggagagcacgaccatgcgggagaacaagtgcttcgagcagtgcggcgggtggggctgcggctgcttcaacgtcaacccctcctgcctcttcgtgcacacctacctgcagagcgtgcgcaaggaggccctgcgggtcttcaactgcatcgactgggtgcacaagctcaccctggagatcaccgacttcgacgggtccgtgagcacgatcgacctgggcgcctccagctcccgcttcaccaactgggggagcgtctccctcagcctggacgccgagggcatctccgggagcaactccttcagcttcatcgagagccccggcaagggctacgccatcgtggacgagccgttctccgagatcccccggcaggggttcctgggcgagatccgctgcaacagcgagtccagcgtgctctccgcgcacgagagctgcctgcgggcccccaacctgatctcctacaagcccatgatcgaccagctcgagtgcaccaccaacctgatcgacccgttcgtcgccttcgagcgcgggagcctgccccagacgcggaacgacaagaccttcgccgcctccaagggcaaccgcggggtgcaggcgttcagcaagggctccgtgcaggccgacctcaccctgatgttcgacaacttcgaggtcgacttcgtgggcgccgccgtgagctgcgacgcggccttcctgaacctcaccgggtgctactcctgcaacgccggcgcccgggtctgcctgagcatcacgtccaccgggaccggcaccctgagcgcccacaacaaggacggctccctccacatcgtgctgcccagcgagaacgggacgaaggaccagtgccagatcctgcacttcaccgtgcccgaggtcgaggaggagttcatgtactcctgcgacggcgacgagcgcccgctcctggtgaaggggaccctgatcgcgatcgaccccttcgacgaccgccgggaggccggcggggagagcaccgtggtcaaccccaagagcggctcctggaacttcttcgactggttcagcggcctcatgtcctggttcgggggccccctgaagacgatcctgctcatctgcctgtacgtggccctgagcatcgggctgttcttcctgctgatctacctcggccgcaccgggctgtccaagatgtggctggccgccaccaagaaggcgagctga

SEQ ID NO: 12875 - RNA, 3480 nt, synthetic construct
  misc_feature 1..3480: note = derived and/or modified CDS sequence (opt1) from RVFV(KEN/Mal-032/07)__HM586967.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgccggtggtcttcgccgaggacccccacctccggaaccgccccgggaagggccacaactacatcgacgggcggctgcaggaggacgcgacctgcaagcccgtgacctacgccggcgcctgctccagcttcgacgtgctgctggagaaggggaagttccccctcttccagtcctacgcgcaccaccgcacgctgctggaggccgtccacgacaccatcatcgccaaggccgacccgcccagctgcgacctccagtccgccgacggcaacaagtgcatgaaggagaagctggtgatgaagacccactgccccaacgactaccagagcgcgcactacctgaacaacgacggcaagatggcctccgtgaagtgcccgcccaagtacgagctcaccgaggactgcaacttctgccggcagatgacgggggccagcctgaagaagggctcctaccccctgcaggacctcttctgccagagctccgaggacgacgggagcaagctgaagaccaagatgaagggcgtctgcgaggtgggcgtgcaggccctgaagaagtgcgacgggcagctctccaccgcccacgaggtcgtgcccttcgcggtgttcaagaacagcaagaaggtctacctggacaagctggacctcaagaccgaggagaacctgctgccggacagcttcgtgtgcttcgagcacaagggccagtacaaggggacgatggactccggccagaccaagcgcgagctcaagagcttcgacatctcccagtgccccaagatcgggggccacggcagcaagaagtgcaccggggacgccgccttctgctccgcctacgagtgcaccgcccagtacgcgaacgcctactgcagccacgccaacggctccgggatcgtgcagatccaggtcagcggcgtgtggaagaagcccctgtgcgtggggtacgagcgggtcgtggtcaagcgcgagctgtccgccaagcccatccagcgggtggagccgtgcacgacctgcatcaccaagtgcgagccccacggcctcgtggtccgcagcaccggcttcaagatctccagcgcggtggcctgcgcctccggggtgtgcgtcacgggcagccagtcccccagcaccgagatcaccctgaagtaccccgggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctcatcaactaccagtgccacaccgccctgagcgccttcgtcgtgatcttcgtgttctccagcacggccatcatctgcctggccgtcctctaccgggtgctgaagtgcctgaagatcgcgccccgcaaggtgctcaacccgctgatgtggatcaccgccttcatccggtgggtctacaagaagatggtggcccgcgtggccgacaacatcaaccaggtcaaccgcgagatcggctggatggagggcgggcagctggccctcggcaaccccgcgcccatcccgcggcacgcccccatcccccgctactccacctacctgatgctgctcctgatcgtgagctacgcctccgcctgcagcgagctgatccaggcgtccagccggatcaccacgtgctccaccgagggggtgaacaccaagtgccgcctgagcggcaccgccctcatccgggccgggtccgtcggcgccgaggcctgcctgatgctgaagggggtgaaggaggaccagacgaagttcctcaagatcaagaccgtgagctccgagctgagctgccgcgagggccagtcctactggaccggcagcttcagccccaagtgcctgtccagccggcgctgccacctcgtcggggagtgccacgtgaaccggtgcctgtcctggcgcgacaacgagaccagcgcggagttctccttcgtgggcgagagcacgaccatgcgggagaacaagtgcttcgagcagtgcgggggctgggggtgcggctgcttcaacgtcaacccgtcctgcctgttcgtgcacacctacctccagagcgtgcgcaaggaggccctgcgggtcttcaactgcatcgactgggtgcacaagctgaccctcgagatcaccgacttcgacggctccgtgagcacgatcgacctgggggcctccagctcccgcttcaccaactggggcagcgtctccctgagcctcgacgccgaggggatctccggcagcaactccttcagcttcatcgagagccccgggaagggctacgccatcgtggacgagcccttctccgagatcccccggcagggcttcctgggggagatccgctgcaacagcgagtccagcgtgctgtccgcgcacgagagctgcctccgggccccgaacctggtctcctacaagcccatgatcgaccagctggagtgcaccaccaacctcatcgaccccttcgtggtgttcgagcgcggcagcctgccccagacgcggaacgacaagaccttcgccgcctccaaggggaaccgcggcgtccaggccttcagcaaggggtccgtgcaggcggacctgaccctcatgttcgacaacttcgaggtggacttcgtcggcgccgccgtgagctgcgacgccgcgttcctgaacctgaccggctgctactcctgcaacgccggggcccgcgtgtgcctcagcatcacgtccaccggcaccgggaccctgagcgcccacaacaaggacggctccctgcacatcgtcctcccgagcgagaacggcacgaaggaccagtgccagatcctgcacttcaccgtgcccgaggtggaggaggagttcatgtactcctgcgacggggacgagcggcccctgctcgtcaagggcaccctgatcgccatcgaccccttcgacgaccgccgggaggccgggggcgagagcaccgtggtcaaccccaagagcgggtcctggaacttcttcgactggttcagcggcctgatgtcctggttcggcgggcccctcaagacgatcctgctgatctgcctctacgtggccctgagcatcggcctgttcttcctcctgatctacctggggcgcaccggcctctccaagatgtggctggccgccaccaagaaggccagctga

SEQ ID NO: 12876 - RNA, 3480 nt, synthetic construct
  misc_feature 1..3480: note = derived and/or modified CDS sequence (opt1) from RVFV(KEN/Gar-008/06)__HM586965.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgccggtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagccgcgtgtggaagaagcccctgtgcgtgggctacgagcgggtcgtggtcaagcgcgagctgtccgccaagccgatccagcgggtggagccctgcacgacctgcatcaccaagtgcgagccccacgggctggtggtccgcagcaccggcttcaagatctccagcgcggtggcctgcgcctccggcgtgtgcgtcaccgggagccagtcccccagcaccgagatcaccctcaagtacccgggcatctcccagagctccgggggcgacatcggggtgcacatggcccacgacgaccagagcgtgagctccaagatcgtcgcccactgcccgccccaggacccctgcctggtgcacggctgcatcgtgtgcgcgcacggcctgatcaactaccagtgccacacggccctcagcgccttcgtcgtgatcttcgtgttctccagcaccgccatcatctgcctggccgtcctgtaccgggtgctcaagtgcctgaagatcgcgccccgcaaggtgctgaaccccctcatgtggatcaccgccttcatccggtgggtctacaagaagatggtggcccgcgtggccgacaacatcaaccaggtcaaccgcgagatcgggtggatggagggcgggcagctggccctgggcaaccccgcgccgatcccccggcacgcccccatcccccgctactccacctacctcatgctgctgctcatcgtgagctacgcctccgcctgcagcgagctgatccaggcgtccagccggatcacgacctgctccaccgagggcgtgaacaccaagtgccgcctgagcgggacggccctgatccgggccggctccgtcggggccgaggcctgcctcatgctgaagggcgtgaaggaggaccagaccaagttcctgaagatcaagaccgtgagctccgagctcagctgccgcgaggggcagtcctactggaccggcagcttcagcccgaagtgcctgtccagccggcgctgccacctggtcggcgagtgccacgtgaaccggtgcctctcctggcgcgacaacgagacgagcgcggagttctccttcgtgggggagagcaccaccatgcgggagaacaagtgcttcgagcagtgcggcgggtggggctgcgggtgcttcaacgtcaacccctcctgcctgttcgtgcacacctacctgcagagcgtgcgcaaggaggccctccgggtcttcaactgcatcgactgggtgcacaagctgaccctggagatcacggacttcgacggctccgtgagcaccatcgacctcggcgcctccagctcccgcttcaccaactgggggagcgtctccctgagcctggacgccgagggcatctccgggagcaactccttcagcttcatcgagagccccggcaaggggtacgccatcgtggacgagcccttctccgagatcccgcggcagggcttcctcggcgagatccgctgcaacagcgagtccagcgtgctgtccgcgcacgagagctgcctgcgggcccccaacctcgtctcctacaagcccatgatcgaccagctggagtgcaccacgaacctgatcgaccccttcgtggtgttcgagcgcgggagcctcccgcagacccggaacgacaagaccttcgccgcctccaagggcaaccgcggggtccaggccttcagcaagggctccgtgcaggcggacctgaccctgatgttcgacaacctcaaggtggacttcgtcggggccgccgtgagctgcgacgccgcgttcctgaacctgacgggctgctactcctgcaacgccggcgcccgcgtgtgcctcagcatcacctccaccgggaccggcacgctgagcgcccacaacaaggacgggtccctgcacatcgtcctccccagcgagaacggcaccaaggaccagtgccagatcctgcacttcaccgtgcccgaggtgaaggaggagttcatgtactcctgcgacggcgacgagcgggccctgctcatgaaggggaccctgatcgcgatcgaccccttcgacgaccgccgggaggccggcggggagagcacggtcgtgaaccccaagagcggctcctggaacttcttcgactggttcagcgggctgatgtcctggttcggcggccccctcaagaccatcctgctgatctgcctctacgtcgccctgagcatcgggctgttcttcctcctgatctacctgggccgcaccgggctctccaagatgtggctggccgccaccaagaaggcgagctga

SEQ ID NO: 12877 - RNA, 3480 nt, synthetic construct
  misc_feature 1..3480: note = derived and/or modified CDS sequence (opt1) from RVFV(Beijing-01)__KX611606.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgatcatcgccgccgacggcctcaacaacatcacgtgccacgggaaggacccggaggacaagatcagcctgatcaagggcccgccccacaagaagcgggtcgggatcgtgcgctgcgagcggcgccgggacgccaagcagatcggccgcgagaccatggccggcatcgcgatgaccgtgctgcccgccctcgccgtcttcgccctggcgcccgtggtgttcgccgaggacccccacctccggaaccgccccgggaagggccacaactacatcgacggggtcacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcggctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgcgagctcaagagcttcgacatctcccagtgccccaagatcgggggccacggcagcaagaagtgcaccggggacgccgccttctgctccgcctacgagtgcacggcccagtacgcgaacgcctactgcagccacgccaacggctccgggatcgtgcagatccaggtcagcggcgtgtggaagaagcccctgtgcgtggggtacgagcgggtcgtggtcaagcgcgagctgtccgccaagccgatccagcgggtggagccctgcacgacctgcatcaccaagtgcgagccccacggcctggtggtccgcagcaccggcttcaagatctccagcgcggtggcctgcgcctccggggtgtgcgtcaccggcagccagtcccccagcaccgagatcaccctcaagtacccggggatctcccagagctccggcggggacatcggcgtgcacatggcccacgacgaccagagcgtgagctccaagatcgtcttcgactgcccgccccaggacccctgcctggtgcacggctgcatcgtgtgcgcccacgggctgatcaactaccagtgccacacggcgctcagcgccttcgtcgtggtgttcgtcttctccagcgtggccatcatctgcctggccatcctgtacaaggtgctccggtgcctgaagatcgcccccaagaaggtcctgaaccccctcatgtggatcaccgcgttcatccgctgggtgtacaagaagatggtggcccgggtcgccgacaacatcaaccaggtgaaccgcgagatcggctggatggagggcgggcagctggccctgggcaaccccgccccgatcccccgccacgcgcccatcccccggtactccacctacctcatgctgctgctcatcatcagctacgcctccgcctgcagcgagctgatccaggcctccagccgcatcaccacgtgctccaccgagggggtgaacaccaagtgccggctgagcggcaccgcgctgatccgcgccgggtccgtcggcgccgaggcctgcctcatgttcgagggggtgaaggaggaccagacgaagttcctgaagatcaagaccgtgagctccgagctgagctgccgggagggccagtcctactggaccggcagcttcagcccgaagtgcctctccagccgccggtgccacctggtcggggagtgccacgtgaaccgctgcctgtcctggcgggacaacgagaccagcgccgagttctccttcgtgggcgagagcacgaccatgcgcgagaacaagtgcttcgagcagtgcgggggctgggggtgcggctgcttcaacgtcaacccctcctgcctcttcgtgcacacctacctgcagagcgtgcggaaggaggcgctgcgcgtcttcaactgcatcgactgggtgcacaagctcaccctggagatcaccgacttcgacggctccgtgagcacgatcgacctgggggcctccagctcccggttcaccaactggggcagcgtctccctcagcctggacgccgaggggatctccggcagcaactccttcagcttcatcgagagccccgggaagggctacgccatcgtggacgagcccttctccgagatcccgcgccagggcttcctgggggagatccggtgcaacagcgagtccagcgtgctctccgcccacgagagctgcctgcgcgcgcccaacctgatctcctacaagcccatgatcgaccagctcgagtgcaccaccaacctgatcgaccccttcgtcgtgttcgagcggggcagcctgccgcagacgcgcaacgacaagaccttcgccgcctccaaggggaaccggggcgtgcaggccttcagcaaggggtccgtccaggccgacctcaccctgatgttcgacaacttcgaggtggacttcgtgggcgcggccgtcagctgcgacgccgccttcctgaacctcaccggctgctactcctgcaacgcgggggcccgcgtgtgcctgagcatcacgtccaccggcaccgggaccctgagcgcccacaacaaggacggctccctccacatcgtgctgcccagcgagaacggcacgaaggaccagtgccagatcctgcacttcaccgtccccgaggtggaggaggagttcatgtactcctgcgacggggacgagcgccccctcctggtgaagggcaccctgatcgccatcgacccgttcgacgaccggcgcgaggccgggggcgagagcaccgtcgtgaaccccaagagcgggtcctggaacttcttcgactggttcagcggcctcatgtcctggttcggcgggcccctgaagacgatcctgctcatctgcctgtacgtcgcgctgagcatcggcctcttcttcctgctgatctacctcgggcggaccggcctgtccaagatgtggctggccgccaccaagaaggccagctga

SEQ ID NO: 12878 - RNA, 3480 nt, synthetic construct
  misc_feature 1..3480: note = derived and/or modified CDS sequence (opt1) from RVFV(KEN/Bar-035/07)__HM586969.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgccggtggtcttcgccgaggacccccacctccggaaccgccccgggaagggccacaactacatcgacgggcggctgcaggaggacgcgacctgcaagcccgtgacctacgccggcgcctgctccagcttcgacgtgctgctggagaaggggaagttccccctcttccagtcctacgcccaccaccgcacgctgctggaggccgtccacgacaccatcatcgccaaggccgacccgcccagctgcgacctccagtccgccgacggcaacaagtgcatgaaggagaagctggtgatgaagacccactgccccaacgactaccagagcgcgcactacctgaacaacgacggcaagatggcctccgtgaagtgcccgcccaagtacgagctcaccgaggactgcaacttctgccggcagatgacgggggccagcctgaagaagggctcctaccccctgcaggacctcttctgccagagctccgaggacgacgggagcaagctgaagaccaagatgaagggcgtctgcgaggtgggcgtgcaggccctgaagaagtgcgacgggcagctctccaccgcccacgaggtcgtgcccttcgcggtgttcaagaacagcaagaaggtctacctggacaagctggacctcaagaccgaggagaacctgctgccggacagcttcgtgtgcttcgagcacaagggccagtacaaggggacgatggactccggccagaccaagcgcgagctcaagagcttcgacatctcccagtgccccaagatcgggggccacggcagcaagaagtgcaccggggacgccgccttctgctccgcctacgagtgcaccgcccagtacgcgaacgcctactgcagccacgccaacggctccgggatcgtgcagatccaggtcagcggcgtgtggaagaagcccctgtgcgtggggtacgagcgggtcgtggtcaagcgcgagctgtccgccaagcccatccagcgggtggagccgtgcacgacctgcatcaccaagtgcgagccccacggcctcgtggtccgcagcaccggcttcaagatctccagcgcggtggcctgcgcctccggggtgtgcgtcacgggcagccagtcccccagcaccgagatcaccctgaagtaccccgggatctcccagagctccggcggggacatcggcgtgcacatggcccacgacgaccagagcgtgagctccaagatcgtcgcccactgcccgccccaggacccctgcctggtgcacggctgcatcgtgtgcgcgcacgggctcatcaactaccagtgccacaccgccctgagcgccttcgtcgtgatcttcgtgttctccagcacggccatcatctgcctggccgtcctctaccgggtgctgaagtgcctgaagatcgcgccccgcaaggtgctcaacccgctgatgtggatcaccgccttcatccggtgggtctacaagaagatggtggcccgcgtggccgacaacatcaaccaggtcaaccgcgagatcggctggatggagggcgggcagctggccctcggcaaccccgcgcccatcccgcggcacgcccccatcccccgctactccacctacctgatgctgctcctgatcgtgagctacgcctccgcctgcagcgagctgatccaggcgtccagccggatcaccacgtgctccaccgagggggtgaacaccaagtgccgcctgagcggcaccgccctcatccgggcccgctccgtcggggccgaggcctgcctgatgctgaagggcgtgaaggaggaccagacgaagttcctcaagatcaagaccgtgagctccgagctgagctgccgggaggggcagtcctactggaccggcagcttcagccccaagtgcctgtccagccgccggtgccacctcgtcggcgagtgccacgtgaaccgctgcctgtcctggcgggacaacgagaccagcgcggagttctccttcgtgggggagagcacgaccatgcgcgagaacaagtgcttcgagcagtgcggcgggtggggctgcgggtgcttcaacgtcaacccgtcctgcctgttcgtgcacacctacctccagagcgtgcggaaggaggccctgcgcgtcttcaactgcatcgactgggtgcacaagctgaccctcgagatcaccgacttcgacggctccgtgagcacgatcgacctgggcgcctccagctcccggttcaccaactgggggagcgtctccctgagcctcgacgccgagggcatctccgggagcaactccttcagcttcatcgagagccccggcaaggggtacgccatcgtggacgagcccttctccgagatcccccgccagggcttcctgggcgagatccggtgcaacagcgagtccagcgtgctgtccgcgcacgagagctgcctccgcgccccgaacctggtctcctacaagcccatgatcgaccagctggagtgcaccaccaacctcatcgaccccttcgtggtgttcgagcgggggagcctgccccagacgcgcaacgacaagaccttcgccgcctccaagggcaaccgcggggtccaggccttcagcaagggctccgtgcaggcggacctgaccctcatgttcgacaacttcgaggtggacttcgtcggggccgccgtgagctgcgacgccgcgttcctgaacctgaccggctgctactcctgcaacgccggcgcccgggtgtgcctcagcatcacgtccaccgggaccggcaccctgagcgcccacaacaaggacgggtccctgcacatcgtcctcccgagcgagaacggcacgaaggaccagtgccagatcctgcacttcaccgtgcccgaggtggaggaggagttcatgtactcctgcgacggcgacgagcgccccctgctcgtcaaggggaccctgatcgccatcgaccccttcgacgaccggcgcgaggcgggcggggagagcaccgtggtcaaccccaagagcggctcctggaacttcttcgactggttcagcgggctgatgtcctggttcggcggccccctcaagacgatcctgctgatctgcctctacgtggccctgagcatcgggctgttcttcctcctgatctacctgggccggaccgggctctccaagatgtggctggccgccaccaagaaggccagctga

SEQ ID NO: 12879 - RNA, 3480 nt, synthetic construct
  misc_feature 1..3480: note = derived and/or modified CDS sequence (opt1) from RVFV(KEN/Bar-032/07)__HM586968.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgccggtggtcttcgccgaggacccccacctccggaaccgccccgggaagggccacaactacatcgacgggcggctgcaggaggacgcgacctgcaagcccgtgacctacgccggcgcctgctccagcttcgacgtgctgctggagaaggggaagttccccctcttccagtcctacgcgcaccaccgcacgctgctggaggccgtccacgacaccatcatcgccaaggccgacccgcccagctgcgacctccagtccgccgacggcaacaagtgcatgaaggagaagctggtgatgaagacccactgccccaacgactaccagagcgcgcactacctgaacaacgacggcaagatggcctccgtgaagtgcccgcccaagtacgagctcaccgaggactgcaacttctgccggcagatgacgggggccagcctgaagaagggctcctaccccctgcaggacctcttctgccagagctccgaggacgacgggagcaagctgaagaccaagatgaagggcgtctgcgaggtgggcgtgcaggccctgaagaagtgcgacgggcagctctccaccgcccacgaggtcgtgcccttcgcggtgttcaagaacagcaagaaggtctacctggacaagctggacctcaagaccgaggagaacctgctgccggacagcttcgtgtgcttcgagcacaagggccagtacaaggggacgatggactccggccagaccaagcgcgagctcaagagcttcgacatctcccagtgccccaagatcgggggccacggcagcaagaagtgcaccggggacgccgccttctgctccgcctacgagtgcaccgcccagtacgcgaacgcctactgcagccacgccaacggctccgggatcgtgcagatccaggtcagcggcgtgtggaagaagcccctgtgcgtggggtacgagcgggtcgtggtcaagcgcgagctgtccgccaagcccatccagcgggtggagccgtgcacgacctgcatcaccaagtgcgagccccacggcctcgtggtccgcagcaccggcttcaagatctccagcgcggtggcctgcgcctccggggtgtgcgtcacgggcagccagtcccccagcaccgagatcaccctgaagtaccccgggatctcccagagctccgtgggcgacatcggggtgcacatggcccacgacgaccagagcgtcagctccaagatcgtggcccactgcccgccccaggacccctgcctggtgcacggctgcatcgtctgcgcgcacggcctcatcaactaccagtgccacaccgccctgagcgccttcgtggtgatcttcgtcttctccagcacggccatcatctgcctggccgtgctctaccgggtgctgaagtgcctgaagatcgcgccccgcaaggtcctcaacccgctgatgtggatcaccgccttcatccggtgggtgtacaagaagatggtggcccgcgtcgccgacaacatcaaccaggtgaaccgcgagatcgggtggatggagggcgggcagctggccctcggcaaccccgcgcccatcccgcggcacgcccccatcccccgctactccacctacctgatgctgctcctgatcgtgagctacgcctccgcctgcagcgagctgatccaggcgtccagccggatcaccacgtgctccaccgagggcgtcaacaccaagtgccgcctgagccacaccgccctcatccgggccgggtccgtgggcgccgaggcctgcctgatgctgaagggggtgaaggaggaccagacgaagttcctcaagatcaagaccgtcagctccgagctgagctgccgcgagggccagtcctactggaccgggagcttcagccccaagtgcctgtccagccggcgctgccacctcgtgggcgagtgccacgtgaaccggtgcctgtcctggcgcgacaacgagaccagcgcggagttctccttcgtcggcgagagcacgaccatgcgggagaacaagtgcttcgagcagtgcgggggctgggggtgcggctgcttcaacgtgaacccgtcctgcctgttcgtgcacacctacctccagagcgtccgcaaggaggccctgcgggtgttcaactgcatcgactgggtgcacaagctgaccctcgagatcaccgacttcgacgggtccgtcagcacgatcgacctgggcgcctccagctcccgcttcaccaactggggcagcgtgtccctgagcctcgacgccgaggggatctccggcagcaactccttcagcttcatcgagagccccgggaagggctacgccatcgtggacgagcccttctccgagatcccccggcaggggttcctgggcgagatccgctgcaacagcgagtccagcgtcctgtccgcgcacgagagctgcctccgggccccgaacctggtgtcctacaagcccatgatcgaccagctggagtgcaccaccaacctcatcgaccccttcgtggtcttcgagcgcggcagcctgccccagacgcggaacgacaagaccttcgccgcctccaaggggaaccgcggcgtgcaggccttcagcaaggggtccgtgcaggcggacctgaccctccgcttcgacaacttcgaggtcgacttcgtgggcgccgccgtgagctgcgacgccgcgttcctgaacctgaccgggtgctactcctgcaacgccggcgcccgggtctgcctcagcatcacgtccaccggcaccgggaccctgagcgcccacaacaaggacggctccctgcacatcgtgctcccgagcgagaacgggacgaaggaccagtgccagatcctgcacttcaccgtgcccgaggtcgaggaggagttcatgtactcctgcgacggcgacgagcgccccctgctcgtgaagggcaccctgatcgccatcgaccccttcgacgaccggcgcgaggccgggggcgagagcaccgtcgtgaaccccaagagcgggtcctggaacttcttcgactggttcagcggcctgatgtcctggttcgggggccccctcaagacgatcctgctgatctgcctctacgtggccctgagcatcggcctgttcttcctcctgatctacctggggcggaccggcctctccaagatgtggctggccgccaccaagaaggccagctga

SEQ ID NO: 12880 - RNA, 3480 nt, synthetic construct
  misc_feature 1..3480: note = derived and/or modified CDS sequence (opt1) from RVFV(TAN/Dod-002/07)__HM586971.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagcaagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggccgcaagaagtgcaccggggacgccgccttctgcagcgcctacgagtgcacggcccagtacgcgaacgcctactgctcccacgccaacggcagcgggatcgtgcagatccaggtctccggcgtgtggaagaagcccctgtgcgtggggtacgagcgggtcgtggtcaagcgcgagctgagcgccaagccgatccagcgggtggagccctgcacgacctgcatcaccaagtgcgagccccacggcctggtggtccgctccaccggcttcaagatcagctccgcggtggcctgcgccagcggggtgtgcgtcaccggctcccagagcccctccaccgagatcaccctcaagtacccggggatcagccagtccagcggcggggacatcggcgtgcacatggcccacgacgaccagtccgtgagcagcaagatcgtcgcccactgcccgccccaggacccctgcctggtgcacggctgcatcgtgtgcgcgcaggcctggatcatctcccagtggcacacggccctgagcgccttcgtcgtgatcttcgtgttctccagcaccgccatcatctgcctcgcggtcctgtaccgggtgctgaagtgcctcaagatcgcgccccgcaaggtgctgaaccccctgatgtggatcaccgccttcatccggtgggtctacaagaagatggtggcccgcgtggccgacaacatcaaccaggtcaaccgcgagatcgggtggatggagggcgggcagctcgccctgggcaaccccgccccgatcccccggcacgcccccatcccccgctactccacctacctgatgctcctgctgatcgtgagctacgcctccgcgtgcagcgagctcatccaggcctccagccggatcacgacctgctccaccgagggcgtgaacaccaagtgccgcctgagcgggacggccctgatccgggccggctccgtcggggccgaggcgtgcctgatgctcaagggcgtgaaggaggaccagaccaagttcctgaagatcaagaccgtgagctccgagctgagctgccgcgaggggcagtcctactggaccggcagcttcagcccgaagtgcctctccagccggcgctgccacctggtcggcgagtgccacgtgaaccggtgcctgtcctggcgcgacaacgagacgagcgccgagttctccttcgtgggggagagcaccaccatgcgggagaacaagtgcttcgagcagtgcggcgggtggggctgcgggtgcttcaacgtcaacccctcctgcctcttcgtgcacacctacctgcagagcgtgcgcaaggaggccctgcgggtcttcaactgcatcgactgggtgcacaagctcaccctggagatcacggacttcgacggctccgtgagcaccatcgacctgggcgcctccagctcccgcttcaccaactgggggagcgtctccctcagcctggacgccgagggcatctccgggagcaactccttcagcttcatcgagagccccggcaaggggtacgcgatcgtggacgagcccttctccgagatcccgcggcagggcttcctgggcgagatccgctgcaacagcgagtccagcgtgctctccgcccacgagagctgcctgcgggcccccaacctggtctcctacaagcccatgatcgaccagctcgagtgcaccacgaacctgatcgaccccttcgtggtgttcgagcgcgggagcctgccgcagacccggaacgacaagaccttcgccgcctccaagggcaaccgcggggtccaggcgttcagcaagggctccgtgcaggccgacctcaccctgatgttcgacaacttcgaggtggacttcgtcggggccgccgtgagctgcgacgcggccttcctgaacctcacgggctgctactcctgcaacgccggcgcccgcgtgtgcctgagcatcacctccaccgggaccggcacgctgagcgcccacaacaaggacgggtccctccacatcgtcctgcccagcgagaacggcaccaaggaccagtgccagatcctgcacttcaccgtgcccgaggtggaggaggagttcatgtactcctgcgacggcgacgagcggcccctcctggtcaaggggaccctgatcgcgatcgacccgttcgacgaccgccgggaggccggcggggagagcacggtggtcaaccccaagagcggctcctggaacttcttcgactggttcagcgggctcatgtcctggttcggcggccccctgaagaccatcctgctcatctgcctgtacgtggccctgagcatcggcctcttcttcctgctgatctacctcgggcgcaccgggctgtccaagatgtggctggccgccaccaagaaggcgagctga

SEQ ID NO: 12881 - RNA, 3480 nt, synthetic construct
  misc_feature 1..3480: note = derived and/or modified CDS sequence (opt1) from RVFV(Smithburn)__DQ380193.1__NSm-Gn-Gc
  source 1..3480: mol_type = other RNA
atgatcgagggcgcctgggacagcctgcgcgaggaggagatgcccgaggagctctcctgcagcatctccgggatccgggaggtgaagaccagctcccaggagctgtaccgcgccctgaaggcgaccatcgccgccgacggcctcaacaacatcacgtgccacgggaaggacccggaggacaagatcagcctgatcaagggcccgccccacaagaagcgggtcggggtggtgcgctgcgagcggcagcgcgacgccaagcagatcggccggggcaccatggccgggatcgcgatgaccgtcttccccgccctggtggtgttcgccctcgcccccgtcgtgttcgcggaggacccccacctccgcaaccggcccggcaaggggcacaactacatcgacggcatgacccaggaggacgccacgtgcaagcccgtgacctacgccggggcctgctccagcttcgacgtcctgctggagaagggcaagttcccgctgttccagtcctacgcccaccaccgcaccctgctcgaggcggtgcacgacatcatcatcgccaaggccgacccgcccagctgcaacctgcagtccgcccacggcaacccctgcatgaaggagaagctggtgatgaagacctactgccccaacgactaccagagcgcccactacctcaacaacgacgggaagatggcgtccgtcaagtgcccgcccaagcacgagctgacggaggactgcaacttctgccggcagatgaccggcgccagcctgaaggaggggtcctaccccctccaggacctgttctgccagagctccgaggacgacggcagcaagctgaagaccaagatgaagggcgtgtgcgaggtgggggtccaggtgctcaagaagtgcgacggccagctgtccaccgcccacgaggtggtccccttcgccgtgttcaagaacagcaagaaggtgtacctggacaagctcgacctgaagacggaggagaacctgctccccgacagcttcgtctgcttcgagcacaaggggcagtacaagggcaccatggactccgggcagatcaagcgcgagctcaagagcttcgacatctcccagtgccccaagatcggcggccacgggagcaagaagtgcaccggcgacgccgcgttctgctccgcctacgagtgcaccgcccagtacgccaacgcctactgcagccacgcgaacgggtccggcatcgtgcagatccaggtgagcggggtctggaagaagcccctgtgcgtgggctacgagcgggtcgtggtgaagcgcgagctgtccgccaagccgatccagcgggtcgagccctgcacgacctgcatcaccaagtgcgagccccacggcctggtggtgcgcagcaccgggttcaagatctccagcgccgtcgcctgcgcgtccggcgtgtgcgtgacggggagccagtcccccagcaccgagatcaccctgaagtacccgggcatctcccagagctccgggggcgacatcggcgtccacatggcccacgacgaccagagcgtgagctccaagatcgtggcccactgcccgccccaggacccctgcctcgtccacgggtgcatcgtgtgcgcccacggcctgatcaactaccagtgccacaccgccttcagcgcgttcgtggtcgtgttcgtgttctccagcgtcgtgatcatctgcctggccatcctctacaaggtgctgaagtgcctgaagatcgcgccccggaaggtcctcaaccccctgatgtggatcacggccttcatccgctgggtgtacaagaagatggtggcccgggtcgccgacaacatcaaccaggtgaaccgcgagatcgggtggatggagggcggccagctggtgctcgggaaccccgccccgatcccccggcacgcccccatcccccgctactccacctacctgatgctgctcctgatcgtcagctacgcctccgcctgcagcgagctgatccaggcgtccagccgcatcacgacctgctccaccgagggcgtgaacaccaagtgccggctcagcgggaccgccctgatccgcgccggctccgtgggggccgaggcgtgcctgatgctgaagggcgtcaaggaggaccagaccaagttcctcaagatcaagacggtgagctccgagctgagctgccgggagggccagtcctactggaccgggagcttcagcccgaagtgcctgtccagccgccggtgccacctcgtgggcgagtgccacgtcaaccgctgcctgtcctggcgggacaacgagaccagcgccgagttctccttcgtgggggagagcaccacgatgcgcgagaacaagtgcttcgagcagtgcggcgggtggggctgcggctgcttcaacgtgaacccctcctgcctgttcgtccacacctacctccagagcgtgcggaaggaggccctgcgcgtgttcaactgcatcgactgggtccacaagctgaccctcgagatcaccgacttcgacgggtccgtgagcaccgtggacctgggcgcctccagctcccggttcacgaactgggggagcgtctccctgagcctcgacgccgagggcatctccgggagcaactccttcagcttcatcgagagccccggcaagggctacgcgatcgtggacgagcccttctccgagatcccgcgccaggggttcctgggcgagatccggtgcaacagcgagtccagcgtgctgtccgcccacgagagctgcctccgcgcccccaacctgatctcctacaagcccatgatcgaccagctggagtgcaccaccaacctcatcgaccccttcgtcgtgttcgagcgggggagcctgccgcagacccgcaacgacaagacgttcgccgcctccaagggcaaccgcggggtgcaggcgttcagcaagggctccgtccaggccgacctgaccctcatgttcgacaacttcgaggtggacttcgtgggcgccgccgtcagctgcgacgccgcgttcctgaacctgaccgggtgctactcctgcaacgccggcgcccgggtgtgcctcagcatcacctccacggggaccggcaccctgagcgcccacaacaaggacggctccctgcacatcgtcctccccagcgagaacgggaccaaggaccagtgccagatcctgcacttcacggtgcccgaggtggaggaggagttcatgtactcctgcgacggcgacgagcggcccctgctcgtcaaggggaccctgatcgcgatcgacccgttcgacgaccgccgcgaggccggcggggagagcaccgtggtgaaccccaagagcggctcctggaacttcttcgactggttcagcggcctgatgtcctggttcgggggccccctcaagaccatcctgctgatctgcctctacgtcgccctgagcatcgggctgttcttcttcctcatctacctgggccggacggggctgtccaagatgtggctcgccgccaccaagaaggcgagctga

SEQ ID NO: 12882 - RNA, 3480 nt, synthetic construct
  misc_feature 1..3480: note = derived and/or modified CDS sequence (opt1) from RVFV(KEN/Gar-004/06)__HM586964.1__NSm-Gn-Gc
  source 1..3480: mol_type = other RNA
atgatcgagggcgcctgggacagcctgcgcgaggaggagatgcccgaggagctctcctgcagcgtgtccgggatccgggaggtcaagaccagctcccaggagctgtaccgcgccctgaaggcgatcatcgccgccgacggcctcaacaacatcacgtgccacgggaagaacccggaggacaagatcagcctgatcaagggcccgccccacaagaagcgggtggggatcgtgcgctgcgagcggcgccgggacgccaagcagatcggccgcgagaccatggccggcatcgcgatgaccgtcctgcccgccctcgccgtgttcgccctggcgcccgtggtcttcgccgaggacccccacctccggaaccgccccgggaagggccacaactacatcgacgggatgacccaggaggacgcgacctgcaagcccgtgacgtacgccggcgcctgctccagcttcgacgtgctgctggagaaggggaagttcccgctgttccagtcctacgcccaccaccggaccctcctggaggccgtccacgacaccatcatcgccaaggccgacccgcccagctgcgacctgcagtccgcccacggcaacccctgcatgaaggagaagctcgtgatgaagacccactgccccaacgactaccagagcgcgcactacctgaacaacgacggcaagatggcctccgtgaagtgcccgcccaagtacgagctgacggaggactgcaacttctgccgccagatgaccggggccagcctcaagaagggctcctaccccctgcaggacctgttctgccagagctccgaggacgacgggagcaagctcaagaccaagatgaagggcgtctgcgaggtgggcgtgcaggccctgaagaagtgcgacgggcagctgtccaccgcccacgaggtcgtgcccttcgcggtgttcaagaacagccagaaggtctacctcgacaagctggacctgaagacggaggagaacctcctgcccgacagcttcgtgtgcttcgagcacaagggccagtacaaggggaccatggactccggccagaccaagcgggagctcaagagcttcgacatctcccagtgccccaagatcgggggccacggccgcaagaagcggaccggggacgccgccttctgcagcgcctacgagtgcacggcccagtacgcgaacgcctactgctcccgcgccaacggcagcgggatcgtgcagatccaggtctcccgggtgtggaagaagcccctgtgcgtgggctacgagcgcgtcgtggtcaagcgggagctgagcgccaagccgatccagcgcgtggagccctgcacgacctgcatcaccaagtgcgagccccacgggctggtggtccggtccaccggcttcaagatcagctccgcggtggcctgcgccagcggcgtgtgcgtcaccgggtcccagagcccctccaccgagatcaccctcaagtacccgggcatcagccagtccagcgggggcgacatcggggtgcacatggcccacgacgaccagtccgtgagcagcaagatcgtcgcccactgcccgccccaggacccctgcctggtgcacggctgcatcgtgtgcgcgcacggcctgatcaacaaccagtcccacagcgccctctccgccttcgtcgtgatcttcgtgttcagctccacggccatcatctgcctggccgtcctgtaccgcgtgctcaagtgcctgaagatcgcgccccgcaaggtgctgaaccccctcatgtggatcaccgccttcatccggtgggtctacaagaagatggtggcccgcgtggccgacaacatcaaccaggtcaaccgggagatcgggtggatggagggcgggcagctggccctgggcaaccccgcgccgatcccccgccacgcccccatcccccggtacagcacctacctcatgctgctgctcatcgtgtcctacgccagcgcctgctccgagctgatccaggcgagctcccgcatcaccacgtgcagcaccgagggcgtgaacaccaagtgccggctgtccgggaccgccctgatccgcgccggcagcgtcggggccgaggcctgcctcatgctgaagggcgtgaaggaggaccagacgaagttcctgaagatcaagaccgtgtccagcgagctctcctgccgggaggggcagagctactggaccggcagcttctccccgaagtgcctgagctcccgccggtgccacctggtcggcgagtgccacgtgaaccgctgcctcagctggcgggacaacgagacctccgcggagttcagcttcgtgggggagtccacgaccatgcgcgagaacaagtgcttcgagcagtgcggcgggtggggctgcgggtgcttcaacgtcaaccccagctgcctgttcgtgcacacctacctgcagtccgtgcggaaggaggccctccgcgtcttcaactgcatcgactgggtgcacaagctgaccctggagatcaccgacttcgacggcagcgtgtccacgatcgacctcggcgccagctccagccggttcaccaactgggggtccgtcagcctgtccctggacgccgagggcatcagcgggtccaacagcttcagcttcatcgagtcccccggcaaggggtacgccatcgtggacgagcccttcagcgagatcccgcgccagggcttcctcggcgagatccggtgcaactccgagagctccgtgctgagcgcgcacgagtcctgcctgcgcgcccccaacctcgtcagctacaagcccatgatcgaccagctggagtgcaccaccaacctgatcgaccccttcgtggtgttcgagcgcgggtccctcccgcagacgcggaacgacaagaccttcgccgccagcaagggcaaccgcggggtccaggccttctccaagggcagcgtgcaggcggacctgaccctgcggttcgacaacttcgaggtggacttcgtcggggccgccgtgtcctgcgacgccgcgttcctcaacctgaccggctgctacagctgcaacgccggcgcccgcgtgtgcctgtccatcacgagcaccgggaccggcaccctctccgcccacaacaaggacgggagcctgcacatcgtcctgccctccgagaacggcacgaaggaccagtgccagatcctccacttcaccgtgcccgaggtggaggaggagttcatgtacagctgcgacggcgacgagcggcccctgctggtcaaggggaccctcatcgccatcgacccgttcgacgaccgccgggaggcgggcggggagagcaccgtggtcaaccccaagtccggcagctggaacttcttcgactggttctccgggctgatgagctggttcggcggccccctgaagacgatcctcctgatctgcctgtacgtggccctctccatcgggctgttcttcctgctcatctacctgggccgcaccgggctgagcaagatgtggctcgccgccaccaagaaggcctcctga

SEQ ID NO: 12883 - RNA, 3204 nt, synthetic construct
  misc_feature 1..3204: note = derived and/or modified CDS sequence (opt1) from RVFV(ZH-548)__DQ380206.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgctcagcgcccacggcaacccctgcatgaaggagaagctggtcatgaagacgcactgccccaacgactaccagtccgcccactacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcccacggcctcatcaactaccagtgccacaccgcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtggatctacaagaagatggtggcccgcgtcgccgacaacatcaaccaggtgaaccgggagatcgggtggatggagggcgggcagctggtgctcggcaaccccgcccccatcccgcgccacgcccccatcccccggtactccacctacctgatgctgctcctgatcgtcagctacgcgagcgcctgctccgagctgatccaggccagctcccgcatcacgacctgcagcaccgagggggtgaacaccaagtgccggctctccggcacggccctgatccgcgccggcagcgtgggggcggaggcctgcctgatgctcaagggcgtcaaggaggaccagaccaagttcctgaagatcaagaccgtgtccagcgagctgtcctgccgggaggggcagagctactggaccggctccttcagcccgaagtgcctgtccagccgccggtgccacctcgtgggcgagtgccacgtcaaccgctgcctgtcctggcgcgacaacgagacgagcgccgagttctccttcgtgggggagagcaccaccatgcgggagaacaagtgcttcgagcagtgcggcgggtggggctgcgggtgcttcaacgtgaaccccagctgcctgttcgtccacacctacctccagtccgtgcgcaaggaggccctgcgggtgttcaactgcatcgactgggtccacaagctgacgctcgagatcaccgacttcgacggcagcgtgtccaccatcgacctgggcgcgagctccagccgcttcaccaactgggggtccgtgagcctgtccctcgacgccgagggcatcagcgggtccaacagcttctccttcatcgagagccccggcaaggggtacgccatcgtcgacgagcccttctccgagatcccgcggcagggcttcctgggcgagatccgctgcaacagcgagtccagcgtgctgtccgcccacgagagctgcctccgggcccccaacctgatcagctacaagcccatgatcgaccagctggagtgcaccacgaacctcatcgaccccttcgtggtcttcgagcgcgggtccctgccgcagacccggaacgacaagaccttcgcggccagcaagggcaaccgcggggtgcaggccttctccaagggcagcgtgcaggccgacctgaccctcatgttcgacaacttcgaggtcgacttcgtgggggccgcggtgtcctgcgacgccgccttcctgaacctgacgggctgctacagctgcaacgccggcgcccgggtctgcctctccatcaccagcaccgggaccggctccctgagcgcgcacaacaaggacgggtccctgcacatcgtgctccccagcgagaacggcacgaaggaccagtgccagatcctgcacttcaccgtgcccgaggtcgaggaggagttcatgtactcctgcgacggggacgagcgccccctgctcgtgaagggcaccctgatcgccatcgacccgttcgacgaccggcgcgaggccggcggggagagcaccgtggtcaaccccaagtccggcagctggaacttcttcgactggttctccgggctgatgagctggttcggcggccccctcaagacgatcctgctgatctgcctctacgtggccctgtccatcgggctgttcttcctcctgatctacctgggccggaccgggctcagcaagatgtggctggcggccaccaagaaggccagctga

SEQ ID NO: 12884 - RNA, 3204 nt, synthetic construct
  misc_feature 1..3204: note = derived and/or modified CDS sequence (opt1) from RVFV(2007000094)__EU574055.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcctgctccgagctgatccaggccagctcccgcatcacgacctgcagcaccgagggcgtgaacaccaagtgccggctgtccggcacggccctcatccgcgccgggagcgtcggcgcggaggcctgcctgatgctgaagggggtgaaggaggaccagaccaagttcctcaagatcaagaccgtgtccagcgagctgtcctgccgggagggccagagctactggaccggctccttcagcccgaagtgcctgtccagccgccggtgccacctggtcggggagtgccacgtgaaccgctgcctctcctggcgcgacaacgagacgagcgccgagttctccttcgtgggcgagagcaccaccatgcgggagaacaagtgcttcgagcagtgcgggggctgggggtgcggctgcttcaacgtcaaccccagctgcctgttcgtgcacacctacctgcagtccgtgcgcaaggaggccctccgggtcttcaactgcatcgactgggtgcacaagctgacgctggagatcaccgacttcgacggcagcgtgtccaccatcgacctcggggcgagctccagccgcttcaccaactggggctccgtcagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtcgtgttcgagcgcggctccctcccgcagacccggaacgacaagaccttcgcggccagcaaggggaaccgcggcgtgcaggccttctccaaggggagcgtccaggccgacctgaccctgatgttcgacaacttcgaggtggacttcgtgggcgccgcggtctcctgcgacgccgccttcctcaacctgacgggctgctacagctgcaacgccggggcccgggtgtgcctgtccatcaccagcaccggcaccgggacgctctccgcgcacaacaaggacggcagcctgcacatcgtgctgccctccgagaacgggaccaaggaccagtgccagatcctccacttcaccgtccccgaggtggaggaggagttcatgtacagctgcgacggcgacgagcgccccctgctggtgaagggcaccctcatcgccatcgacccgttcgacgaccggcgcgaggccgggggcgagtccacggtcgtgaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggaccggcctgtccaagatgtggctcgcggccaccaagaaggccagctga

SEQ ID NO: 12885 - RNA, 3204 nt, synthetic construct
  misc_feature 1..3204: note = derived and/or modified CDS sequence (opt1) from RVFV(ZH-548M12)__M25276.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctcctggagaaggggaagttcccgctgttccagagctacgcccaccaccgcaccctcctggaggcggtgcacgacaccatcatcgccaaggccgacccgccctcctgcgacctgctcagcgcccacggcaacccctgcatgaaggagaagctggtcatgaagacgcactgccccaacgactaccagtccgcccaccacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcccacggcctcatcaactaccagtgccacaccgcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtggatctacaagaagatggtggcccgcgtcgccgacaacatcaaccaggtgaaccgggagatcgggtggatggagggcgggcagctggtgctcggcaaccccgcccccatcccgcgccacgcccccatcccccggtactccacctacctgatgctgctcctgatcgtcagctacgcgagcgcctgctccgagctgatccaggccagctcccgcatcacgacctgcagcaccgagggggtgaacaccaagtgccggctctccggcacggccctgatccgcgccggcagcgtgggggcggaggcctgcctgatgctcaagggcgtcaaggaggaccagaccaagttcctgaagctgaagaccgtgtccagcgagctgtcctgccgggaggggcagagctactggaccggctccttcagcccgaagtgcctctccagccgccggtgccacctggtgggcgagtgccacgtcaaccgctgcctgtcctggcgcgacaacgagacgagcgccgagttctccttcgtgggggagagcaccaccatgcgggagaacaagtgcttcgagcagtgcggcgggtggggctgcgggtgcttcaacgtgaaccccagctgcctcttcgtccacacctacctgcagtccgtgcgcaaggaggccctgcgggtgttcaactgcatcgactgggtccacaagctcacgctggagatcaccgacttcgacggcagcgtgtccaccatcgacctgggcgcgagctccagccgcttcaccaactgggggtccgtgagcctctccctggacgccgagggcatcagcgggtccaacagcttctccttcatcgagagccccggcaaggggtacgccatcgtcgacgagcccttctccgagatcccgcggcagggcttcctgggcgagatccgctgcaacagcgagtccagcgtgctctccgcccacgagagctgcctgcgggcccccaacctgatcagctacaagcccatgatcgaccagctcgagtgcaccacgaacctgatcgaccccttcgtggtcttcgagcgcgggtccctgccgcagacccggaacgacaagaccttcgcggccagcaagggcaaccgcggggtgcaggccttctccaagggcagcgtgcaggccgacctcaccctgatgttcgacaacttcgaggtcgacttcgtgggggccgcggtgtcctgcgacgccgccttcctgaacctcacgggctgctacagctgcaacgccggcgcccgggtctgcctgtccatcaccagcaccgggaccggctccctgagcgcgcacaacaaggacgggtccctccacatcgtgctgcccagcgagaacggcacgaaggaccagtgccagatcctgcacttcaccgtgcccgaggtcgaggaggagttcatgtactcctgcgacggggacgagcgccccctcctggtgaagggcaccctgatcgccatcgacccgttcgacgaccggcgcgaggccggcggggagagcaccgtggtcaaccccaagtccggcagctggaacttcttcgactggttctccgggctcatgagctggttcggcggccccctgaagacgatcctgctcatctgcctgtacgtggccctgtccatcgggctgttcttcctgctgatctacctcggcgggaccggcctgagcaagatgtggctggcggccaccaagaaggccagctga

SEQ ID NO: 12886 - RNA, 3204 nt, synthetic construct
  misc_feature 1..3204: note = derived and/or modified CDS sequence (opt1) from RVFV(Sudan 86-2010)__JQ820489.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcctgctccgagctgatccaggccagctcccgcatcacgacctgcagcaccgagggcgtgaacaccaagtgccggctgtccggcacggccctcatccgcgccgggagcgtcggcgcggaggcctgcctgatgctgaagggggtgaaggaggaccagaccaagttcctcaagatcaagaccgtgtccagcgagctgtcctgccgggagggccagagctactggaccggctccttcagcccgaagtgcctgtccagccgccggtgccacctggtcggggagtgccacgtgaaccgctgcctctcctggcgcgacaacgagacgagcgccgagttctccttcgtgggcgagagcaccaccatgcgggagaacaagtgcttcgagcagtgcgggggctgggggtgcggctgcttcaacgtcaaccccagctgcctgttcgtgcacacctacctgcagtccgtgcgcaaggaggccctccgggtcttcaactgcatcgactgggtgcacaagctgacgctggagatcaccgacttcgacggcagcgtgtccaccatcgacctcggggcgagctccagccgcttcaccaactggggctccgtcagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtcatcttcgagcgcggctccctcccgcagacccggaacgacaagaccttcgcggccagcaaggggaaccgcggcgtgcaggccttctccaaggggagcgtgcaggccgacctgaccctgatgttcgacaacttcgaggtcgacttcgtgggcgccgcggtgtcctgcgacgccgccttcctcaacctgacgggctgctacagctgcaacgccggggcccgggtctgcctgtccatcaccagcaccggcaccgggacgctctccgcgcacaacaaggacggcagcctgcacatcgtgctgccctccgagaacgggaccaaggaccagtgccagatcctccacttcaccgtgcccgaggtcgaggaggagttcatgtacagctgcgacggcgacgagcgccccctgctggtgaagggcaccctcatcgccatcgacccgttcgacgaccggcgcgaggccgggggcgagtccacggtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggaccggcctgtccaagatgtggctcgcggccaccaagaaggccagctga

SEQ ID NO: 12887 - RNA, 3204 nt, synthetic construct
  misc_feature 1..3204: note = derived and/or modified CDS sequence (opt1) from RVFV(ZS-6365)__DQ380205.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtggatctacaagaagatggtggcccgcgtcgccgacaacatcaaccaggtgaaccgggagatcggctggatggagggcgggcagctggtgctggggaaccccgcccccatcccgcgccacgcccccatcccccggtactccacctacctcatgctgctgctcatcgtcagctacgcgagcgcctgctccgagctgatccaggccagctcccgcatcacgacctgcagcaccgagggcgtgaacaccaagtgccggctgtccggcacggccctcatccgcgccgggagcgtgggcgcggaggcctgcctgatgctgaagggggtcaaggaggaccagaccaagttcctcaagatcaagaccgtgtccagcgagctgtcctgccgggagggccagagctactggaccggctccttcagcccgaagtgcctgtccagccgccggtgccacctggtgggggagtgccacgtcaaccgctgcctctcctggcgcgacaacgagacgagcgccgagttctccttcgtgggcgagagcaccaccatgcgggagaacaagtgcttcgagcagtgcgggggctgggggtgcggctgcttcaacgtgaaccccagctgcctgttcgtccacacctacctgcagtccgtgcgcaaggaggccctccgggtgttcaactgcatcgactgggtccacaagctgacgctggagatcaccgacttcgacggcagcgtgtccaccatcgacctcggggcgagctccagccgcttcaccaactggggctccgtgagcctgtccctggacgccgaggggatcagcggctccaacagcttctccttcatcgagagccccgggaagggctacgccatcgtcgacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtggtcttcgagcgcggctccctcccgcagacccggaacgacaagaccttcgcggccagcaaggggaaccgcggcgtgcaggccttctccaaggggagcgtgcaggccgacctgaccctgatgttcgacaacttcgaggtcgacttcgtgggcgccgcggtgtcctgcgacgccgccttcctcaacctgacgggctgctacagctgcaacgccggggcccgggtctgcctgtccatcaccagcaccggcaccgggtccctcagcgcgcacaacaaggacggctccctgcacatcgtgctgcccagcgagaacgggacgaaggaccagtgccagatcctccacttcaccgtgcccgaggtcgaggaggagttcatgtactcctgcgacggcgacgagcgccccctgctggtgaagggcaccctcatcgccatcgacccgttcgacgaccggcgcgaggccgggggcgagagcaccgtggtcaaccccaagtccgggagctggaacttcttcgactggttctccggcctgatgagctggttcggcgggcccctgaagacgatcctcctgatctgcctgtacgtggccctctccatcggcctgttcttcctgctcatctacctggggcggaccggcctgagcaagatgtggctcgcggccaccaagaaggccagctga

SEQ ID NO: 12888 - RNA, 3204 nt, synthetic construct
  misc_feature 1..3204: note = derived and/or modified CDS sequence (opt1) from RVFV(1853/78)__DQ380220.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcggggtggtgcagatccaggtctccggcgtgtggaagaagcccctgtgcgtggggtacgagcgggtcgtggtgaagcgcgagctgagcgccaagccgatccagcgggtcgagccctgcacgacctgcatcaccaagtgcgagccccacggcctggtggtccgctccaccggcttcaagatcagctccgccgtggcctgcgcgagcggggtgtgcgtcaccggctcccagagcccctccaccgagatcacgctcaagtacccggggatcagccagtccagcggcggggacatcggcgtgcacatggcccacgacgaccagtccgtgagctccaagatcgtcgcccactgcccgccccaggacccctgcctggtgcacggctgcatcgtgtgcgcccacgggctgatcaactaccagtgccacaccgcgctcagcgccttcgtcgtggtgttcgtcttctccagcatcgccatcatctgcctggccatcctgtaccgggtgctcaagtgcctgaagatcgcgccccgcaaggtgctgaaccccctcatgtggatcaccgccttcatccggtgggtctacaagaagatggtggcccgcgtggccgacaacatcaaccaggtcaaccgggagatcggctggatggagggcgggcagctggtgctggggaaccccgcccccatcccgcgccacgcccccatcccccggtactccacctacctcatgctgctgctcatcgtgagctacgcgagcgcctgctccgagctgatccaggccagctcccgcatcacgacctgcagcaccgagggcgtcaacaccaagtgccggctgtccggcacggccctcatccgcgccgggagcgtgggcgcggaggcctgcctgatgctgaagggggtgaaggaggaccagaccaagttcctcaagatcaagaccgtctccagcgagctgtcctgccgggagggccagagctactggaccggctccttcagcccgaagtgcctgtccagccgccggtgccacctggtgggggagtgccacgtgaaccgctgcctctcctggcgcgacaacgagacgagcgccgagttctccttcgtcggcgagagcaccaccatgcgggagaacaagtgcttcgagcagtgcgggggctgggggtgcggctgcttcaacgtgaaccccagctgcctgttcgtgcacacctacctgcagtccgtccgcaaggaggccctccgggtgttcaactgcatcgactgggtgcacaagctgacgctggagatcaccgacttcgacggcagcgtctccaccatcgacctcggggcgagctccagccgcttcaccaactggggctccgtgagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtcctgtccgcccacgagagctgcctgcgggcccccaacctcatcagctacaagcccatgatcgaccagctggagtgcaccacgaacctgatcgaccccttcgtggtgttcgagcgcggctccctcccgcagacccggaacgacaagaccttcgcggccagcaaggggaaccgcggcgtccaggccttctccaaggggagcgtgcaggccgacctgaccctgatgttcgacaacttcgaggtggacttcgtcggcgccgcggtgtcctgcgacgccgccttcctcaacctgacgggctgctacagctgcaacgccggggcccgggtgtgcctgtccatcaccagcaccggcaccgggacgctctccgcgcacaacaaggacggcagcctgcacatcgtcctgccctccgagaacgggaccaaggaccagtgccagatcctccacttcaccgtgcccgaggtggaggaggagttcatgtacagctgcgacggcgacgagcgccccctgctggtcaagggcaccctcatcgccatcgacccgttcgacgaccggcgcgaggccgggggcgagtccacggtggtgaaccccaagagcgggtcctggaacttcttcgactggttcagcggcctgatgtcctggttcggcgggcccctgaagaccatcctcctgatctgcctgtacgtcgccctcagcatcggcctgttcttcctgctcatctacctggggcggaccggcctgtccaagatgtggctcgcggccaccaagaaggccagctga

SEQ ID NO: 12889 - RNA, 3204 nt, synthetic construct
  misc_feature 1..3204: note = derived and/or modified CDS sequence (opt1) from RVFV(T1)__DQ380201.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccgtcctgtaccgggtgctcaagtgcctgaagatcgcgccccgcaaggtgctgaaccccctcatgtggatcaccgccttcatccggtggatctacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcctgctccgagctgatccaggccagctcccgcatcacgacctgcagcaccgagggcgtgaacaccaagtgccggctgtccggcacggccctcatccgcgccgggagcgtcggcgcggaggcctgcctgatgctgaagggggtgaaggaggaccagaccaagttcctcaagatcaagaccgtgtccagcgagctgtcctgccgggagggccagagctactggaccggctccttcagcccgaagtgcctgtccagccgccggtgccacctggtcggggagtgccacgtgaaccgctgcctctcctggcgcgacaacgagacgagcgccgagttctccttcgtgggcgagagcaccaccatgcgggagaacaagtgcttcgagcagtgcgggggctgggggtgcggctgcttcaacgtcaaccccagctgcctgttcgtgcacacctacctgcagtccgtgcgcaaggaggccctccgggtcttcaactgcatcgactgggtgcacaagctgacgctggagatcaccgacttcgacggcagcgtgtccaccatcgacctcggggcgagctccagccgcttcaccaactggggctccgtcagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtcgtgttcgagcgcggctccctcccgcagacccggaacgacaagaccttcgcggccagcaaggggaaccgcggcgtgcaggccttctccaaggggagcgtccaggccgacctgaccctgatgttcgacaacttcgaggtggacttcgtgggcgccgcggtctcctgcgacgccgccttcctcaacctgacgggctgctacagctgcaacgccggggcccgggtgtgcctgtccatcaccagcaccggcaccgggtccctcagcgcgcacaacaaggacggctccctgcacatcgtgctgcccagcgagaacgggacgaaggaccagtgccagatcctccacttcaccgtccccgaggtggaggaggagttcatgtactcctgcgacggcgacgagcgccccctgctggtgaagggcaccctcatcgccatcgacccgttcgacgaccggcgcgaggccgggggcgagagcaccgtcgtgaaccccaagtccgggagctggaacttcttcgactggttctccggcctgatgagctggttcggcgggcccctgaagacgatcctcctgatctgcctgtacgtggccctctccatcggcctgttcttcctgctcatctacctggggcggaccggcctgagcaagatgtggctcgcggccaccaagaaggccagctga

SEQ ID NO: 12890 - RNA, 3204 nt, synthetic construct
  misc_feature 1..3204: note = derived and/or modified CDS sequence (opt1) from RVFV(Kenya 83 (21445))__DQ380198.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggccctggggaaccccgcccccatcccgcgccacgcgcccatcccccggtactccacctacctcatgctgctgctcatcgtcagctacgccagcgcctgctccgagctgatccaggccagctcccgcatcacgacctgcagcaccgagggcgtgaacaccaagtgccggctgtccggcacggccctcatccgcgcggggagcgtgggcgccgaggcctgcctgatgctgaagggggtcaaggaggaccagaccaagttcctcaagatcaagaccgtgtccagcgagctgtcctgccgggagggccagagctactggaccggctccttcagcccgaagtgcctgtccagccgccggtgccacctggtgggggagtgccacgtcaaccgctgcctctcctggcgcgacaacgagacgagcgccgagttctccttcgtgggcgagagcaccaccatgcgggagaacaagtgcttcgagcagtgcgggggctgggggtgcggctgcttcaacgtgaaccccagctgcctgttcgtccacacctacctgcagtccgtgcgcaaggaggcgctccgggtgttcaactgcatcgactgggtccacaagctgacgctggagatcaccgacttcgacggcagcgtgtccaccatcgacctcggggccagctccagccgcttcaccaactggggctccgtgagcctgtccctggacgccgaggggatcagcggctccaacagcttctccttcatcgagagccccgggaagggctacgccatcgtcgacgagcccttctccgagatcccgcggcagggcttcctcggggagatccgctgcaacagcgagtccagcgtgctgtccgcccacgagagctgcctgcgggcgcccaacctcatcagctacaagcccatgatcgaccagctggagtgcaccacgaacctgatcgaccccttcgtggtcttcgagcgcggctccctcccgcagacccggaacgacaagaccttcgccgccagcaaggggaaccgcggcgtgcaggccttctccaaggggagcgtgcaggccgacctgaccctgatgttcgacaacttcgaggtcgacttcgtgggcgcggccgtgtcctgcgacgccgccttcctcaacctgacgggctgctacagctgcaacgccggggcgcgggtctgcctgtccatcaccagcaccggcaccgggacgctctccgcccacaacaaggacggcagcctgcacatcgtgctgccctccgagaacgggaccaaggaccagtgccagatcctccacttcaccgtgcccgaggtcgaggaggagttcatgtacagctgcgacggcgacgagcgccccctgctggtgaagggcaccctcatcgccatcgacccgttcgacgaccggcgcgaggccgggggcgagtccacggtggtcaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcggaccggcctgtccaagatgtggctcgccgccaccaagaaggccagctga

SEQ ID NO: 12891 - RNA, 3204 nt, synthetic construct
  misc_feature 1..3204: note = derived and/or modified CDS sequence (opt1) from RVFV(Sudan 85-2010)__JQ820488.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcctgctccgagctgatccaggccagctcccgcatcacgacctgcagcaccgagggcgtgaacaccaagtgccggctgtccggcacggccctcatccgcgccgggagcgtcggcgcggaggcctgcctgatgctgaagggggtgaaggaggaccagaccaagttcctcaagatcaagaccgtgtccagcgagctgtcctgccgggagggccagagctactggaccggctccttcagcccgaagtgcctgtccagccgccggtgccacctggtcggggagtgccacgtgaaccgctgcctctcctggcgcgacaacgagacgagcgccgagttctccttcgtgggcgagagcaccaccatgcgggagaacaagtgcttcgagcagtgcgggggctgggggtgcggctgcttcaacgtcaaccccagctgcctgttcgtgcacacctacctgcagtccgtgcgcaaggaggccctccgggtcttcaactgcatcgactgggtgcacaagctgacgctggagatcaccgacttcgacggcagcgtgtccaccatcgacctcggggcgagctccagccgcttcaccaactggggctccgtcagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtcgtgttcgagcgcggctccctcccgcagacccggaacgagaagaccttcgcggccagcaaggggaaccgcggcgtgcaggccttctccaaggggagcgtccaggccgacctgaccctgatgttcgacaacttcgaggtggacttcgtgggcgccgcggtctcctgcgacgccgccttcctcaacctgacgggctgctacagctgcaacgccggggcccgggtgtgcctgtccatcaccagcaccggcaccgggacgctctccgcgcacaacaaggacggcagcctgcacatcgtgctgccctccgagaacgggaccaaggaccagtgccagatcctccacttcaccgtccccgaggtggaggaggagttcatgtacagctgcgacggcgacgagcgccccctgctggtgaagggcaccctcatcgccatcgacccgttcgacgaccggcgcgaggccgggggcgagtccacggtcgtgaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggaccggcctgtccaagatgtggctcgcggccaccaagaaggccagctga

SEQ ID NO: 12892 - RNA, 3204 nt, synthetic construct
  misc_feature 1..3204: note = derived and/or modified CDS sequence (opt1) from RVFV(2007004194)__EU574031.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgagcaacgacggcaagatggcgtccgtgaagtgcccgcccaagtacgagctgaccgaggactgcaacttctgccggcagatgaccggggccagcctcaagaagggctcctaccccctgcaggacctgttctgccagagctccgaggacgacgggagcaagctcaagaccaagatgaagggcgtgtgcgaggtcggggtgcaggccctgaagaagtgcgacggccagctgtccacggcccacgaggtggtccccttcgccgtgttcaagaacagcaagaaggtgtacctcgacaagctggacctgaagaccgaggagaacctcctgcccgactccttcgtctgcttcgagcacaagggccagtacaaggggaccatggacagcggccagaccaagcgcgagctgaagtccttcgacatcagccagtgccccaagatcgggggccacggctccaagaagtgcacgggggacgcggccttctgcagcgcctacgagtgcaccgcccagtacgccaacgcgtactgcagccacgccaacggctccgggatcgtgcagatccaggtgagcggcgtctggaagaagcccctctgcgtggggtacgagcgggtggtcgtgaagcgcgagctgtccgccaagccgatccagcgggtggagccctgcacgacctgcatcaccaagtgcgagccccacggcctggtcgtgcgcagcaccggcttcaagatctccagcgccgtcgcctgcgcgtccggggtgtgcgtgaccggcagccagtcccccagcaccgagatcacgctcaagtacccggggatctcccagagctccggcggggacatcggcgtccacatggcccacgacgaccagagcgtgtccagcaagatcgtggcccactgcccgccccaggacccctgcctggtccacggctgcatcgtgtgcgcccacgggctgatcaactaccagtgccacaccgcgctctccgccttcgtggtcgtgttcgtgttcagctccatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtacagcacctacctcatgctgctgctcatcgtgagctacgcgtccgcctgcagcgagctgatccaggcctccagccgcatcacgacctgctccaccgagggcgtgaacaccaagtgccggctgagcggcacggccctcatccgcgccgggtccgtcggcgcggaggcctgcctgatgctgaagggggtgaaggaggaccagaccaagttcctcaagatcaagaccgtgagctccgagctgagctgccgggagggccagtcctactggaccggcagcttctccccgaagtgcctgagctcccgccggtgccacctggtcggggagtgccacgtgaaccgctgcctcagctggcgcgacaacgagacgtccgccgagttcagcttcgtgggcgagagcaccaccatgcgggagaacaagtgcttcgagcagtgcgggggctgggggtgcggctgcttcaacgtcaacccctcctgcctgttcgtgcacacctacctgcagagcgtgcgcaaggaggccctccgggtcttcaactgcatcgactgggtgcacaagctgacgctggagatcaccgacttcgacggctccgtgagcaccatcgacctcggggcgtccagctcccgcttcaccaactggggcagcgtctccctgagcctggacgccgaggggatctccggcagcaactccttcagcttcatcgagtcccccgggaagggctacgccatcgtggacgagcccttcagcgagatcccgcggcagggcttcctcggggagatccgctgcaactccgagagctccgtgctgagcgcccacgagagctgcctgcgggcccccaacctcatctcctacaagcccatgatcgaccagctggagtgcaccacgaacctgatcgaccccttcgtcgtgttcgagcgcggcagcctcccgcagacccggaacgacaagaccttcgcggcctccaaggggaaccgcggcgtgcaggccttcagcaaggggtccgtccaggccgacctgaccctgatgttcgacaacttcgaggtggacttcgtgggcgccgcggtcagctgcgacgccgccttcctcaacctgacgggctgctactcctgcaacgccggggcccgggtgtgcctgagcatcacctccaccggcaccgggacgctcagcgcgcacaacaaggacggctccctgcacatcgtgctgcccagcgagaacgggaccaaggaccagtgccagatcctccacttcaccgtccccgaggtggaggaggagttcatgtactcctgcgacggcgacgagcgccccctgctggtgaagggcaccctcatcgccatcgacccgttcgacgaccggcgcgaggccgggggcgagagcacggtcgtgaaccccaagtccgggagctggaacttcttcgactggttctccggcctgatgagctggttcggcgggcccctgaagaccatcctcctgatctgcctgtacgtggccctctccatcggcctgttcttcctgctcatctacctggggcggaccggcctgagcaagatgtggctcgcggccaccaagaaggccagctga

SEQ ID NO: 12893 - RNA, 3204 nt, synthetic construct
  misc_feature 1..3204: note = derived and/or modified CDS sequence (opt1) from RVFV(2250/74)__DQ380209.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtggatctacaagaagatggtggcccgcgtcgccgacaacatcaaccaggtgaaccgggagatcggctggatggagggcgggcagctggtgctggggaaccccgcccccatcccgcgccacgcccccatcccccggtactccacctacctcatgctgctgctcatcgtcagctacgcgagcgcctgctccgagctgatccaggccagctcccgcatcacgacctgcagcaccgagggcgtgaacaccaagtgccggctgtccggcacggccctcatccgcgccgggagcgtgggcgcggaggcctgcctgatgctgaagggggtcaaggaggaccagaccaagttcctcaagatcaagaccgtgtccagcgagctgtcctgccgggagggccagagctactggaccggctccttcagcccgaagtgcctgtccagccgccggtgccacctggtgggggagtgccacgtcaaccgctgcctctcctggcgcgacaacgagacgagcgccgagttctccttcgtgggcgagagcaccaccatgcgggagaacaagtgcttcgagcagtgcgggggctgggggtgcggctgcttcaacgtgaaccccagctgcctgttcgtccacacctacctgcagtccgtgcgcaaggaggccctccgggtgttcaactgcatcgactgggtccacaagctgacgctggagatcaccgacttcgacggcagcgtgtccaccatcgacctcggggcgagctccagccgcttcaccaactggggctccgtgagcctgtccctggacgccgaggggatcagcggctccaacagcttctccttcatcgagagccccgggaagggctacgccatcgtcgacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtggtcttcgagcgcggctccctcccgcagacccggaacgacaagaccttcgcggccagcaaggggaaccgcggcgtgcaggccttctccaaggggagcgtgcaggccgacctgaccctgatgttcgacaacttcgaggtcgacttcgtgggcgccgcggtgtcctgcgacgccgccttcctcaacctgacgggctgctacagctgcaacgccggggccaaggtctgcctgtccatcaccagcaccggcaccgggtccctcagcgcgcacaacaaggacggctccctgcacatcgtgctgcccagcgagaacgggacgaaggaccagtgccagatcctccacttcaccgtgcccgaggtcgaggaggagttcatgtactcctgcgacggcgacgagcggcccctgctggtgaagggcaccctcatcgccatcgacccgttcgacgaccgccgggaggccgggggcgagagcaccgtggtcaaccccaagtccgggagctggaacttcttcgactggttctccggcctgatgagctggttcggcgggcccctgaagacgatcctcctgatctgcctgtacgtggccctctccatcggcctgttcttcctgctcatctacctggggcgcaccggcctgagcaagatgtggctcgcggccaccaagaaggccagctga

SEQ ID NO: 12894 - RNA, 3204 nt, synthetic construct
  misc_feature 1..3204: note = derived and/or modified CDS sequence (opt1) from RVFV(Sudan 28-2010)__JQ820491.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcctgctccgagctgatccaggccagctcccgcatcacgacctgcagcaccgagggcgtgaacaccaagtgccggctgtccggcacggccctcatccgcgccgggagcgtcggcgcggaggcctgcctgatgctgaagggggtgaaggaggaccagaccaagttcctcaagatcaagaccgtgtccagcgagctgtcctgccgggagggccagagctactggaccggctccttcagcccgaagtgcctgtccagccgccggtgccacctggtcggggagtgccacgtgaaccgctgcctctcctggcgcgacaacgagacgagcgccgagttctccttcgtgggcgagagcaccaccatgcgggagaacaagtgcttcgagcagtgcgggggctgggggtgcggctgcttcaacgtcaaccccagctgcctgttcgtgcacacctacctgcagtccgtgcgcaaggaggccctccgggtcttcaactgcatcgactgggtgcacaagctgacgctggagatcaccgacttcgacggcagcgtgtccaccatcgacctcggggcgagctccagccgcttcaccaactggggctccgtcagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtcgtgttcgagcgcggctccctcccgcagacccggaacgacaagaccttcgcggccagcaaggggaaccgcggcgtgcaggccttctccaaggggagcgtccaggccgacctgaccctgatgttcgacaacttcgaggtggacttcgtgggcgccgcggtctcctgcgacgccgccttcctcaacctgacgggctgctacagctgcaacgccggggcccgggtgtgcctgtccatcaccagcaccggcaccgggacgctctccgcgcacaacaaggacggcagcctgcacatcgtgctgccctccgagaacgggaccaaggaccagtgccagatcctccacttcaccgtccccgaggtggaggaggagttcatgtacagctgcgacggcgacgagcgccccctgctggtgaagggcaccctcatcgccatcgacccgttcgacgaccggcgcgaggccgggggcgagtccacggtcgtgaaccccaagagcgggtcctggaacttcttcgactggttcagcggcctgatgtcctggttcggcgggcccctgaagaccatcctcctgatctgcctgtacgtggtcctcagcatcggcctgttcttcctgctcatctacctggggcggaccggcctgtccaagatgtggctcgccgcgaccaagaaggccagctga

SEQ ID NO: 12895 - RNA, 3204 nt, synthetic construct
  misc_feature 1..3204: note = derived and/or modified CDS sequence (opt1) from RVFV(2007000324)__JF326195.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggccctggggaaccccgcccccatcccgcgccacgcgcccatcccccggtactccacgtacctcatgctgctgctcatcgtcagctacgccagcgcctgctccgagctgatccaggccagctcccgcatcacgacctgcagcaccgagggcgtgaacaccaagtgccggctgtccggcaccgccctcatccgcgcggggagcgtgggcgccgaggcctgcctgatgctgaagggggtcaaggaggaccagaccaagttcctcaagatcaagaccgtgtccagcgagctgtcctgccgggagggccagagctactggacgggctccttcagcccgaagtgcctgtccagccgccggtgccacctggtgggggagtgccacgtcaaccgctgcctctcctggcgcgacaacgagaccagcgccgagttctccttcgtgggcgagagcaccaccatgcgggagaacaagtgcttcgagcagtgcgggggctgggggtgcggctgcttcaacgtgaaccccagctgcctgttcgtccacacgtacctgcagtccgtgcgcaaggaggcgctccgggtgttcaactgcatcgactgggtccacaagctgaccctggagatcaccgacttcgacggcagcgtgtccaccatcgacctcggggccagctccagccgcttcaccaactggggctccgtgagcctgtccctggacgccgaggggatcagcggctccaacagcttctccttcatcgagagccccgggaagggctacgccatcgtcgacgagcccttctccgagatcccgcggcagggcttcctcggggagatccgctgcaacagcgagtccagcgtgctgtccgcccacgagagctgcctgcgggcgcccaacctcgtgagctacaagcccatgatcgaccagctggagtgcacgaccaacctgatcgaccccttcgtcgtgttcgagcgcggctccctcccgcagacccggaacgacaagaccttcgccgccagcaaggggaaccgcggcgtgcaggccttctccaaggggagcgtccaggccgacctgacgctgatgttcgacaacttcgaggtggacttcgtgggcgcggccgtctcctgcgacgccgccttcctcaacctgaccggctgctacagctgcaacgccggggcgcgggtgtgcctgtccatcaccagcaccggcacggggaccctctccgcccacaacaaggacggcagcctgcacatcgtgctgccctccgagaacgggaccaaggaccagtgccagatcctccacttcaccgtccccgaggtggaggaggagttcatgtacagctgcgacggcgacgagcgccccctgctggtgaagggcacgctcatcgccatcgacccgttcgacgaccggcgcgaggccgggggcgagtccaccgtcgtgaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcggaccggcctgtccaagatgtggctcgccgccacgaagaaggccagctga

SEQ ID NO: 12896 - RNA, 3204 nt, synthetic construct
  misc_feature 1..3204: note = derived and/or modified CDS sequence (opt1) from RVFV(ZM-657)__DQ380204.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaaggcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtggatctacaagaagatggtggcccgcgtcgccgacaacatcaaccaggtgaaccgggagatcggctggatggagggcgggcagctggtgctggggaaccccgcccccatcccgcgccacgcccccatcccccggtactccacctacctcatgctgctgctcatcgtcagctacgcgagcgcctgctccgagctgatccaggccagctcccgcatcacgacctgcagcaccgagggcgtgaacaccaagtgccggctgtccggcacggccctcatccgcgccgggagcgtgggcgcggaggcctgcctgatgctgaagggggtcaaggaggaccagaccaagttcctcaagatcaagaccgtgtccagcgagctgtcctgccgggagggccagagctactggaccggctccttcagcccgaagtgcctgtccagccgccggtgccacctggtgggggagtgccacgtcaaccgctgcctctcctggcgcgacaacgagacgagcgccgagttctccttcgtgggcgagagcaccaccatgcgggagaacaagtgcttcgagcagtgcgggggctgggggtgcggctgcttcaacgtgaaccccagctgcctgttcgtccacacctacctgcagtccgtgcgcaaggaggccctccgggtgttcaactgcatcgactgggtccacaagctgacgctggagatcaccgacttcgacggcagcgtgtccaccatcgacctcggggcgagctccagccgcttcaccaactggggctccgtgagcctgtccctggacgccgaggggatcagcggctccaacagcttctccttcatcgagagccccgggaagggctacgccatcgtcgacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtggtcttcgagcgcggctccctcccgcagacccggaacgacaagaccttcgcggccagcaaggggaaccgcggcgtgcaggccttctccaaggggagcgtgcaggccgacctgaccctgatgttcgacaacttcgaggtcgacttcgtgggcgccgcggtgtcctgcgacgccgccttcctcaacctgacgggctgctacagctgcaacgccggggcccgggtctgcctgtccatcaccagcaccggcaccgggtccctcagcgcgcacaacaaggacggctccctgcacatcgtgctgcccagcgagaacgggacgaaggaccagtgccagatcctccacttcaccgtgcccgaggtcgaggaggagttcatgtactcctgcgacggcgacgagcgccccctgctggtgaagggcaccctcatcgccatcgacccgttcgacgaccggcgcgaggccgggggcgagagcaccgtggtcaaccccaagtccgggagctggaacttcttcgactggttctccggcctgatgagctggttcggcgggcccctgaagacgatcctcctgatctgcctgtacgtggccctctccatcggcctgttcttcctgctcatctacctggggcggaccggcctgagcaagatgtggctcgcggccaccaagaaggccagctga

SEQ ID NO: 12897 - RNA, 3204 nt, synthetic construct
  misc_feature 1..3204: note = derived and/or modified CDS sequence (opt1) from RVFV(T-46 (228113))__DQ380199.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccaaggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccgtcctgtaccgggtgctcaagtgcctgaagatcgcgccccgcaaggtgctgaaccccctcatgtggatcaccgccttcatccggtggatctacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcctgctccgagctgatccaggccagctcccgcatcacgacctgcagcaccgagggcgtgaacaccaagtgccggctgtccggcacggccctcatccgcgccgggagcgtcggcgcggaggcctgcctgatgctgaagggggtgaaggaggaccagaccaagttcctcaagatcaagaccgtgtccagcgagctgtcctgccgggagggccagagctactggaccggctccttcagcccgaagtgcctgtccagccgccggtgccacctggtcggggagtgccacgtgaaccgctgcctctcctggcgcgacaacgagacgagcgccgagttctccttcgtgggcgagagcaccaccatgcgggagaacaagtgcttcgagcagtgcgggggctgggggtgcggctgcttcaacgtcaaccccagctgcctgttcgtgcacacctacctgcagtccgtgcgcaaggaggccctccgggtcttcaactgcatcgactgggtgcacaagctgacgctggagatcaccgacttcgacggcagcgtgtccaccatcgacctcggggcgagctccagccgcttcaccaactggggctccgtcagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtcgtgttcgagcgcggctccctcccgcagacccggaacgacaagaccttcgcggccagcaaggggaaccgcggcgtgcaggccttctccaaggggagcgtccaggccgacctgaccctgatgttcgacaacttcgaggtggacttcgtgggcgccgcggtctcctgcgacgccgccttcctcaacctgacgggctgctacagctgcaacgccggggcccgggtgtgcctgtccatcaccagcaccggcaccgggtccctcagcgcgcacaacaaggacggctccctgcacatcgtgctgcccagcgagaacgggacgaaggaccagtgccagatcctccacttcaccgtccccgaggtggaggaggagttcatgtactcctgcgacggcgacgagcgccccctgctggtgaagggcaccctcatcgccatcgacccgttcgacgaccggcgcgaggccgggggcgagagcaccgtcgtgaaccccaagtccgggagctggaacttcttcgactggttctccggcctgatgagctggttcggcgggcccctgaagacgatcctcctgatctgcctgtacgtggccctctccatcggcctgttcttcctgctcatctacctggggcggaccggcctgagcaagatgtggctcgcggccaccaagaaggccagctga

SEQ ID NO: 12898 - RNA, 3204 nt, synthetic construct
  misc_feature 1..3204: note = derived and/or modified CDS sequence (opt1) from RVFV(MP12)__Z30318.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctcctggagaaggggaagttcccgctgttccagagctacgcccaccaccgcaccctcctggaggcggtgcacgacaccatcatcgccaaggccgacccgccctcctgcgacctgctcagcgcccacggcaacccctgcatgaaggagaagctggtcatgaagacgcactgccccaacgactaccagtccgcccaccacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcccacggcctcatcaactaccagtgccacaccgcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtggatctacaagaagatggtggcccgcgtcgcccacaacatcaaccaggtgaaccgggagatcgggtggatggagggcgggcagctggtgctcggcaaccccgcccccatcccgcgccacgcccccatcccccggtactccacctacctgatgctgctcctgatcgtcagctacgcgagcgcctgctccgagctgatccaggccagctcccgcatcacgacctgcagcaccgagggggtgaacaccaagtgccggctctccggcacggccctgatccgcgccggcagcgtgggggcggaggcctgcctgatgctcaagggcgtcaaggaggaccagaccaagttcctgaagctgaagaccgtgtccagcgagctgtcctgccgggaggggcagagctactggaccggctccttcagcccgaagtgcctctccagccgccggtgccacctggtgggcgagtgccacgtcaaccgctgcctgtcctggcgcgacaacgagacgagcgccgagttctccttcgtgggggagagcaccaccatgcgggagaacaagtgcttcgagcagtgcggcgggtggggctgcgggtgcttcaacgtgaaccccagctgcctcttcgtccacacctacctgcagtccgtgcgcaaggaggccctgcgggtgttcaactgcatcgactgggtccacaagctcacgctggagatcaccgacttcgacggcagcgtgtccaccatcgacctgggcgcgagctccagccgcttcaccaactgggggtccgtgagcctctccctggacgccgagggcatcagcgggtccaacagcttctccttcatcgagagccccggcaaggggtacgccatcgtcgacgagcccttctccgagatcccgcggcagggcttcctgggcgagatccgctgcaacagcgagtccagcgtgctctccgcccacgagagctgcctgcgggcccccaacctgatcagctacaagcccatgatcgaccagctcgagtgcaccacgaacctgatcgaccccttcgtggtcttcgagcgcgggtccctgccgcagacccggaacgacaagaccttcgcggccagcaagggcaaccgcggggtgcaggccttctccaagggcagcgtgcaggccgacctcaccctgatgttcgacaacttcgaggtcgacttcgtgggggccgcggtgtcctgcgacgccgccttcctgaacctcacgggctgctacagctgcaacgccggcgcccgggtctgcctgtccatcaccagcaccgggaccggctccctgagcgcgcacaacaaggacgggtccctccacatcgtgctgcccagcgagaacggcacgaaggaccagtgccagatcctgcacttcaccgtgcccgaggtcgaggaggagttcatgtactcctgcgacggggacgagcgccccctcctggtgaagggcaccctgatcgccatcgacccgttcgacgaccggcgcgaggccggcggggagagcaccgtggtcaaccccaagtccggcagctggaacttcttcgactggttctccgggctcatgagctggttcggcggccccctgaagacgatcctgctcatctgcctgtacgtggccctgtccatcgggctgttcttcctgctgatctacctcggcgggaccggcctgagcaagatgtggctggcggccaccaagaaggccagctga

SEQ ID NO: 12899 - RNA, 3204 nt, synthetic construct
  misc_feature 1..3204: note = derived and/or modified CDS sequence (opt1) from RVFV(200803166)__JF311381.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctgaagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgacggcctgcagcgagctgatccaggcctccagccgcatcacgacctgctccaccgagggcgtgaacaccaagtgccggctgagcggcaccgccctcatccgcgccgggtccgtcggcgcggaggcctgcctgatgctgaagggggtgaaggaggaccagaccaagttcctcaagatcaagaccgtgagctccgagctgagctgccgggagggccagtcctactggacgggcagcttctccccgaagtgcctgagctcccgccggtgccacctggtcggggagtgccacgtgaaccgctgcctcagctggcgcgacaacgagacctccgccgagttcagcttcgtgggcgagtccaccaccatgcgggagaacaagtgcttcgagcagtgcgggggctgggggtgcggctgcttcaacgtcaaccccagctgcctgttcgtgcacacgtacctgcagagcgtgcgcaaggaggccctccgggtcttcaactgcatcgactgggtgcacaagctgaccctggagatcaccgacttcgacggctccgtgagcaccatcgacctcggggcgtccagctcccgcttcaccaactggggcagcgtctccctgagcctggacgccgaggggatctccggcagcaactccttcagcttcatcgagtcccccgggaagggctacgccatcgtggacgagcccttcagcgagatcccgcggcagggcttcctcggggagatccgctgcaactccgagagctccgtgctgagcgcccacgagtcctgcctgcgggcccccaacctcatcagctacaagcccatgatcgaccagctggagtgcacgaccaacctgatcgaccccttcgtcgtgttcgagcgcggcagcctcccgcagacccggaacgacaagaccttcgcggcctccaaggggaaccgcggcgtgcaggccttcagcaaggggtccgtccaggccgacctgacgctgatgttcgacaacttcgaggtggacttcgtgggcgccgcggtcagctgcgacgccgccttcctcaacctgaccggctgctactcctgcaacgccggggcccgggtgtgcctgagcatcacctccaccggcacggggaccctcagcgcgcacaacaaggacggctccctgcacgtggtcctgcccagcgagaacgggaccaaggaccagtgccagatcctccacttcaccgtgcccgaggtggaggaggagttcatgtactcctgcgacggcgacgagcgccccctgctggtcaagggcacgctcatcgccatcgacccgttcgacgaccggcgcgaggccgggggcgagagcaccgtggtgaaccccaagtccgggagctggaacttcttcgactggttctccggcctgatgagctggttcggcgggcccctgaagaccatcctcctgatctgcctgtacgtcgccctctccatcggcctgttcttcctgctcatctacctggggcggaccggcctgagcaagatgtggctcgcggccacgaagaaggcctcctga

SEQ ID NO: 12900 - RNA, 3204 nt, synthetic construct
  misc_feature 1..3204: note = derived and/or modified CDS sequence (opt1) from RVFV(200803162)__JF311377.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcgccaagtgcgagccccacggcctggtcgtgcgctccaccggcttcaagatcagctccgccgtcgcgtgcgccagcggggtgtgcgtgaccggctcccagagcccctccaccgagatcaccctcaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcgcacggcctgatcaactaccagtgccacacggccctcagcgccttcgtggtcatcttcgtgttctccagcaccgccatcatctgcctggccgtgctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcgggtggatggagggcgggcagctggccctgcgcaaccccgcgcccatcccgcggcacgcccccatcccccgctactccacctacctcatgctgctgctcatcgtcagctacgccagcgcctgctccgagctgatccaggccagctcccggatcacgacctgcagcaccgagggcgtgaacaccaagtgccgcctgtccgggacggcgctcatccgggccggcagcgtgggcgccgaggcctgcctgatgctgaagggggtcaaggaggaccagaccaagttcctcaagatcaagaccgtgtccagcgagctgtcctgccgcgagggccagagctactggaccgggtccttcagcccgaagtgcctgtccagccggcgctgccacctggtgggcgagtgccacgtcaaccgctgcctctcctggcgggacaacgagacgagcgcggagttctccttcgtgggcgagagcaccaccatgcgcgagaacaagtgcttcgagcagtgcgggggctgggggtgcggctgcttcaacgtgaaccccagctgcctgttcgtccacacctacctgcagtccgtgcggaaggaggccctccgcgtgttcaactgcatcgactgggtccacaagctgacgctggagatcaccgacttcgacgggagcgtgtccaccatcgacctcggcgccagctccagccggttcaccaactggggctccgtgagcctgtccctggacgccgaggggatcagcggctccaacagcttctccttcatcgagagccccgggaagggctacgccatcgtcgacgagcccttctccgagatcccgcgccaggggttcctcggcgagatccggtgcaacagcgagtccagcgtgctgtccgcgcacgagagctgcctgcgcgcccccaacctcgtgagctacaagcccatgatcgaccagctggagtgcaccacgaacctgatcgaccccttcgtcgtgttcgagcggggctccctcccgcagacccgcaacgacaagaccttcgccgccagcaaggggaaccggggcgtgcaggccttctccaaggggagcgtccaggcggacctgaccctgatgttcgacaacttcgaggtggacttcgtgggcgccgccgtctcctgcgacgccgccttcctcaacctgacggggtgctacagctgcaacgcgggcgcccgcgtgtgcctgtccatcaccagcaccggcaccgggacgctctccgcccacaacaaggacggcagcctgcacatcgtgctgccctccgagaacgggaccaaggaccagtgccagatcctccacttcaccgtccccgaggtggaggaggagttcatgtacagctgcgacggcgacgagcggcccctgctggtgaaggggaccctcatcgccatcgacccgttcgacgaccgccgggaggcgggcggcgagtccacggtcgtgaaccccaagagcgggtcctggaacttcttcgactggttcagcggcctgatgtcctggttcgggggccccctgaagaccatcctcctgatctgcctgtacgtggccctcagcatcggcctgttcttcctgctcatctacctggggcgcaccggcctgtccaagatgtggctcgccgccaccaagaaggccagctga

SEQ ID NO: 12901 - RNA, 3204 nt, synthetic construct
  misc_feature 1..3204: note = derived and/or modified CDS sequence (opt1) from RVFV(Hv-B375)__DQ380218.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagaacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcctgctccgagctgatccaggccagctcccgcatcacgacctgcagcaccgagggcgtgaacaccaagtgccggctgtccggcacggccctcatccgcgccgggagcgtcggcgcggaggcctgcctgatgctgaagggggtgaaggaggaccagaccaagttcctcaagatcaagaccgtgtccagcgagctgtcctgccgggagggccagagctactggaccggctccttcagcccgaagtgcctgtccagccgccggtgccacctggtcggggagtgccacgtgaaccgctgcctctcctggcgcgacaacgagacgagcgccgagttctccttcgtgggcgagagcaccaccatgcgggagaacaagtgcttcgagcagtgcgggggctgggggtgcggctgcttcaacgtcaaccccagctgcctgttcgtgcacacctacctgcagtccgtgcgcaaggaggccctccgggtcttcaactgcatcgactgggtgcacaagctgacgctggagatcaccgacttcgacggcagcgtgtccaccatcgacctcggggcgagctccagccgcttcaccaactggggctccgtcagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtcgtgttcgagcgcggctccctcccgcagacccggaacgacaagaccttcgcggccagcaaggggaaccgcggcgtgcaggccttctccaaggggagcgtccaggccgacctgaccctgatgttcgacaacttcgaggtggacttcgtgggcgccgcggtctcctgcgacgccgccttcctcaacctgacgggctgctacagctgcaacgccggggcccgggtgtgcctgtccatcaccagcaccggcaccgggacgctctccgcgcacaacaaggacggcagcctgcacatcgtgctgccctccgagaacgggaccaaggaccagtgccagatcctccacttcaccgtccccgaggtggaggaggagttcatgtacagctgcgacggcgacgagcgccccctgctggtgaagggcaccctcatcgccatcgacccgttcgacgaccggcgcgaggccgggggcgagtccacggtcgtgaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggaccggcctgtccaagatgtggctcgcggccaccaagaaggccagctga

SEQ ID NO: 12902 - RNA, 3204 nt, synthetic construct
  misc_feature 1..3204: note = derived and/or modified CDS sequence (opt1) from RVFV(1260/78)__DQ380214.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgcaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcctgctccgagctgatccaggccagctcccgcatcacgacctgcagcaccgagggcgtgaacaccaagtgccggctgtccggcacggccctcatccgcgccgggagcgtcggcgcggaggcctgcctgatgctgaagggggtgaaggacgaccagaccaagttcctcaagatcaagaccgtgtccagcgagctgtcctgccgggagggccagagctactggaccggctccttcagcccgaagtgcctgtccagccgccggtgccacctggtcggggagtgccacgtgaaccgctgcctctcctggcgcgacaacgagacgagcgccgagttctccttcgtgggcgagagcaccaccatgcgggagaacaagtgcttcgagcagtgcgggggctgggggtgcggctgcttcaacgtcaaccccagctgcctgttcgtgcacacctacctgcagtccgtgcgcaaggaggccctccgggtcttcaactgcatcgactgggtgcacaagctgacgctggagatcaccgacttcgacggcagcgtgtccaccatcgacctcggggcgagctccagccgcttcaccaactggggctccgtcagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtcgtgttcgagcgcggctccctcccgcagacccggaacgacaagaccttcgcggccagcaaggggaaccgcggcgtgcaggccttctccaaggggagcgtccaggccgacctgaccctgatgttcgacaacttcgaggtggacttcgtgggcgccgcggtctcctgcgacgccgccttcctcaacctgacgggctgctacagctgcaacgccggggcccgggtgtgcctgtccatcaccagcaccggcaccgggacgctctccgcgcacaacaaggacggcagcctgcacatcgtgctgccctccgagaacgggaccaaggaccagtgccagatcctccacttcaccgtccccgaggtggaggaggagttcatgtacagctgcgacggcgacgagcgccccctgctggtgaagggcaccctcatcgccatcgacccgttcgacgaccggcgcgaggccgggggcgagtccacggtcgtgaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggaccggcctgtccaagatgtggctcgcggccaccaagaaggccagctga

SEQ ID NO: 12903 - RNA, 3204 nt, synthetic construct
  misc_feature 1..3204: note = derived and/or modified CDS sequence (opt1) from RVFV(ZH-501-777)__DQ380202.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggaccccggccagaccaagcgcgagctgaagtccttcgacatcagccagtgccccaagatcgggggccacggctccaagaagtgcacgggggacgcggccttctgcagcgcctacgagtgcaccgcccagtacgccaacgcgtactgctcccacgccaacggcagcgggatcgtgcagatccaggtgagcggcgtctggaagaagccgctctgcgtggggtacgagcgggtggtcgtgaagcgcgagctgtccgccaagcccatccagcgggtggagccctgcacgacctgcatcaccaagtgcgagccccacggcctggtcgtgcgcagcaccggcttcaagatctccagcgccgtcgcctgcgcgtccggggtgtgcgtgaccggcagccagtccccgagcaccgagatcacgctcaagtaccccgggatctcccagagctccggcggggacatcggcgtccacatggcccacgacgaccagagcgtgtccagcaagatcgtggcccactgcccgccccaggacccctgcctggtccacggctgcatcgtgtgcgcccacgggctgatcaactaccagtgccacaccgcgctctccgccttcgtggtcgtgttcgtgttcagctccatcgccatcatctgcctggccgtcctgtaccgggtgctcaagtgcctgaagatcgcgccccgcaaggtgctgaaccccctcatgtggatcaccgccttcatccggtggatctacaagaagatggtcgcccgcgtggccgacaacatcaaccaggtgaaccgggagatcggctggatggagggcgggcagctggtcctggggaaccccgccccgatcccccgccacgcccccatcccgcggtacagcacctacctcatgctgctgctcatcgtgtcctacgcgagcgcctgcagcgagctgatccaggcctccagccgcatcacgacctgctccaccgagggcgtgaacaccaagtgccggctgagcggcacggccctcatccgcgccgggtccgtcggcgcggaggcctgcctgatgctgaagggggtgaaggaggaccagaccaagttcctcaagatcaagaccgtgagctccgagctgagctgccgggagggccagtcctactggaccggcagcttctcccccaagtgcctgagctcccgccggtgccacctggtcggggagtgccacgtgaaccgctgcctcagctggcgcgacaacgagacgtccgccgagttcagcttcgtgggcgagtccaccaccatgcgggagaacaagtgcttcgagcagtgcgggggctgggggtgcggctgcttcaacgtcaaccccagctgcctgttcgtgcacacctacctgcagagcgtgcgcaaggaggccctccgggtcttcaactgcatcgactgggtgcacaagctgacgctggagatcaccgacttcgacggctccgtgagcaccatcgacctcggggcgtccagctcccgcttcaccaactggggcagcgtctccctgagcctggacgccgaggggatctccggcagcaactccttcagcttcatcgagtcccccgggaagggctacgccatcgtggacgagccgttcagcgagatcccccggcagggcttcctcggggagatccgctgcaactccgagagctccgtgctgagcgcccacgagtcctgcctgcgggcccccaacctcatcagctacaagcccatgatcgaccagctggagtgcaccacgaacctgatcgacccgttcgtcgtgttcgagcgcggcagcctcccccagacccggaacgacaagaccttcgcggcctccaaggggaaccgcggcgtgcaggccttcagcaaggggtccgtccaggccgacctgaccctgatgttcgacaacttcgaggtggacttcgtgggcgccgcggtcagctgcgacgccgccttcctcaacctgacgggctgctactcctgcaacgccggggcccgggtgtgcctgagcatcacctccaccggcaccgggagcctctccgcgcacaacaaggacggcagcctgcacatcgtgctgccctccgagaacgggacgaaggaccagtgccagatcctccacttcaccgtccccgaggtggaggaggagttcatgtacagctgcgacggcgacgagcgcccgctgctggtgaagggcaccctcatcgccatcgaccccttcgacgaccggcgcgaggccgggggcgagtccaccgtcgtgaaccccaagagcgggtcctggaacttcttcgactggttcagcggcctgatgtcctggttcggcgggcccctgaagacgatcctcctgatctgcctgtacgtggccctcagcatcggcctgttcttcctgctcatctacctggggcggaccggcctgtccaagatgtggctcgcggccaccaagaaggccagctga

SEQ ID NO: 12904 - RNA, 3204 nt, synthetic construct
  misc_feature 1..3204: note = derived and/or modified CDS sequence (opt1) from RVFV(OS-3)__DQ380184.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcggggtggtgcagatccaggtctccggcgtgtggaagaagcccctgtgcgtggggtacgagcgggtcgtggtgaagcgcgagctgagcgccaagccgatccagcgggtcgagccctgcacgacctgcatcaccaagtgcgagccccacggcctggtggtccgctccaccggcttcaagatcagctccgccgtggcctgcgcgagcggggtgtgcgtcaccggctcccagagcccctccaccgagatcacgctcaagtacccggggatcagccagtccagcggcggggacatcggcgtgcacatggcccacgacgaccagtccgtgagctccaagatcgtcgcccactgcccgccccaggacccctgcctggtgcacggctgcatcgtgtgcgcccacgggctgatcaactaccagtgccacaccgcgctcagcgccttcgtcgtggtgttcgtcttctccagcgtggccatcatctgcctggccatcctgtacaaggtgctcaagtgcctgaagatcgcgccccggaaggtcctgaaccccctcatgtggatcaccgccttcatccgctgggtgtacaagaagatggtggcccgggtcgccgacaacatcaaccaggtgaaccgcgagatcggctggatggagggcgggcagctggccctggggaaccccgcccccatcccgcggcacgcgcccatcccccgctactccacctacctcatgctgctgctcatcgtgagctacgccagcgcctgctccgagctgatccaggccagctcccggatcacgacctgcagcaccgagggcgtcaacaccaagtgccgcctgtccggcacggccctcatccgggcggggagcgtgggcgccgaggcctgcctgatgctgaagggggtgaaggaggaccagaccaagttcctcaagatcaagaccgtctccagcgagctgtcctgccgcgagggccagagctactggaccggctccttcagcccgaagtgcctgtccagccggcgctgccacctggtgggggagtgccacgtgaaccggtgcctctcctggcgcgacaacgagacgagcgccgagttctccttcgtcggcgagagcaccaccatgcgcgagaacaagtgcttcgagcagtgcgggggctgggggtgcggctgcttcaacgtgaaccccagctgcctgttcgtgcacacctacctgcagtccgtccggaaggaggcgctccgcgtgttcaactgcatcgactgggtgcacaagctgacgctggagatcaccgacttcgacggcagcgtctccaccatcgacctcggggccagctccagccggttcaccaactggggctccgtgagcctgtccctggacgccgaggggatcagcggctccaacagcttctccttcatcgagagccccgggaagggctacgccatcgtggacgagcccttctccgagatcccgcgccagggcttcctcggggagatccggtgcaacagcgagtccagcgtcctgtccgcccacgagagctgcctgcgcgcgcccaacctcatcagctacaagcccatgatcgaccagctggagtgcaccacgaacctgatcgaccccttcgtggtgttcgagcggggctccctcccgcagacccgcaacgacaagaccttcgccgccagcaaggggaaccggggcgtccaggccttctccaaggggagcgtgcaggccgacctgaccctgatgttcgacaacttcgaggtggacttcgtcggcgcggccgtgtcctgcgacgccgccttcctcaacctgacgggctgctacagctgcaacgccggggcgcgcgtgtgcctgtccatcaccagcaccggcaccgggacgctctccgcccacaacaaggacggcagcctgcacatcgtcctgccctccgagaacgggaccaaggaccagtgccagatcctccacttcaccgtgcccgaggtggaggaggagttcatgtacagctgcgacggcgacgagcggcccctgctggtcaagggcaccctcatcgccatcgacccgttcgacgaccgccgggaggccgggggcgagtccacggtggtgaaccccaagagcgggtcctggaacttcttcgactggttcagcggcctgatgtcctggttcggcgggcccctgaagaccatcctcctgatctgcctgtacgtcgcgctcagcatcggcctgttcttcctgctcatctacctggggcgcaccggcctgtccaagatgtggctcgccgccaccaagaaggccagctga

SEQ ID NO: 12905 - RNA, 3204 nt, synthetic construct
  misc_feature 1..3204: note = derived and/or modified CDS sequence (opt1) from RVFV(SAUDI 200010901)__KU978778.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgttctgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcatcagctacgcgagcgcctgctccgagctgatccaggccagctcccgcatcacgacctgcagcaccgagggcgtgaacaccaagtgccggctgtccggcacggccctcatccgcgccgggagcgtgggcgcggaggcctgcctgatgctgaagggggtcaaggaggaccagaccaagttcctcaagatcaagaccgtgtccagcgagctgtcctgccgggagggccagagctactggaccggctccttcagcccgaagtgcctgtccagccgccggtgccacctggtgggggagtgccacgtcaaccgctgcctctcctggcgcgacaacgagacgagcgccgagttctccttcgtgggcgagagcaccaccatgcgggagaacaagtgcttcgagcagtgcgggggctgggggtgcggctgcttcaacgtgaaccccagctgcctgttcgtccacacctacctgcagtccgtgcgcaaggaggccctccgggtgttcaactgcatcgactgggtccacaagctgacgctggagatcaccgacttcgacggcagcgtgtccaccatcgacctcggggcgagctccagccgcttcaccaactggggctccgtgagcctgtccctggacgccgaggggatcagcggctccaacagcttctccttcatcgagagccccgggaagggctacgccatcgtcgacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtggtcttcgagcgcggctccctcccgcagacccggaacgagaagaccttcgcggccagcaaggggaaccgcggcgtgcaggccttctccaaggggagcgtgcaggccgacctgaccctgatgttcgacaacttcgaggtcgacttcgtgggcgccgcggtgtcctgcgacgccgccttcctcaacctgacgggctgctacagctgcaacgccggggcccgggtctgcctgtccatcaccagcaccggcaccgggacgctctccgcgcacaacaaggacggcagcctgcacatcgtgctgccctccgagaacgggaccaaggaccagtgccagatcctccacttcaccgtgcccgaggtcgaggaggagttcatgtacagctgcgacggcgacgagcgccccctgctggtgaagggcaccctcatcgccatcgacccgttcgacgaccggcgcgaggccgggggcgagtccacggtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggaccggcctgtccaagatgtggctcgcggccaccaagaaggccagctga

SEQ ID NO: 12906 - RNA, 3204 nt, synthetic construct
  misc_feature 1..3204: note = derived and/or modified CDS sequence (opt1) from RVFV(2007001811)__EU574040.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcctgctccgagctgatccaggccagctcccgcatcacgacctgcagcaccgagggcgtgaacaccaagtgccggctgtccggcacggccctcatccgcgccgggagcgtcggcgcggaggcctgcctgatgctgaagggggtgaaggaggaccagaccaagttcctcatgatcaagaccgtgtccagcgagctgtcctgccgggagggccagagctactggaccggctccttcagcccgaagtgcctgtccagccgccggtgccacctggtcggggagtgccacgtgaaccgctgcctctcctggcgcgacaacgagacgagcgccgagttctccttcgtgggcgagagcaccaccatgcgggagaacaagtgcttcgagcagtgcgggggctgggggtgcggctgcttcaacgtcaaccccagctgcctgttcgtgcacacctacctgcagtccgtgcgcaaggaggccctccgggtcttcaactgcatcgactgggtgcacaagctgacgctggagatcaccgacttcgacggcagcgtgtccaccatcgacctcggggcgagctccagccgcttcaccaactggggctccgtcagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtcgtgttcgagcgcggctccctcccgcagacccggaacgagaagaccttcgcggccagcaaggggaaccgcggcgtgcaggccttctccaaggggagcgtccaggccgacctgaccctgatgttcgacaacttcgaggtggacttcgtgggcgccgcggtctcctgcgacgccgccttcctcaacctgacgggctgctacagctgcaacgccggggcccgggtgtgcctgtccatcaccagcaccggcaccgggacgctctccgcgcacaacaaggacggcagcctgcacatcgtgctgccctccgagaacgggaccaaggaccagtgccagatcctccacttcaccgtccccgaggtggaggaggagttcatgtacagctgcgacggcgacgagcgccccctgctggtgaagggcaccctcatcgccatcgacccgttcgacgaccggcgcgaggccgggggcgagtccacggtcgtgaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggaccggcctgtccaagatgtggctcgcggccaccaagaaggccagctga

SEQ ID NO: 12907 - RNA, 3204 nt, synthetic construct
  misc_feature 1..3204: note = derived and/or modified CDS sequence (opt1) from RVFV(2007000253)__JF326192.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggccctggggaaccccgcccccatcccgcgccacgcgcccatcccccggtactccacgtacctcatgctgctgctcatcgtcagctacgccagcgcctgctccgagctgatccaggccagctcccgcatcacgacctgcagcaccgagggcgtgaacaccaagtgccggctgtccggcaccgccctcatccgcgcggggagcgccggcgccgaggcctgcctgatgctgaagggggtgaaggaggaccagaccaagttcctcaagatcaagaccgtctccagcgagctgtcctgccgggagggccagagctactggacgggctccttcagcccgaagtgcctgtccagccgccggtgccacctggtgggggagtgccacgtgaaccgctgcctctcctggcgcgacaacgagaccagcgcggagttctccttcgtcggcgagagcaccaccatgcgggagaacaagtgcttcgagcagtgcgggggctgggggtgcggctgcttcaacgtgaaccccagctgcctgttcgtgcacacgtacctgcagtccgtccgcaaggaggccctccgggtgttcaactgcatcgactgggtgcacaagctgaccctggagatcaccgacttcgacggcagcgtctccaccatcgacctcggggccagctccagccgcttcaccaactggggctccgtgagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtcctgtccgcgcacgagagctgcctgcgggcccccaacctcgtgagctacaagcccatgatcgaccagctggagtgcacgaccaacctgatcgaccccttcgtggtcttcgagcgcggctccctcccgcagacccggaacgacaagaccttcgccgccagcaaggggaaccgcggcgtgcaggccttctccaaggggagcgtgcaggcggacctgacgctgatgttcgacaacttcgaggtcgacttcgtgggcgccgccgtgtcctgcgacgccgccttcctcaacctgaccggctgctacagctgcaacgcgggggcccgggtctgcctgtccatcaccagcaccggcacggggaccctctccgcccacaacaaggacggcagcctgcacatcgtgctgccctccgagaacgggaccaaggaccagtgccagatcctccacttcaccgtgcccgaggtcgaggaggagttcatgtacagctgcgacggcgacgagcgccccctgctggtgaagggcacgctcatcgccatcgacccgttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcggaccggcctgtccaagatgtggctcgccgccacgaagaaggccagctga

SEQ ID NO: 12908 - RNA, 3204 nt, synthetic construct
  misc_feature 1..3204: note = derived and/or modified CDS sequence (opt1) from RVFV(2007001292)__EU574046.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggccctggggaaccccgcccccatcccgcgccacgcgcccatcccccggtactccacgtacctcatgctgctgctcatcgtcagctacgccagcgcctgctccgagctgatccaggccagctcccgcatcacgacctgcagcaccgagggcgtgaacaccaagtgccggctgtccggcaccgccctcatccgcgcggggagcgtgggcgccgaggcctgcctgatgctgaagggggtcaaggaggaccagaccaagttcctcaagatcaagaccgtgtccagcgagctgtcctgccgggagggccagagctactggacgggctccttcagcccgaagtgcctgtccagccgccggtgccacctggtgggggagtgccacgtcaaccgctgcctctcctggcgcgacaacgagaccagcgccgagttctccttcgtgggcgagagcaccaccatgcgggagaacaagtgcttcgagcagtgcgggggctgggggtgcggctgcttcaacgtgaaccccagctgcctgttcgtccacacgtacctgcagtccgtgcgcaaggaggcgctccgggtgttcaactgcatcgactgggtccacaagctgaccctggagatcaccgacttcgacggcagcgtgtccaccatcgacctcggggccagctccagccgcttcaccaactggggctccgtgagcctgtccctggacgccgaggggatcagcggctccaacagcttctccttcatcgagagccccgggaagggctacgccatcgtcgacgagcccttctccgagatcccgcggcagggcttcctcggggagatccgctgcaacagcgagtccagcgtgctgtccgcccacgagagctgcctgcgggcgcccaacctcgtgagctacaagcccatgatcgaccagctggagtgcacgaccaacctgatcgaccccttcgtcgtgttcgagcgcggctccctcccgcagacccggaacgacaagaccttcgccgccagcaaggggaaccgcggcgtgcaggccttctccaaggggagcgtccaggccgacctgacgctgatgttcgacaacttcgaggtggacttcgtgggcgcggccgtctcctgcgacgccgccttcctcaacctgaccggctgctacagctgcaacgccggggcgcgggtgtgcctgtccatcaccagcaccggcacggggaccctctccgcccacaacaaggacggcagcctgcacatcgtgctgccctccgagaacgggaccaaggaccagtgccagatcctccacttcaccgtccccgaggtggaggaggagttcatgtacagctgcgacggcgacgagcgccccctgctggtgaagggcacgctcatcgccatcgacccgttcgacgaccggcgcgaggccgggggcgagtccaccgtcgtgaaccccaagagcgggtcctggaacctgttcgactggttcagcggcctgatgtcctggttcggcgggcccctcaagaccatcctgctgatctgcctctacgtggcgctgagcatcggcctgttcttcctcctgatctacctggggcggaccggcctctccaagatgtggctggccgccacgaagaaggccagctga

SEQ ID NO: 12909 - RNA, 3204 nt, synthetic construct
  misc_feature 1..3204: note = derived and/or modified CDS sequence (opt1) from RVFV(2007002476)__EU574036.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccgggtcctcaagtgcctgaagatcgcgccccgcaaggtgctgaaccccctcatgtggatcaccgccttcatcaagtgggtgtacaagaagatggtcgcccgggtggccgacaacatcaaccaggtgaaccgcgagatcggctggatggagggcgggcagctggccctggggaaccccgcccccatcccgcggcacgcgcccatcccccgctactccacgtacctcatgctgctgctcatcgtcagctacgccagcgcctgctccgagctgatccaggccagctcccggatcacgacctgcagcaccgagggcgtgaacaccaagtgccgcctgtccggcaccgccctcatccgggcggggagcgtgggcgccgaggcctgcctgatgctgaagggggtcaaggaggaccagaccaagttcctcaagatcaagaccgtgtccagcgagctgtcctgccgcgagggccagagctactggacgggctccttcagcccgaagtgcctgtccagccggcgctgccacctggtgggggagtgccacgtcaaccggtgcctctcctggcgcgacaacgagaccagcgccgagttctccttcgtgggcgagagcaccaccatgcgcgagaacaagtgcttcgagcagtgcgggggctgggggtgcggctgcttcaacgtgaaccccagctgcctgttcgtccacacgtacctgcagtccgtgcggaaggaggcgctccgcgtgttcaactgcatcgactgggtccacaagctgaccctggagatcaccgacttcgacggcagcgtgtccaccatcgacctcggggccagctccagccggttcaccaactggggctccgtgagcctgtccctggacgccgaggggatcagcggctccaacagcttctccttcatcgagagccccgggaagggctacgccatcgtcgacgagcccttctccgagatcccgcgccagggcttcctcggggagatccggtgcaacagcgagtccagcgtgctgtccgcccacgagagctgcctgcgcgcgcccaacctcgtgagctacaagcccatgatcgaccagctggagtgcacgaccaacctgatcgaccccttcgtcgtgttcgagcggggctccctcccgcagacccgcaacgacaagaccttcgccgccagcaaggggaaccggggcgtgcaggccttctccaaggggagcgtccaggccgacctgacgctgatgttcgacaacttcgaggtggacttcgtgggcgcggccgtctcctgcgacgccgccttcctcaacctgaccggctgctacagctgcaacgccggggcgcgcgtgtgcctgtccatcaccagcaccggcacggggaccctctccgcccacaacaaggacggcagcctgcacatcgtgctgccctccgagaacgggaccaaggaccagtgccagatcctccacttcaccgtccccgaggtggaggaggagttcatgtacagctgcgacggcgacgagcggcccctgctggtgaagggcacgctcatcgccatcgacccgttcgacgaccgccgggaggccgggggcgagtccaccgtcgtgaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcgcaccggcctgtccaagatgtggctcgccgccacgaagaaggccagctga

SEQ ID NO: 12910 - RNA, 3204 nt, synthetic construct
  misc_feature 1..3204: note = derived and/or modified CDS sequence (opt1) from RVFV(73HB1230)__DQ380221.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagaaggagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgcgtggtcgtgaagcgggagctgagcgccaagccgatccagcgcgtggagccctgcacgacctgcatcaccaagtgcgagccccacggcctggtcgtgcggtccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgcgtcctcaagtgcctgaagatcgcgccccggaaggtgctgaaccccctcatgtggatcaccgccttcatccgctgggtgtacaagaagatggtcgcccgggtggccgacaacatcaaccaggtgaaccgcgagatcggctggatggagggcgggcagctggtcctggggaaccccgcccccatcccgcggcacgcccccatcccccgctactccacctacctcatgctgctgctcatcgtgagctacgcgagcgcctgctccgagctgatccaggccagctcccggatcacgacctgcagcaccgagggcgtgaacaccaagtgccgcctgtccggcacggccctcatccgggccgggagcgtcggcgcggaggcctgcctgatgctgaagggggtgaaggaggaccagaccaagttcctcaagatcaagaccgtgtccagcgagctgtcctgccgcgagggccagagctactggaccggctccttcagcccgaagtgcctgtccagccggcgctgccacctggtcggggagtgccacgtgaaccggtgcctctcctggcgcgacaacgagacgagcgccgagttctccttcgtgggcgagagcaccatcatgcgcgagaacaagtgcttcgagcagtgcgggggctgggggtgcggctgcttcaacgtcaaccccagctgcctgttcgtgcacacctacctgcagtccgtgcggaaggaggccctccgcgtcttcaactgcatcgactgggtgcacaagctgaccctggagatcacggacttcgacggcagcgtgtccaccatcgacctcggggcgagctccagccggttcaccaactggggctccgtcagcctgtccctggacgccgaggggatcagcggctccaacagcttctccttcatcgagagccccgggaagggctacgccatcgtggacgagcccttctccgagatcccgcgccagggcttcctcggggagatccggtgcaacagcgagtccagcgtgctgtccgcccacgagagctgcctgcgcgcccccaacctcatcagctacaagcccatgatcgaccagctggagtgcaccaccaacctgatcgaccccttcgtcgtgttcgagcggggctccctcccgcagacgcgcaacgacaagaccttcgcggccagcaaggggaaccggggcgtgcaggccttctccaaggggagcgtccaggccgacctgaccctgatgttcgacaacttcgaggtggacttcgtgggcgccgcggtctcctgcgacgccgccttcctcaacctgaccggctgctacagctgcaacgccggggcccgcgtgtgcctgtccatcacgagcaccggcaccgggaccctctccgcgcacaacaaggacggcagcctgcacatcgtgctgccctccgagaacgggacgaaggaccagtgccagatcctccacttcaccgtccccgaggtggaggaggagttcatgtacagctgcgacggcgacgagcggcccctgctggtgaagggcaccctcatcgccatcgacccgttcgacgaccgccgggaggccgggggcgagtccaccgtcgtgaaccccaagagcgggtcctggaacttcttcgactggttcagcggcctgatgtcctggttcggcgggcccctgaagacgatcctcctgatctgcctgtacgtggccctcagcatcggcctgttcttcctgctcatctacctggggcgcaccggcctgtccaagatgtggctcgcggccaccaagaaggccagctga

SEQ ID NO: 12911 - RNA, 3204 nt, synthetic construct
  misc_feature 1..3204: note = derived and/or modified CDS sequence (opt1) from RVFV(ZINGA J83 R1)__KU978776.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggctcatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctcatcaactaccagtgccacaccgcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtgggtgtaccgcaagatggtcgcccgggtggccgacaacatcaaccaggtgaaccgcgagatcggctggatggagggcgggcagctggtcctcgggaaccccgcccccatcccgcggcacgtgcccatcccccgctactccacctacctgatgctgctcctgatcgtgagctacgccagcgcgtgctccgagctgatccaggccagctcccggatcacgacctgcagcaccgagggcgtcaacaccaagtgccgcctctccggcacggccctgatccgggccgggagcgtgggcgccgaggcgtgcctgatgctcaagggggtgaaggaggaccagaccaagttcctgaagatcaagaccgtctccagcgagctgtcctgccgcgagggccagagctactggaccggctccttcagcccgaagtgcctgtccagccggcgctgccacctcgtgggggagtgccacgtgaaccgctgcctgtcctggcgggacaacgagacgagcgccgagttctccttcgtcggcgagagcaccaccatgcgcgagaacaagtgcttcgagcagtgcgggggctgggggtgcggctgcttcaacgtgaaccccagctgcctgttcgtgcacacctacctccagtccgtccggaaggaggccctgcgcgtgttcaactgcatcgactgggtgcacaagctgacgctcgagatcaccgacttcgacggcagcgtctccaccatcgacctgggggccagctccagccggttcaccaactggggctccgtgagcctgtccctcgacgcggaggggatcagcggctccaacagcttctccttcatcgagagccccgggaagggctacgccatcgtggacgagcccttctccgagatcccgcgccagggcttcctgggggagatccggtgcaacagcgagtccagcgtcctgtccgcccacgagagctgcctccgcgcccccaacctgatcagctacaagcccatgatcgaccagctggagtgcaccacgaacctcatcgaccccttcgtggtgttcgagcggggctccctgccgcagacccgcaacgacaagaccttcgccgcgagcaaggggaaccggggcgtccaggccttctccaaggggagcgtgcaggccgacctgaccctcatgttcgacaacttcgaggtggacttcgtcggcgccgccgtgtcctgcgacgcggccttcctgaacctgacgggctgctacagctgcaacgccggggcccgcgtgtgcctctccatcaccagcaccggcaccgggacgctgtccgcccacaacaaggacggcagcctgcacatcgtcctcccctccgagaacgggaccaaggaccagtgccagatcctgcacttcaccgtgcccgaggtggaggaggagttcatgtacagctgcgacggcgacgagcggcccctgctcgtccgcggcaccctgatcgcgatcgacccgttcgacgaccggcgcgaggccgggggcgagtccacggtggtgaaccccaagagcgggtcctggaacttcttcgactggttcagcggcctgatgtcctggttcggcgggcccctcaagaccatcctgctgatctgcctctacgtcgccctgagcatcggcctgttcttcctcctgatctacctggggcggaccggcctctccaagatgtggctggccgcgaccaagaaggccagctga

SEQ ID NO: 12912 - RNA, 3204 nt, synthetic construct
  misc_feature 1..3204: note = derived and/or modified CDS sequence (opt1) from RVFV(2008/00101)__HE687306.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggccctggggaaccccgcccccatcccgcgccacgcgcccatcccccggtactccacgtacctcatgctgctgctcatcgtcagctacgccagcgcctgctccgagctgatccaggccagctcccgcatcacgacctgcagcaccgagggcgtgaacaccaagtgccggctgtccggcaccgccctcatccgcgcggggagcgtgggcgccgaggcctgcctgatgctgaagggggtcaaggaggaccagaccaagttcctcaagatcaagaccgtgtccagcgagctgtcctgccgggagggccagagctactggacgggctccttcagcccgaagtgcctgtccagccgccggtgccacctggtgggggagtgccacgtcaaccgctgcctctcctggcgcgacaacgagaccagcgccgagttctccttcgtgggcgagagcaccaccatgcgggagaacaagtgcttcgagcagtgcgggggctgggggtgcggctgcttcaacgtgaaccccagctgcctgttcgtccacacgtacctgcagtccgtgcgcaaggaggcgctccgggtgttcaactgcatcgactgggtccacaagctgaccctggagatcaccgacttcgacggcagcgtgtccaccatcgacctcggggccagctccagccgcttcaccaactggggctccgtgagcctgtccctggacgccgaggggatcagcggctccaacagcttctccttcatcgagagccccgggaagggctacgccatcgtcgacgagcccttctccgagatcccgcggcagggcttcctcggggagatccgctgcaacagcgagtccagcgtgctgtccgcccacgagagctgcctgcgggcgcccaacctcgtgagctacaagcccatgatcgaccagctggagtgcacgaccaacctgatcgaccccttcgtcgtgttcgagcgcggctccctcccgcagacccggaacgacaagaccttcgccgccagcaaggggaaccgcggcgtgcaggccttctccaaggggagcgtccaggccgacctgacgctgatgttcgacaacttcgaggtggacttcgtgggcgcggccgtctcctgcgacgccgccttcctcaacctgaccggctgctacagctgcaacgccggggcgcgggtgtgcctgtccatcaccagcaccggcacggggaccctctccgcccacaacaaggacggcagcctgcacatcgtgctgccctccgagaacgggaccaaggaccagtgccagatcctccacttcaccgtccccgaggtggaggaggagttcatgtacagctgcgacggcgacgagcgccccctgctggtgaagggcacgctcatcgccatcgacccgttcgacgaccggcgcgaggccgggggcgagtccaccgtcgtgaaccccaagagcgggtcctggaacttcttcgactggttcagcggcctgatgtcctggttcggcgggcccctgaagaccaccctcctgatctgcctgtacgtggcgctcagcatcggcctgttcttcctgctcatctacctggggcggacgggcctgtccaagatgtggctcgccgccaccaagaaggccagctga

SEQ ID NO: 12913 - RNA, 3204 nt, synthetic construct
  misc_feature 1..3204: note = derived and/or modified CDS sequence (opt1) from RVFV(2007002445)__EU574037.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggccctggggaaccccgcccccatcccgcgccacgcgcccatcccccggtactccacgtacctcatgctgctgctcatcgtcagctacgccagcgcctgctccgagctgatccaggccagctcccgcatcacgacctgcagcaccgagggcgtgaacaccaagtgccggctgtccggcaccgccctcatccgcgcggggagcgtgggcgccgaggcctgcctgatgctgaagggggtcaaggaggaccagaccaagttcctcaagatcaagaccgtgtccagcgagctgtcctgccgggagggccagagctactggacgggctccttcagcccgaagtgcctgtccagccgccggtgccacctggtgggggagtgccacgtcaaccgctgcctctcctggcgcgacaacgagaccagcgccgagttctccttcgtgggcgagagcaccaccatgcgggagaacaagtgcttcgagcagtgcgggggctgggggtgcggctgcttcaacgtgaaccccagctgcctgttcgtccacacgtacctgcagtccgtgcgcaaggaggcgctccgggtgttcaactgcatcgactgggtccacaagctgaccctggagatcaccgacttcgacggcagcgtgtccaccatcgacctcggggccagctccagccgcttcaccaactggggctccgtgagcctgtccctggacgccgaggggatcagcggctccaacagcttctccttcatcgagagccccgggaagggctacgccatcgtcgacgagcccttctccgagatcccgcggcagggcttcctcggggagatccgctgcaacagcgagtccagcgtgctgtccgcccacgagagctgcctgcgggcgcccaacctcgtgagctacaagcccatgatcgaccagctggagtgcacgaccaacctgatcgaccccttcgtcgtgttcgagcgcggctccctcccgcagacccggaacgagaagaccttcgccgccagcaaggggaaccgcggcgtgcaggccttctccaaggggagcatccaggccgacctgacgctgatgttcgacaacttcgaggtcgacttcgtgggcgcggccgtgtcctgcgacgccgccttcctcaacctgaccggctgctacagctgcaacgccggggcgcgggtctgcctgtccatcaccagcaccggcacggggaccctctccgcccacaacaaggacggcagcctgcacatcgtgctgccctccgagaacgggaccaaggaccagtgccagatcctccacttcaccgtgcccgaggtcgaggaggagttcatgtacagctgcgacggcgacgagcgccccctgctggtgaagggcacgctcatcgccatcgacccgttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcggaccggcctgtccaagatgtggctcgccgccacgaagaaggccagctga

SEQ ID NO: 12914 - RNA, 3204 nt, synthetic construct
  misc_feature 1..3204: note = derived and/or modified CDS sequence (opt1) from RVFV(ZC-3349)__DQ380207.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccaggccgtgtccagcaagatcgtggcccactgcccgccccaggacccctgcctggtccacggctgcatcgtgtgcgcgcacgggctgatcaactaccagtgccacaccgccctctccgccttcgtggtcgtgttcgtgttcagctccatcgccatcatctgcctggccatcctgtaccgggtcctcaagtgcctgaagatcgcgccccgcaaggtgctgaaccccctcatgtggatcaccgccttcatccggtggatctacaagaagatggtggcccgcgtcgccgacaacatcaaccacgtgaaccgggagatcggctggatggagggcgggcagctggtgctggggaaccccgcccccatcccgcgccacgcgcccatcccccggtacagcacctacctcatgctgctgctcatcgtctcctacgccagcgcctgcagcgagctgatccaggcctccagccgcatcacgacctgctccaccgagggcgtgaacaccaagtgccggctgagcggcacggccctcatccgcgcggggtccgtgggcgccgaggcctgcctgatgctgaagggggtcaaggaggaccagaccaagttcctcaagatcaagaccgtgagctccgagctgagctgccgggagggccagtcctactggaccggcagcttctccccgaagtgcctgagctcccgccggtgccacctggtgggggagtgccacgtcaaccgctgcctcagctggcgcgacaacgagacgtccgccgagttcagcttcgtgggcgagtccaccaccatgcgggagaacaagtgcttcgagcagtgcgggggctgggggtgcggctgcttcaacgtgaaccccagctgcctgttcgtccacacctacctgcagagcgtgcgcaaggaggcgctccgggtgttcaactgcatcgactgggtccacaagctgacgctggagatcaccgacttcgacggctccgtgagcaccatcgacctcggggcctccagctcccgcttcaccaactggggcagcgtgtccctgagcctggacgccgaggggatctccggcagcaactccttcagcttcatcgagtcccccgggaagggctacgccatcgtcgacgagcccttcagcgagatcccgcggcagggcttcctcggggagatccgctgcaactccgagagctccgtgctgagcgcccacgagtcctgcctgaaggcgcccaacctcatcagctacaagcccatgatcgaccagctggagtgcaccacgaacctgatcgaccccttcgtggtcttcgagcggggcagcctcccgcagacccgcaacgacaagaccttcgccgcctccaaggggaaccggggcgtgcaggccttcagcaaggggtccgtgcaggccgacctgaccctgatgttcgacaacttcgaggtcgacttcgtgggcgcggccgtgagctgcgacgccgccttcctcaacctgacgggctgctactcctgcaacgccggggcgcgcgtctgcctgagcatcacctccaccggcaccgggagcctctccgcccacaacaaggacggcagcctgcacatcgtgctgccctccgagaacgggacgaaggaccagtgccagatcctccacttcaccgtgcccgaggtcgaggaggagttcatgtacagctgcgacggcgacgagcggcccctgctggtgaagggcaccctcatcgccatcgacccgttcgacgaccgccgggaggccgggggcgagtccaccgtggtcaaccccaagagcgggtcctggaacttcttcgactggttcagcggcctgatgtcctggttcggcgggcccctgaagacgatcctcctgatctgcctgtacgtggcgctcagcatcggcctgttcttcctgctcatctacctggggcgcaccggcctgtccaagatgtggctcgccgccaccaagaaggccagctga

SEQ ID NO: 12915 - RNA, 3204 nt, synthetic construct
  misc_feature 1..3204: note = derived and/or modified CDS sequence (opt1) from RVFV(Kenya 9800523)__DQ380196.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgttctgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcctgctccgagctgatccaggccagctcccgcatcacgacctgcagcaccgagggcgtgaacaccaagtgccggctgtccggcacggccctcatccgcgccgggagcgtcggcgcggaggcctgcctgatgctgaagggggtgaaggaggaccagaccaagttcctcaagatcaagaccgtgtccagcgagctgtcctgccgggagggccagagctactggaccggctccttcagcccgaagtgcctgtccagccgccggtgccacctggtcggggagtgccacgtgaaccgctgcctctcctggcgcgacaacgagacgagcgccgagttctccttcgtgggcgagagcaccaccatgcgggagaacaagtgcttcgagcagtgcgggggctgggggtgcggctgcttcaacgtcaaccccagctgcctgttcgtgcacacctacctgcagtccgtgcgcaaggaggccctccgggtcttcaactgcatcgactgggtgcacaagctgacgctggagatcaccgacttcgacggcagcgtgtccaccatcgacctcggggcgagctccagccgcttcaccaactggggctccgtcagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtgctgaacgcccacgagtcctgcctgcgggcccccaacctcatcagctacaagcccatgatcgaccagctggagtgcaccacgaacctgatcgaccccttcgtcgtgttcgagcgcggcagcctcccgcagacccggaacgacaagaccttcgcggcctccaaggggaaccgcggcgtgcaggccttcagcaaggggtccgtccaggccgacctgaccctgatgttcgacaacttcgaggtggacttcgtgggcgccgcggtcagctgcgacgccgccttcctcaacctgacgggctgctactcctgcaacgccggggcccgggtgtgcctgagcatcacctccaccggcaccgggacgctcagcgcgcacaacaaggagggctccctgcacatcgtgctgcccagcgagaacgggaccaaggaccagtgccagatcctccacttcaccgtccccgaggtggaggaggagttcatgtactcctgcgacggcgacgagcgccccctgctggtgaagggcaccctcatcgccatcgacccgttcgacgaccggcgcgaggccgggggcgagagcacggtcgtgaaccccaagtccgggagctggaacttcttcgactggttctccggcctgatgagctggttcggcgggcccctgaagaccatcctcctgatctgcctgtacgtggccctctccatcggcctgttcttcctgctcatctacctggggcggaccggcctgagcaagatgtggctcgcggccaccaagaaggcctcctga

SEQ ID NO: 12916 - RNA, 3204 nt, synthetic construct
  misc_feature 1..3204: note = derived and/or modified CDS sequence (opt1) from RVFV(Entebbe)__DQ380191.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagatcaagcgcgagctcaagagcttcgacatctcccagtgccccaagatcgggggccacggcagcaagaagtgcaccggggacgcggccttctgctccgcctacgagtgcacggcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcaccctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacacggcgctcagcgccttcgtggtcgtgttcgtgttctccagcgtcgccatcatctgcctggccatcctgtacaaggtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggtgctggggaaccccgcccccatcccgcggcacgcccccatcccccgctactccacctacctcatgctgctgctcatcgtgagctacgcgagcgcctgctccgagctgatccaggccagctcccggatcaccacgtgcagcaccgagggcgtcaacaccaagtgccgcctgtccggcaccgccctcatccgggccgggagcgtgggcgcggaggcctgcctgatgctgaagggggtgaaggaggaccagacgaagttcctcaagatcaagaccgtctccagcgagctgtcctgccgcgagggccagagctactggaccggctccttcagcccgaagtgcctgtccagccggcgctgccacctggtgggggagtgccacgtgaaccggtgcctctcctggcgcgacaacgagaccagcgccgagttctccttcgtcggcgagagcacgaccatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcacggacttcgacggcagcgtctccaccgtggacctcggggcgagctccagccggttcaccaactggggctccgtgagcctgtccctggacgccgaggggatcagcggctccaacagcttctccttcatcgagagccccgggaagggctacgccatcgtcgacgagcccttctccgagatcccgcgccagggcttcctcggggagatccggtgcaacagcgagtccagcgtgctgtccgcccacgagagctgcctgcgcgcccccaacctcatcagctacaagcccatgatcgaccagctggagtgcaccaccaacctgatcgaccccttcgtggtcttcgagcggggctccctcccgcagacgcgcaacgacaagaccttcgcggccagcaaggggaaccggggcgtgcaggccttctccaaggggagcgtgcaggccgacctgaccctgatgttcgacaacttcgaggtcgacttcgtgggcgccgcggtgtcctgcgacgccgccttcctcaacctgaccggctgctacagctgcaacgccggggcccgcgtctgcctgtccatcacgagcaccggcaccgggaccctctccgcgcacaacaaggacggcagcctgcacatcgtgctgccctccgagaacgggacgaaggaccagtgccagatcctccacttcaccgtgcccgaggtcgaggaggagttcatgtacagctgcgacggcgacgagcggcccctgctggtgaagggcaccctcatcgccatcgacccgttcgacgaccgccgggaggccgggggcgagtccaccgtggtcaaccccaagagcgggtcctggaacttcttcgactggttcagcggcctgatgtcctggttcggcgggcccctgaagacgatcctcctgatctgcctgtacgtggccctcagcatcggcctgttcttcctgctcatctacctggggcgcaccggcctgtccaagatgtggctcgcggccaccaagaaggccagctga

SEQ ID NO: 12917 - RNA, 3204 nt, synthetic construct
  misc_feature 1..3204: note = derived and/or modified CDS sequence (opt1) from RVFV(25010-24)__KM210509.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctgatcgtccgctccaccggcttcaagatcagctccgccgtggcctgcgcgagcggggtctgcgtgaccggctcccagagcccctccaccgagatcacgctcaagtacccggggatcagccagtccagcggcggggacatcggcgtgcacatggcccacgacgaccagtccgtcagctccaagatcgtggcccactgcccgccccaggacccctgcctggtgcacggctgcatcgtctgcgcccacgggctgatcaactaccagtgccacaccgcgctcagcgccttcgtggtggtcttcgtgttctccagcgtggccatcatctgcctggccatcctgtacaaggtcctcaagtgcctgaagatcgcccccaagaaggtgctgaaccccctcatgtggatcaccgcgttcatccggtgggtgtacaagaagatggtcgcccgcgtggccgacaacatcaaccaggtgaaccgggagatcggctggatggagggcgggcagctggccctggggaaccccgcccccatcccgcgccacgcgcccatcccccggtactccacctacctcatgctgctgctcatcgtcagctacgccagcgcctgctccgagctgatccaggccagctcccgcatcacgacctgcagcaccgagggcgtgaacaccaagtgccggctgtccggcacggccctcatccgcgcggggagcgtgggcgccgaggcctgcctgatgctgaagggggtcaaggacgaccagaccaagttcctcaagatcaagaccgtgtccagcgagctgtcctgccgggagggccagagctactggaccggctccttcagcccgaagtgcctgtccagccgccggtgccacctggtgggggagtgccacgtcaaccgctgcctctcctggcgggacaacgagacgagcgccgagttctccttcgtgggcgagagcaccaccatgcgcgagaacaagtgcttcgagcagtgcgggggctgggggtgcggctgcttcaacgtgaaccccagctgcctgttcgtccacacctacctgcagtccgtgcgcaaggaggcgctccgggtgttcaactgcatcgactgggtccacaagctgacgctggagatcaccgacttcgacggcagcgtgtccaccatcgacctcggggccagctccagccgcttcaccaactggggctccgtgagcctgtccctggacgccgaggggatcagcggctccaacagcttctccttcatcgagagccccgggaagggctacgccatcgtcgacgagcccttctccgagatcccgcggcagggcttcctcggggagatccgctgcaacagcgagtccagcgtgctgtccgcccacgagagctgcctgcgggcgcccaacctcatcagctacaagcccatgatcgaccagctggagtgcaccacgaacctgatcgaccccttcgtggtcttcgagcgcggctccctcccgcagacccggaacgacaagaccttcgccgccagcaaggggaaccgcggcgtgcaggccttctccaaggggagcgtgcaggccgacctgaccctgatgttcgacaacttcgaggtcgacttcgtgggcgcggccgtgtcctgcgacgccgccttcctcaacctgacgggctgctacagctgcaacgccggggcgcgggtctgcctgtccatcaccagcaccggcaccgggacgctctccgcccacaacaaggacggcagcctgcacatcgtgctgccctccgagaacgggaccaaggaccagtgccagatcctccacttcaccgtgcccgaggtcgaggaggagttcatgtacagctgcgacggcgacgagcgccccctgctggtgaagggcaccctcatcgccatcgacccgttcgacgaccggcgcgaggccgggggcgagtccacggtggtcaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcggaccggcctgtccaagatgtggctcgccgccaccaagaaggccagctga

SEQ ID NO: 12918 - RNA, 3204 nt, synthetic construct
  misc_feature 1..3204: note = derived and/or modified CDS sequence (opt1) from RVFV(763/70)__DQ380188.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgggctgaccgaggactgcaacttctgccggcagatgaccggcgcctccctcaagaaggggagctaccccctgcaggacctgttctgccagtccagcgaggacgacggctccaagctcaagaccaagatgaagggggtgtgcgaggtcggcgtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaaggggcagtacaagggcaccatggactccgggcagaccaagcgcgagctcaagagcttcgacatctcccagtgccccaagatcggcggccacgggagcaagaagtgcacgggcgacgcggccttctgctccgcctacgagtgcaccgcccagtacgccaacgcgtactgcagccacgccaacgggagcggcatcgtgcagatccaggtgtccggggtctggaagaagcccctgtgcgtgggctacgagcgggtggtcgtgaagcgcgagctgagcgccaagccgatccagcgggtggagccctgcacgacctgcatcaccaagtgcgagccccacggcctggtcgtgcgctccaccgggttcaagatcagctccgccgtcgcctgcgcgagcggcgtgtgcgtgaccgggtcccagagcccctccaccgagatcacgctcaagtacccgggcatcagccagtccagcgggggcgacatcggcgtccacatggcccacgacgaccagtccgtgagctccaagatcgtggcccactgcccgccccaggacccctgcctggtccacgggtgcatcgtgtgcgcccacggcctgatcaactaccagtgccacaccgcgctcagcgccttcgtggtcgtgttcgtgttctccagcgtcgccatcatctgcctggccatcctgtacaaggtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcgggtggatggagggcgggcagctggccctgggcaaccccgcccccatcccgcggcacgcgcccatcccccgctactccacctacctcatgctgctgctcatcgtgagctacgccagcgcctgctccgagctgatccaggccagctcccggatcacgacctgcagcaccgagggcgtgaacaccaagtgccgcctgtccgggacggccctcatccgggcgggcagcgtcggggccgaggcctgcctgatgctgaagggcgtgaaggaggaccagaccaagttcctcaagatcaagaccgtgtccagcgagctgtcctgccgcgagggccagagctactggaccgggtccttcagcccgaagtgcctgtccagccggcgctgccacctggtcggcgagtgccacgtgaaccggtgcctctcctggcgcgacaacgagacgagcgccgagttctccttcgtgggggagagcaccaccatgcgcgagaacaagtgcttcgagcagtgcggcgggtggggctgcggctgcttcaacgtcaaccccagctgcctgttcgtgcacacctacctgcagtccgtgcggaaggaggcgctccgcgtcttcaactgcatcgactgggtgcacaagctgacgctggagatcaccgacttcgacgggagcgtgtccaccatcgacctcggcgccagctccagccggttcaccaactgggggtccgtcagcctgtccctggacgccgagggcatcagcgggtccaacagcttctccttcatcgagagccccggcaagggctacgccatcgtggacgagcccttctccgagatcccgcgccaggggttcctcggcgagatccggtgcaacagcgagtccagcgtgctgtccgcccacgagagctgcctgcgcgcgcccaacctcatcagctacaagcccatgatcgaccagctggagtgcaccacgaacctgatcgaccccttcgtcgtgttcgagcgggggtccctcccgcagacccgcaacgacaagaccttcgccgccagcaagggcaaccgcggggtgcaggccttctccaagggcagcgtccaggccgacctgaccctgatgttcgacaacttcgaggtggacttcgtgggcgcggccgtctcctgcgacgccgccttcctcaacctgacggggtgctacagctgcaacgccggcgcgcgggtgtgcctgtccatcaccagcaccgggaccggcacgctctccgcccacaacaaggacgggagcctgcacatcgtgctgccctccgagaacggcaccaaggaccagtgccagatcctccacttcaccgtccccgaggtggaggaggagttcatgtacagctgcgacggcgacgagcggcccctgctggtgaaggggaccctcatcgccatcgacccgttcgacgaccgccgggaggccggcggggagtccacggtcgtgaaccccaagagcggctcctggaacttcttcgactggttcagcggcctgatgtcctggttcgggggccccctgaagaccatcctcctgatctgcctgtacgtggcgctcagcatcgggctgttcttcctgctcatctacctgggccgcaccgggctgtccaagatgtggctcgccgccaccaagaaggccagctga

SEQ ID NO: 12919 - RNA, 3204 nt, synthetic construct
  misc_feature 1..3204: note = derived and/or modified CDS sequence (opt1) from RVFV(OS-1)__DQ380186.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcggggtggtgcagatccaggtctccggcgtgtggaagaagcccctgtgcgtggggtacgagcgggtcgtggtgaagcgcgagctgagcgccaagccgatccagcgggtcgagccctgcacgacctgcatcaccaagtgcgagccccacggcctggtggtccgctccaccggcttcaagatcagctccgccgtggcctgcgcgagcggggtgtgcgtcaccggctcccagagcccctccaccgagatcacgctcaagtacccggggatcagccagtccagcggcggggacatcggcgtgcacatggcccacgacgaccagtccgtgagctccaagatcgtcgcccactgcccgccccaggacccctgcctggtgcacggctgcatcgtgtgcgcccacgggctgatcaactaccagtgccacaccgcgctcagcgccttcgtcgtggtgttcgtcttctccagcgtggccatcatctgcctggccatcctgtacaaggtgctcaagtgcctgaagatcgcgccccggaaggtcctgaaccccctcatgtggatcaccgccttcatccgctgggtgtacaagaagatggtggcccgggtcgccgacaacatcaaccaggtgaaccgcgagatcggctggatggagggcgggcagctggccctggggaaccccgcccccatcccgcggcacgcgcccatcccccgctactccacctacctcatgctgctgctcatcgtgagctacgccagcgcctgctccgagctgatccaggccagctcccggatcacgacctgcagcaccgagggcgtcaacaccaagtgccgcctgtccggcacggccctcatccgggcggggagcgtgggcgccgaggcctgcctgatgctgaagggggtgaaggaggaccagaccaagttcctcaagatcaagaccgtctccagcgagctgtcctgccgcgagggccagagctactggaccggctccttcagcccgaagtgcctgtccagccggcgctgccacctggtgggggagtgccacgtgaaccggtgcctctcctggcgcgacaacgagacgagcgccgagttctccttcgtcggcgagagcaccaccatgcgcgagaacaagtgcttcgagcagtgcgggggctgggggtgcggctgcttcaacgtgaaccccagctgcctgttcgtgcacacctacctgcagtccgtccggaaggaggcgctcaaggtgttcaactgcatcgactgggtgcacaagctgacgctggagatcaccgacttcgacggcagcgtctccaccatcgacctcggggccagctccagccgcttcaccaactggggctccgtgagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtcctgtccgcccacgagagctgcctgcgggcgcccaacctcatcagctacaagcccatgatcgaccagctggagtgcaccacgaacctgatcgaccccttcgtggtgttcgagcgcggctccctcccgcagacccggaacgacaagaccttcgccgccagcaaggggaaccgcggcgtccaggccttctccaaggggagcgtgcaggccgacctgaccctgatgttcgacaacttcgaggtggacttcgtcggcgcggccgtgtcctgcgacgccgccttcctcaacctgacgggctgctacagctgcaacgccggggcgcgggtgtgcctgtccatcaccagcaccggcaccgggacgctctccgcccacaacaaggacggcagcctgcacatcgtcctgccctccgagaacgggaccaaggaccagtgccagatcctccacttcaccgtgcccgaggtggaggaggagttcatgtacagctgcgacggcgacgagcgccccctgctggtcaagggcaccctcatcgccatcgacccgttcgacgaccggcgcgaggccgggggcgagtccacggtggtgaaccccaagagcgggtcctggaacttcttcgactggttcagcggcctgatgtcctggttcggcgggcccctgaagaccatcctcctgatctgcctgtacgtcgcgctcagcatcggcctgttcttcctgctcatctacctggggcggaccggcctgtccaagatgtggctcgccgccaccaagaaggccagctga

SEQ ID NO: 12920 - RNA, 3204 nt, synthetic construct
  misc_feature 1..3204: note = derived and/or modified CDS sequence (opt1) from RVFV(BIME-01)__KX609032.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcgtcgccatcatctgcctggccatcctgtacaaggtgctccggtgcctgaagatcgcccccaagaaggtgctgaaccccctcatgtggatcaccgcgttcatccgctgggtctacaagaagatggtggcccgggtggccgacaacatcaaccaggtcaaccgcgagatcggctggatggagggcgggcagctggccctggggaaccccgcccccatcccgcggcacgcgcccatcccccgctactccacctacctcatgctgctgctcatcatcagctacgccagcgcctgctccgagctgatccaggccagctcccggatcacgacctgcagcaccgagggcgtgaacaccaagtgccgcctgtccggcacggccctcatccgggcggggagcgtgggcgccgaggcctgcctgatgctgaagggggtcaaggaggaccagaccaagttcctcaagatcaagaccgtgtccagcgagctgtcctgccgcgagggccagagctactggaccggctccttcagcccgaagtgcctgtccagccggcgctgccacctggtgggggagtgccacgtcaaccggtgcctctcctggcgcgacaacgagacgagcgccgagttctccttcgtgggcgagagcaccaccatgcgcgagaacaagtgcttcgagcagtgcgggggctgggggtgcggctgcttcaacgtgaaccccagctgcctgttcgtccacacctacctgcagtccgtgcggaaggaggcgctccgcgtgttcaactgcatcgactgggtccacaagctgacgctggagatcaccgacttcgacggcagcgtgtccaccatcgacctcggggccagctccagccggttcaccaactggggctccgtgagcctgtccctggacgccgaggggatcagcggctccaacagcttctccttcatcgagagccccgggaagggctacgccatcgtcgacgagcccttctccgagatcccgcgccagggcttcctcggggagatccggtgcaacagcgagtccagcgtgctgtccgcccacgagagctgcctgcgcgcgcccaacctcatcagctacaagcccatgatcgaccagctggagtgcaccacgaacctgatcgaccccttcgtggtcttcgagcggggctccctcccgcagacccgcaacgacaagaccttcgccgccagcaaggggaaccggggcgtgcaggccttctccaaggggagcgtgcaggccgacctgaccctgatgttcgacaacttcgaggtcgacttcgtgggcgcggccgtgtcctgcgacgccgccttcctcaacctgacgggctgctacagctgcaacgccggggcgcgcgtctgcctgtccatcaccagcaccggcaccgggacgctctccgcccacaacaaggacggcagcctgcacatcgtgctgccctccgagaacgggaccaaggaccagtgccagatcctccacttcaccgtgcccgaggtcgaggaggagttcatgtacagctgcgacggcgacgagcggcccctgctggtgaagggcaccctcatcgccatcgacccgttcgacgaccgccgggaggccgggggcgagtccacggtggtcaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcgcaccggcctgtccaagatgtggctcgccgccaccaagaaggccagctga

SEQ ID NO: 12921 - RNA, 3204 nt, synthetic construct
  misc_feature 1..3204: note = derived and/or modified CDS sequence (opt1) from RVFV(73HB1449)__DQ380211.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagaaccccagcaccgagatcacgctcaagtacccggggatctcccagagctccggcggggacatcggcgtccacatggcccacgacgaccagagcgtgtccagcaagatcgtggcccactgcccgccccaggacccctgcctggtccacggctgcatcgtgtgcgcccacgggctgatcaactaccagtgccacaccgcgctctccgccttcgtggtcgtgttcgtgttcagctccatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtacagcacctacctcatgctgctgctcatcgtgtcctacgcgagcgcctgcagcgagctgatccaggcctccagccgcatcacgacctgctccaccgagggcgtgaacaccaagtgccggctgagcggcacggccctcatccgcgccgggtccgtcggcgcggaggcctgcctgatgctgaagggggtgaaggacgaccagaccaagttcctcaagatcaagaccgtgagctccgagctgagctgccgggagggccagtcctactggaccggcagcttctccccgaagtgcctgagctcccgccggtgccacctggtcggggagtgccacgtgaaccgctgcctcagctggcgcgacaacgagacgtccgccgagttcagcttcgtgggcgagtccaccaccatgcgggagaacaagtgcttcgagcagtgcgggggctgggggtgcggctgcttcaacgtcaaccccagctgcctgttcgtgcacacctacctgcagagcgtgcgcaaggaggccctccgggtcttcaactgcatcgactgggtgcacaagctgacgctggagatcaccgacttcgacggctccgtgagcaccatcgacctcggggcgtccagctcccgcttcaccaactggggcagcgtctccctgagcctggacgccgaggggatctccggcagcaactccttcagcttcatcgagtcccccgggaagggctacgccatcgtggacgagcccttcagcgagatcccgcggcagggcttcctcggggagatccgctgcaactccgagagctccgtgctgagcgcccacgagtcctgcctgcgggcccccaacctcatcagctacaagcccatgatcgaccagctggagtgcaccacgaacctgatcgaccccttcgtcgtgttcgagcgcggcagcctcccgcagacccggaacgagaagaccttcgcggcctccaaggggaaccgcggcgtgcaggccttcagcaaggggtccgtccaggccgacctgaccctgatgttcgacaacttcgaggtggacttcgtgggcgccgcggtcagctgcgacgccgccttcctcaacctgacgggctgctactcctgcaacgccggggcccgggtgtgcctgagcatcacctccaccggcaccgggacgctcagcgcgcacaacaaggacggctccctgcacatcgtgctgcccagcgagaacgggaccaaggaccagtgccagatcctccacttcaccgtccccgaggtggaggaggagttcatgtactcctgcgacggcgacgagcgccccctgctggtgaagggcaccctcatcgccatcgacccgttcgacgaccggcgcgaggccgggggcgagagcacggtcgtgaaccccaagtccgggagctggaacttcttcgactggttctccggcctgatgagctggttcggcgggcccctgaagaccatcctcctgatctgcctgtacgtggccctctccatcggcctgttcttcctgctcatctacctggggcggaccggcctgagcaagatgtggctcgcggccaccaagaaggcctcctga

SEQ ID NO: 12922 - RNA, 3204 nt, synthetic construct
  misc_feature 1..3204: note = derived and/or modified CDS sequence (opt1) from RVFV(SA01-1322)__KX096942.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgttctgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctgggggaccccgcccccatcccgcgccacgcccccatcccccggtactccacctacctcatgctgctgctcatcatcagctacgcgagcgcctgctccgagctgatccaggccagctcccgcatcacgacctgcagcaccgagggcgtgaacaccaagtgccggctgtccggcacggccctcatccgcgccgggagcgtgggcgcggaggcctgcctgatgctgaagggggtcaaggaggaccagaccaagttcctcaagatcaagaccgtgtccagcgagctgtcctgccgggagggccagagctactggaccggctccttcagcccgaagtgcctgtccagccgccggtgccacctggtgggggagtgccacgtcaaccgctgcctctcctggcgcgacaacgagacgagcgccgagttctccttcgtgggcgagagcaccaccatgcgggagaacaagtgcttcgagcagtgcgggggctgggggtgcggctgcttcaacgtgaaccccagctgcctgttcgtccacacctacctgcagtccgtgcgcaaggaggccctccgggtgttcaactgcatcgactgggtccacaagctgacgctggagatcaccgacttcgacggcagcgtgtccaccatcgacctcggggcgagctccagccgcttcaccaactggggctccgtgagcctgtccctggacgccgaggggatcagcggctccaacagcttctccttcatcgagagccccgggaagggctacgccatcgtcgacgagcccttctccgagatcccgcggcagggcttcctcggggagatccgctgcaacagcgagtccagcgtgctgtccgcccacgagagctgcctgcgggcccccaacctcatcagctacaagcccatgatcgaccagctggagtgcaccacgaacctgatcgaccccttcgtggtcttcgagcgcggctccctcccgcagacccggaacgagaagaccttcgcggccagcaaggggaaccgcggcgtgcaggccttctccaaggggagcgtgcaggccgacctgaccctgatgttcgacaacttcgaggtcgacttcgtgggcgccgcggtgtcctgcgacgccgccttcctcaacctgacgggctgctacagctgcaacgccggggcccgggtctgcctgtccatcaccagcaccggcaccgggacgctctccgcgcacaacaaggacggcagcctgcacatcgtgctgccctccgagaacgggaccaaggaccagtgccagatcctccacttcaccgtgcccgaggtcgaggaggagttcatgtacagctgcgacggcgacgagcgccccctgctggtgaagggcaccctcatcgccatcgacccgttcgacgaccggcgcgaggccgggggcgagtccacggtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggaccggcctgtccaagatgtggctcgcggccaccaagaaggccagctga

SEQ ID NO: 12923 - RNA, 3204 nt, synthetic construct
  misc_feature 1..3204: note = derived and/or modified CDS sequence (opt1) from RVFV(Sudan 2V-2007)__JQ820490.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcagcgtccacggctgcatcgtgtgcgcccacgggctgatcaactaccagtgccacaccgcgctgtccgccttcgtggtcgtgttcgtgttcagctccatcgccatcatctgcctcgccatcctgtaccgggtcctgaagtgcctcaagatcgcgccccgcaaggtgctgaaccccctgatgtggatcaccgccttcatccggtgggtgtacaagaagatggtcgcccgcgtggccgacaacatcaaccaggtgaaccgggagatcggctggatggagggcgggcagctcgtcctggggaaccccgcccccatcccgcgccacgcccccatcccccggtacagcacctacctgatgctcctgctgatcgtgagccacgcgtccgcctgcagcgagctcatccaggcctccagccgcatcacgacctgctccaccgagggcgtgaacaccaagtgccggctgagcggcacggccctgatccgcgccgggtccgtcggcgcggaggcctgcctcatgctgaagggggtgaaggaggaccagaccaagttcctgaagatcaagaccgtgagctccgagctcagctgccgggagggccagtcctactggaccggcagcttctccccgaagtgcctgagctcccgccggtgccacctggtcggggagtgccacgtgaaccgctgcctgagctggcgcgacaacgagacgtccgccgagttcagcttcgtgggcgagagcaccaccatgcgggagaacaagtgcttcgagcagtgcgggggctgggggtgcggctgcttcaacgtcaacccctcctgcctcttcgtgcacacctacctgcagagcgtgcgcaaggaggccctgcgggtcttcaactgcatcgactgggtgcacaagctcacgctggagatcaccgacttcgacggctccgtgagcaccatcgacctgggggcgtccagctcccgcttcaccaactggggcagcgtctccctcagcctggacgccgaggggatctccggcagcaactccttcagcttcatcgagtcccccgggaagggctacgccatcgtggacgagcccttcagcgagatcccgcggcagggcttcctgggggagatccgctgcaactccgagagctccgtgctcagcgcccacgagagctgcctgcgggcccccaacctgatctcctacaagcccatgatcgaccagctcgagtgcaccacgaacctgatcgaccccttcgtcgtgttcgagcgcggcagcctgccgcagacccggaacgacaagaccttcgcggcctccaaggggaaccgcggcgtgcaggccttcagcaaggggtccgtccaggccgacctcaccctgatgttcgacaacttcgaggtggacttcgtgggcgccgcggtcagctgcgacgccgccttcctgaacctcacgggctgctactcctgcaacgccggggcccgggtgtgcctgagcatcacctccaccggcaccgggacgctgagcgcgcacaacaaggacggctccctccacatcgtgctgcccagcgagaacgggaccaaggaccagtgccagatcctgcacttcaccgtccccgaggtggaggaggagttcatgtactcctgcgacggcgacgagcgccccctcctggtgaagggcaccctgatggccatcgacccgttcgacgaccggcgcgaggccgggggcgagagcacggtcgtgaaccccaagtccgggagctggaacttcttcgactggttctccggcctcatgagctggttcggcgggcccctgaagaccatcctgctcatctgcctgtacgtggccctgtccatcggcctcttcttcctgctgatctacctcgggcggaccggcctgagcaagatgtggctggcggccaccaagaaggccagctga

SEQ ID NO: 12924 - RNA, 3204 nt, synthetic construct
  misc_feature 1..3204: note = derived and/or modified CDS sequence (opt1) from RVFV(35/74)__JF784387.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcggggtggtgcagatccaggtctccggcgtgtggaagaagcccctgtgcgtggggtacgagcgggtcgtggtgaagcgcgagctgagcgccaagccgatccagcgggtcgagccctgcacgacctgcatcaccaagtgcgagccccacggcctggtggtccgctccaccggcttcaagatcagctccgccgtggcctgcgcgagcggggtgtgcgtcaccggctcccagagcccctccaccgagatcacgctcaagtacccggggatcagccagtccagcggcggggacatcggcgtgcacatggcccacgacgaccagtccgtgagctccaagatcgtcgcccactgcccgccccaggacccctgcctggtgcacggctgcatcgtgtgcgcccacgggctgatcaactaccagtgccacaccgcgctcagcgccttcgtcgtggtgttcgtcttctccagcgtggccatcatctgcctggccatcctgtacaaggtgctcaagtgcctgaagatcgcgccccggaaggtcctggaccccctcatgtggatcaccgtgttcatccgctgggtgtacaagaagatggtcgcccgggtggccgacaacatcaaccaggtgaaccgcgagatcggctggatggagggcgggcagctggccctggggaaccccgcccccatcccgcggcacgcccccatcccccgctactccacctacctcatgctgctgctcatcgtcagctacgcgagcgcctgctccgagctgatccaggccagctcccggatcacgacctgcagcaccgagggcgtgaacaccaagtgccgcctgtccggcacggccctcatccgggccgggagcgtgggcgcggaggcctgcctgatgctgaagggggtcaaggaggaccagaccaagttcctcaagatcaagaccgtgtccagcgagctgtcctgccgcgagggccagagctactggaccggctccttcagcccgaagtgcctgtccagccggcgctgccacctggtgggggagtgccacgtcaaccggtgcctctcctggcgcgacaacgagacgagcgccgagttctccttcgtgggcgagagcaccaccatgcgcgagaacaagtgcttcgagcagtgcgggggctgggggtgcggctgcttcaacgtgaaccccagctgcctgttcgtccacacctacctgcagtccgtgcggaaggaggccctccgcgtgttcaactgcatcgactgggtccacaagctgacgctggagatcaccgacttcgacggcagcgtgtccaccatcgacctcggggcgagctccagccggttcaccaactggggctccgtgagcctgtccctggacgccgaggggatcagcggctccaacagcttctccttcatcgagagccccgggaagggctacgccatcgtcgacgagcccttctccgagatcccgcgccagggcttcctcggggagatccggtgcaacagcgagtccagcgtgctgtccgcccacgagagctgcctgcgcgcccccaacctcatcagctacaagcccatgatcgaccagctggagtgcaccacgaacctgatcgaccccttcgtggtcttcgagcggggctccctcccgcagacccgcaacgacaagaccttcgcggccagcaaggggaaccggggcgtgcaggccttctccaaggggagcgtgcaggccgacctgaccctgatgttcgacaacttcgaggtcgacttcgtgggcgccgcggtgtcctgcgacgccgccttcctcaacctgacgggctgctacagctgcaacgccggggcccgcgtctgcctgtccatcaccagcaccggcaccgggacgctctccgcgcacaacaaggacggcagcctgcacatcgtgctgccctccgagaacgggaccaaggaccagtgccagatcctccacttcaccgtgcccgaggtcgaggaggagttcatgtacagctgcgacggcgacgagcggcccctgctggtgaagggcaccctcatcgccatcgacccgttcgacgaccgccgggaggccgggggcgagtccacggtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcgcaccggcctgtccaagatgtggctcgcggccaccaagaaggccagctga

SEQ ID NO: 12925 - RNA, 3204 nt, synthetic construct
  misc_feature 1..3204: note = derived and/or modified CDS sequence (opt1) from RVFV(200803169)__JF311384.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggccctggggaaccccgcccccatcccgcgccacgcgcccatcccccggtactccacgtacctcatgctgctgctcatcgtcagctacgccagcgcctgctccgagctgatccaggccagctcccgcatcacgacctgcagcaccgagggcgtgaacaccaagtgccggctgtccggcaccgccctcatccgcgcggggagcgtgggcgccgaggcctgcctgatgctgaagggggtcaaggtggaccagaccaagttcctcaagatcaagaccgtgtccagcgagctgtcctgccgggagggccagagctactggacgggctccttcagcccgaagtgcctgtccagccgccggtgccacctggtcggggagtgccacgtgaaccgctgcctctcctggcgcgacaacgagaccagcgccgagttctccttcgtgggcgagagcaccaccatgcgggagaacaagtgcttcgagcagtgcgggggctgggggtgcggctgcttcaacgtcaaccccagctgcctgttcgtgcacacgtacctgcagtccgtgcgcaaggaggcgctccgggtcttcaactgcatcgactgggtgcacaagctgaccctggagatcaccgacttcgacggcagcgtgtccaccatcgacctcggggccagctccagccgcttcaccaactggggctccgtcagcctgtccctggacgccgaggggatcagcggctccaacagcttctccttcatcgagagccccgggaagggctacgccatcgtggacgagcccttctccgagatcccgcggcagggcttcctcggggaggtgcgctgcaacagcgagtccagcgtcctgtccgcccacgagagctgcctgcgggcgcccaacctcgtgagctacaagcccatgatcgaccagctggagtgcacgaccaacctgatcgaccccttcgtggtcttcgagcgcggctccctcccgcagacccggaacgacaagaccttcgccgccagcaaggggaaccgcggcgtgcaggccttctccaaggggagcgtgcaggccgacctgacgctgatgttcgacaacttcgaggtcgacttcgtgggcgcggccgtgtcctgcgacgccgccttcctcaacctgaccggctgctacagctgcaacgccggggcgcgggtctgcctgtccatcaccagcaccggcacggggaccctctccgcccacaacaaggacggcagcctgcacatcgtgctgccctccgagaacgggaccaaggaccagtgccagatcctccacttcaccgtgcccgaggtcgaggaggagttcatgtacagctgcgacggcgacgagcgccccctgctggtgaagggcacgctcatcgccatcgacccgttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcggaccggcctgtccaagatgtggctcgccgccacgaagaaggccagctga

SEQ ID NO: 12926 - RNA, 3204 nt, synthetic construct
  misc_feature 1..3204: note = derived and/or modified CDS sequence (opt1) from RVFV(2269/74)__DQ380222.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagcacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcgtcgccatcatctgcctggccatcctgtacaaggtgctcaagtgcctgaagatcgcccccaagaaggtgctgaaccccctcatgtggatcaccgcgttcatccggtgggtctacaagaagatggtggcccgcgtggccgacaacatcaaccaggtcaaccgggagatcggctggatggagggcgggcagctggccctggggaaccccgcccccatcccgcgccacgcgcccatcccccggtactccacctacctcatgctgctgctcatcgtgagctacgccagcgcctgctccgagctgatccaggccagctcccgcatcacgacctgcagcaccgagggcgtgaacaccaagtgccggctgtccggcacggccctcatccgcgcggggagcgtcggcgccgaggcctgcctgatgctgaagggggtgaaggaggaccagaccaagttcctcaagatcaagaccgtgtccagcgagctgtcctgccgggagggccagagctactggaccggctccttcagcccgaagtgcctgtccagccgccggtgccacctggtcggggagtgccacgtgaaccgctgcctctcctggcgggacaacgagacgagcgccgagttctccttcgtgggcgagagcaccaccatgcgcgagaacaagtgcttcgagcagtgcgggggctgggggtgcggctgcttcaacgtcaaccccagctgcctgttcgtgcacacctacctgcagtccgtgcgcaaggaggcgctccgggtcttcaactgcatcgactgggtgcacaagctgacgctggagatcaccgacttcgacggcagcgtgtccaccatcgacctcggggccagctccagccgcttcaccaactggggctccgtcagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtgctgtccgcccacgagagctgcctgcgggcgcccaacctcatcagctacaagcccatgatcgaccagctggagtgcaccacgaacctgatcgaccccttcgtcgtgttcgagcgcggctccctcccgcagacccggaacgacaagaccttcgccgccagcaaggggaaccgcggcgtgcaggccttctccaaggggagcgtccaggccgacctgaccctgatgttcgacaacttcgaggtggacttcgtgggcgcggccgtctcctgcgacgccgccttcctcaacctgacgggctgctacagctgcaacgccggggcgcgggtgtgcctgtccatcaccagcaccggcaccgggacgctctccgcccacaacaaggacggcagcctgcacatcgtgctgccctccgagaacgggaccaaggaccagtgccagatcctccacttcaccgtccccgaggtggaggaggagttcatgtacagctgcgacggcgacgagcgccccctgctggtgaagggcaccctcatcgccatcgacccgttcgacgaccggcgcgaggccgggggcgagtccacggtcgtgaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcggaccggcctgtccaagatgtggctcgccgccaccaagaaggccagctga

SEQ ID NO: 12927 - RNA, 3204 nt, synthetic construct
  misc_feature 1..3204: note = derived and/or modified CDS sequence (opt1) from RVFV(SA-51 (Van Wyck))__DQ380195.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccggggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgcgtggtcgtgaagcgggagctgagcgccaagccgatccagcgcgtggagccctgcacgacctgcatcaccaagtgcgagccccacggcctggtcgtgcggtccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcgtcgccatcatctgcctggccatcctgtacaaggtgctcaagtgcctgaagatcgcgccccgcaaggtgctgaaccccctcatgtggatcaccgccttcatccggtgggtctacaagaagatggtggcccgcgtggccgacaacatcaaccaggtcaaccgggagatcggctggatggagggcgggcagctggccctggggaaccccgcccccatcccgcgccacgcgcccatcccccggtactccacctacctcatgctgctgctcatcgtgagctacgccagcgcctgctccgagctgatccaggccagctcccgcatcacgacctgcagcaccgagggcgtgaacaccaagtgccggctgtccggcacggccctcatccgcgcggggagcgtcggcgccgaggcctgcctgatgctgaagggggtgaaggaggaccagaccaagttcctcaagatcaagaccgtgtccagcgagctgtcctgccgggagggccagagctactggaccggctccttcagcccgaagtgcctgtccagccgccggtgccacctggtcggggagtgccacgtgaaccgctgcctctcctggcgcgacaacgagacgagcgccgagttctccttcgtgggcgagagcaccaccatgcgggagaacaagtgcttcgagcagtgcgggggctgggggtgcggctgcttcaacgtcaaccccagctgcctgttcgtgcacacctacctgcagtccgtgcgcaaggaggcgctccgggtcttcaactgcatcgactgggtgcacaagctgacgctggaggtgaccgacttcgacggcagcgtctccaccatcgacctcggggccagctccagccgcttcaccaactggggctccgtgagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtcctgtccgcccacgagagctgcctgcgggcgcccaacctcatcagctacaagcccatgatcgaccagctggagtgcaccacgaacctgatcgaccccttcgtggtgttcgagcgcggctccctcccgcagacccggaacgacaagaccttcgccgccagcaaggggaaccgcggcgtccaggccttctccaaggggagcgtgcaggccgacctgaccctgatgttcgacaacttcgaggtggacttcgtcggcgcggccgtgtcctgcgacgccgccttcctcaacctgacgggctgctacagctgcaacgccggggcgcgggtgtgcctgtccatcaccagcaccggcaccgggacgctctccgcccacaacaaggacggcagcctgcacatcgtcctgccctccgagaacgggaccaaggaccagtgccagatcctccacttcaccgtgcccgaggtggaggaggagttcatgtacagctgcgacggcgacgagcgccccctgctggtcaagggcaccctcatcgccatcgacccgttcgacgaccggcgcgaggccgggggcgagtccacggtggtgaaccccaagagcgggtcctggaacttcttcgactggttcagcggcctgatgtcctggttcggcgggcccctgaagaccatcctcctgatctgcctgtacgtcgcgctcagcatcggcctgttcttcctgctcatctacctggggcggaccggcctgtccaagatgtggctcgccgccaccaagaaggccagctga

SEQ ID NO: 12928 - RNA, 3204 nt, synthetic construct
  misc_feature 1..3204: note = derived and/or modified CDS sequence (opt1) from RVFV(OS-8)__DQ380185.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcggggtggtgcagatccaggtctccggcgtgtggaagaagcccctgtgcgtggggtacgagcgggtcgtggtgaagcgcgagctgagcgccaagccgatccagcgggtcgagccctgcacgacctgcatcaccaagtgcgagccccacggcctggtggtccgctccaccggcttcaagatcagctccgccgtggcctgcgcgagcggggtgtgcgtcaccggctcccagagcccctccaccgagatcacgctcaagtacccggggatcagccagtccagcggcggggacatcggcgtgcacatggcccacgacgaccagtccgtgagctccaagatcgtcgcccactgcccgccccaggacccctgcctggtgcacggctgcatcgtgtgcgcccacgggctgatcaactaccagtgccacaccgcgctcagcgccttcgtcgtggtgttcgtcttctccagcgtggccatcatctgcctggccatcctgtacaaggtgctcaagtgcctgaagatcgcgccccggaaggtcctgaaccccctcatgtggatcaccgccttcatccgctgggtgtacaagaagatggtggcccgggtcgccgacaacatcaaccaggtgaaccgcgagatcggctggatggagggcgggcagctggccctggggaaccccgcccccatcccgcggcacgcgcccatcccccgctactccacctacctcatgctgctgctcatcgtgagctacgccagcgcctgctccgagctgatccaggccagctcccggatcacgacctgcagcaccgagggcgtcaacaccaagtgccgcctgtccggcacggccctcatccgggcggggagcgtgggcgccgaggcctgcctgatgctgaagggggtgaaggaggaccagaccaagttcctccgcatcaagaccgtctccagcgagctgtcctgccgggagggccagagctactggaccggctccttcagcccgaagtgcctgtccagccgccggtgccacctggtgggggagtgccacgtgaaccgctgcctctcctggcgcgacaacgagacgagcgccgagttctccttcgtcggcgagagcaccaccatgcgggagaacaagtgcttcgagcagtgcgggggctgggggtgcggctgcttcaacgtgaaccccagctgcctgttcgtgcacacctacctgcagtccgtccgcaaggaggcgctccgggtgttcaactgcatcgactgggtgcacaagctgacgctggagatcaccgacttcgacggcagcgtctccaccatcgacctcggggccagctccagccgcttcaccaactggggctccgtgagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtcctgtccgcccacgagagctgcctgcgggcgcccaacctcatcagctacaagcccatgatcgaccagctggagtgcaccacgaacctgatcgaccccttcgtggtgttcgagcgcggctccctcccgcagacccggaacgacaagaccttcgccgccagcaaggggaaccgcggcgtccaggccttctccaaggggagcgtgcaggccgacctgaccctgatgttcgacaacttcgaggtggacttcgtcggcgcggccgtgtcctgcgacgccgccttcctcaacctgagcggctgctactcctgcaacgccggggcgcgggtgtgcctgagcatcacgtccaccggcaccgggaccctcagcgcccacaacaaggacggctccctgcacatcgtcctgcccagcgagaacgggacgaaggaccagtgccagatcctccacttcaccgtgcccgaggtggaggaggagttcatgtactcctgcgacggcgacgagcgccccctgctggtcaagggcaccctcatcgccatcgacccgttcgacgaccggcgcgaggccgggggcgagagcaccgtggtgaaccccaagtccgggagctggaacttcttcgactggttctccggcctgatgagctggttcggcgggcccctgaagacgatcctcctgatctgcctgtacgtcgcgctctccatcggcctgttcttcctgctcatctacctggggcggaccggcctgagcaagatgtggctcgccgccaccaagaaggccagctga

SEQ ID NO: 12929 - RNA, 3204 nt, synthetic construct
  misc_feature 1..3204: note = derived and/or modified CDS sequence (opt1) from RVFV(KEN07-KUR340)__EF460404.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccggatgctcaagtgcctgaagatcgcgccccgcatcgtcctgaaccccctcatgtggatcaccgccttcatccggtgggtgtacaagaagatggtggcccgcgtcgccgacaacatcaaccaggtgaaccgggagatcggctggatggagggcgggcagctggccctggggaaccccgcccccatcccgcgccacgcgcccatcccccggtactccacgtacctcatgctgctgctcatcgtgagctacgccagcgcctgctccgagctgatccaggccagctcccgcatcacgacctgcagcaccgagggcgtcaacaccaagtgccggctgtccggcaccgccctcatccgcgcggggagcgtgggcgccgaggcctgcctgatgctgaagggggtgaaggaggaccagaccaagttcctcaagatcaagaccgtctccagcgagctgtcctgccgggagggccagagctactggacgggctccttcagcccgaagtgcctgtccagccgccggtgccacctggtgggggagtgccacgtgaaccgctgcctctcctggcgcgacaacgagaccagcgccgagttctccttcgtcggcgagagcaccaccatgcgggagaacaagtgcttcgagcagtgcgggggctgggggtgcggctgcttcaacgtgaaccccagctgcctgttcgtgcacacgtacctgcagtccgtccgcaaggaggcgctccgggtgttcaactgcatcgactgggtgcacaagctgaccctggagatcaccgacttcgacggcagcgtctccaccatcgacctcggggccagctccagccgcttcaccaactggggctccgtgagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtcctgtccgcccacgagagctgcctgcgggcgcccaacctcgtgagctacaagcccatgatcgaccagctggagtgcacgaccaacctgatcgaccccttcgtggtcttcgagcgcggctccctcccgcagacccggaacgacaagaccttcgccgccagcaaggggaaccgcggcgtgcaggccttctccaaggggagcgtgcaggccgacctgacgctgatgttcgacaacttcgaggtcgacttcgtgggcgcggccgtgtcctgcgacgccgccttcctcaacctgaccggctgctacagctgcaacgccggggcgcgggtctgcctgtccatcaccagcaccggcacggggaccctctccgcccacaacaaggacggcagcctgcacatcgtgctgccctccgagaacgggaccaaggaccagtgccagatcctccacttcaccgtgcccgaggtcgaggaggagttcatgtacagctgcgacggcgacgagcgccccctgctggtgaagggcacgctcatcgccatcgacccgttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcggaccggcctgtccaagatgtggctcgccgccacgaagaaggccagctga

SEQ ID NO: 12930 - RNA, 3204 nt, synthetic construct
  misc_feature 1..3204: note = derived and/or modified CDS sequence (opt1) from RVFV(ANK-3837)__DQ380215.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaagctggactccggccagaccaagcgcgagctcaagagcttcgacatctcccagtgccccaagatcgggggccacggcagcaagaagtgcaccggggacgcggccttctgctccgcctacgagtgcacggcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcaccctgaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctcatcaactaccagtgccacacggcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtgggtgtaccgcaagatggtcgcccgggtggccgacaacatcaaccaggtgaaccgcgagatcggctggatggagggcgggcagctggtcctcgggaaccccgcccccatcccgcggcacgtgcccatcccccgctactccacctacctgatgctgctcctgatcgtgagctacgccagcgcgtgctccgagctgatccaggccagctcccggatcaccacgtgcagcaccgagggcgtcaacaccaagtgccgcctctccggcaccgccctgatccgggccgggagcgtgggcgccgaggcgtgcctgatgctcaagggggtgaaggaggaccagacgaagttcctgaagatcaagaccgtctccagcgagctgtcctgccgcgagggccagagctactggaccggctccttcagcccgaagtgcctgtccagccggcgctgccacctcgtgggggagtgccacgtgaaccgctgcctgtcctggcgggacaacgagaccagcgccgagttctccttcgtcggcgagagcacgaccatgcgcgagaacaagtgcttcgagcagtgcgggggctgggggtgcggctgcttcaacgtgaaccccagctgcctgttcgtgcacacctacctccagtccgtccggaaggaggccctgcgcgtgttcaactgcatcgactgggtgcacaagctgaccctcgagatcacggacttcgacggcagcgtctccaccatcgacctgggggccagctccagccggttcaccaactggggctccgtgagcctgtccctcgacgcggaggggatcagcggctccaacagcttctccttcatcgagagccccgggaagggctacgccatcgtggacgagcccttctccgagatcccgcgccagggcttcctgggggagatccggtgcaacagcgagtccagcgtcctgtccgcccacgagagctgcctccgcgcccccaacctgatcagctacaagcccatgatcgaccagctggagtgcaccaccaacctcatcgaccccttcgtggtgttcgagcggggctccctgccgcagacgcgcaacgacaagaccttcgccgcgagcaaggggaaccggggcgtccaggccttctccaaggggagcgtgcaggccgacctgaccctcatgttcgacaacttcgaggtggacttcgtcggcgccgccgtgtcctgcgacgcggccttcctgaacctgaccggctgctacagctgcaacgccggggcccgcgtgtgcctctccatcacgagcaccggcaccgggaccctgtccgcccacaacaaggacggcagcctgcacatcgtcctcccctccgagaacgggacgaaggaccagtgccagatcctgcacttcaccgtgcccgaggtggaggaggagttcatgtacagctgcgacggcgacgagcggcccctgctcgtccgcggcaccctgatcgcgatcgacccgttcgacgaccggcgcgaggccgggggcgagtccaccgtggtgaaccccaagagcgggtcctggaacttcttcgactggttcagcggcctgatgtcctggttcggcgggcccctcaagacgatcctgctgatctgcctctacgtcgccctgagcatcggcctgttcttcctcctgatctacctggggcggaccggcctctccaagatgtggctggccgcgaccaagaaggccagctga

SEQ ID NO: 12931 - RNA, 3204 nt, synthetic construct
  misc_feature 1..3204: note = derived and/or modified CDS sequence (opt1) from RVFV(Lunyo)__KU167026.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggtgtccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtctccggcgtgtggaagaagcccctgtgcgtggggtacgagcgggtcgtggtgaagcgcgagctgagcgccaagccgatccagcgggtcgagccctgcacgacctgcatcaccaagtgcgagccccacggcctggtggtccgctccaccggcttcaagatcagctccgccgtggcctgcgcgagcggggtgtgcgtcaccggctcccagagcccctccaccgagatcacgctcaagtacccggggatcagccagtccagcggcggggacatcggcgtgcacatggcccacgacgaccagtccgtgagctccaagatcgtcgcccactgcccgccccaggacccctgcctggtgcacggctgcatcgtgtgcgcccacgggctgatcaactaccagtgccacaccgcgctcagcgccttcgtcgtggtgttcgtcttctccagcgtggccatcatctgcctggccatcctgtacaaggtgctcaagtgcctgaagatcgcgccccggaaggtcctgaaccccctcatgtggatcaccgccttcatccgctgggtgtacaagaagatggtggcccgggtcgccgacaacatcaaccaggtgaaccgcgagatcggctggatggagggcgggcagctggccctggggaaccccgcccccatcccgcggcacgcgcccatcccccgctactccacctacctcatgctgctgctcatcgtgagctacgccagcgcctgctccgagctgatccaggccagctcccggatcacgacctgcagcaccgagggcgtcaacacccgctgccggctgtccggcacggccctcatccgcgcggggagcgtgggcgccgaggcctgcctgatgctgaagggggtgaaggaggaccagaccaagttcctcaagatcaagaccgtctccagcgagctgtcctgccgggagggccagagctactggaccggctccttcagcccgaagtgcctgtccagccgccggtgccacctggtgggggagtgccacgtgaaccgctgcctctcctggcgcgacaacgagacgagcgccgagttctccttcgtcggcgagagcaccaccatgcgggagaacaagtgcttcgagcagtgcgggggctgggggtgcggctgcttcaacgtgaaccccagctgcctgttcgtgcacacctacctgcagtccgtccgcaaggaggcgctccgggtgttcaactgcatcgactgggtgcacaagctgacgctggagatcaccgacttcgacggcagcgtctccaccatcgacctcggggccagctccagccgcttcaccaactggggctccgtgagcctgtccctggacgccgaggggatcagcggctccaacagcttctccttcatcgagagccccgggaagggctacgccatcgtggacgagcccttctccgagatcccgcggcagggcttcctcggggagatccgctgcaacagcgagtccagcgtcctgtccgcccacgagagctgcctgcgggcgcccaacctcatcagctacaagcccatgatcgaccagctggagtgcaccacgaacctgatcgaccccttcgtggtgttcgagcgcggctccctcccgcagacccggaacgacaagaccttcgccgccagcaaggggaaccgcggcgtccaggccttctccaaggggagcgtgcaggccgacctgaccctgatgttcgacaacttcgaggtggacttcgtcggcgcggccgtgtcctgcgacgccgccttcctcaacctgacgggctgctacagctgcaacgccggggcgcgggtgtgcctgtccatcaccagcaccggcaccgggacgctctccgcccacaacaaggacggcagcctgcacatcgtcctgccctccgagaacgggaccaaggaccagtgccagatcctccacttcaccgtgcccgaggtggaggaggagttcatgtacagctgcgacggcgacgagcgccccctgctggtcaagggcaccctcatcgccatcgacccgttcgacgaccggcgcgaggccgggggcgagtccacggtggtgaaccccaagagcgggtcctggaacttcttcgactggttcagcggcctgatgtcctggttcggcgggcccctgaagaccatcctcctgatctgcctgtacgtcgcgctcagcatcggcctgttcttcctgctcatctacctggggcggaccggcctgtccaagatgtggctcgccgccaccaagaaggccagctga

SEQ ID NO: 12932 - RNA, 3204 nt, synthetic construct
  misc_feature 1..3204: note = derived and/or modified CDS sequence (opt1) from RVFV(200803167)__JF311382.1__Gn-Gc
  source 1..3204: mol_type = other RNA
atggccggcatcgccatgaccgtgctgcccgcgctcgccgtcttcgccctggccccggtggtgttcgccgaggacctgcacctccgcaaccggcccgggaagggccacaactacatcgacgggatgacccaggaggacgcgacgtgcaagcccgtcacctacgccggcgcctgcagctccttcgacgtgctgctggagaaggggaagttccccctcttccagagctacgcccaccaccgcaccctgctggaggcggtgcacgacaccatcatcgccaaggccgacccgccctcctgcgacctccagagcgcccacggcaacccctgcatgaaggagaagctggtcatgaagacgcactgccccaacgactaccagtccgcccactacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgccggacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagcccatccagcgggtggagccgtgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcgccctgaagtaccccgggatcagccagtccagcggcggggacatcggcgtccacatggcccacgacgaccagtccgtgagctccaagatcgtggcccactgcccgccccaggacccctgcctggtccacggctgcatcgtgtgcgcgcacgggctcatcaactaccagtgccacacggccctgagcgccttcgtggtcgtgttcgtgttctccagcatcgccatcatctgcctggccatcctctaccgggtcctgaagtgcctgaagatcgcgccccgcaaggtgctcaacccgctgatgtggatcaccgccttcatccggtgggtgtacaagaagatggtcgcccgcgtggccgacaacatcaaccaggtgaaccgggagatcggctggatggagggcgggcagctggtcctcgggaaccccgcccccatcccccgccacgcgccgatcccccggtactccacctacctgatgctgctcctgatcgtgagctacgccagcgcctgctccgagctgatccaggccagctcccgcatcaccacgtgcagcaccgagggcgtgaacaccaagtgccggctctccggcaccgccctgatccgcgcggggagcgtcggcgccgaggcctgcctgatgctcaagggggtgaaggaggaccagacgaagttcctgaagatcaagaccgtgtccagcgagctgtcctgccgggagggccagagctactggaccggctccttcagccccaagtgcctgtccagccgccggtgccacctcgtcggggagtgccacgtgaaccgctgcctgtcctggcgcgacaacgagaccagcgccgagttctccttcgtgggcgagagcacgaccatgcgggagaacaagtgcttcgagcagtgcgggggctgggggtgcggctgcttcaacgtcaacccgagctgcctgttcgtgcacacctacctccagtccgtgcgcaaggaggcgctgcgggtcttcaactgcatcgactgggtgcacaagctgaccctcgagatcacggacttcgacggcagcgtgtccaccatcgacctgggggccagctccagccgcttcaccaactggggctccgtcagcctgtccctcgacgccgaggggatcagcggctccaacagcttctccttcatcgagagccccgggaagggctacgccatcgtggacgagcccttctccgagatcccccggcagggcttcctgggggagatccgctgcaacagcgagtccagcgtgctgtccgcccacgagagctgcctccgggcgccgaacctgatcagctacaagcccatgatcgaccagctggagtgcaccaccaacctcatcgaccccttcgtcgtgttcgagcgcggctccctgccccagacgcggaacgacaagaccttcgccgccagcaaggggaaccgcggcgtgcaggccttctccaaggggagcgtccaggccgacctgaccctcatgttcgacaacttcgaggtggacttcgtgggcgcggccgtctcctgcgacgccgccttcctgaacctgaccggctgctacagctgcaacgccggggcgcgggtgtgcctctccatcacgagcaccggcaccgggaccctgtccgcccacaacaaggacggcagcctgcacatcgtgctcccgtccgagaacgggacgaaggaccagtgccagatcctgcacttcaccgtccccgaggtggaggaggagttcatgtacagctgcgacggcgacgagcgccccctgctcgtgaagggcaccctgatcgccatcgaccccttcgacgaccggcgcgaggccgggggcgagtccaccgtcgtgaaccccaagagcgggtcctggaacttcttcgactggttcagcggcctgatgtcctggttcggcgggccgctcaagacgatgctgctgatctgcctctacgtggcgctgagcatcggcctgttcttcctcctgatctacctggggcggaccggcctctccaagatgtggctggccgccaccaagaaggccagctga

SEQ ID NO: 12933 - RNA, 3204 nt, synthetic construct
  misc_feature 1..3204: note = derived and/or modified CDS sequence (opt1) from RVFV(2373/74)__DQ380194.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatggtggcccactgcccgccccaggacccctgcctggtccacggctgcatcgtgtgcgcccacgggctgatcaactaccagtgccacaccgcgctcagcgccttcgtggtcgtgttcgtgttctccagcgtcgccatcatctgcctggccatcctgtacaaggtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggccctggggaaccccgcccccatcccgcggcacgcgcccatcccccgctactccacctacctcatgctgctgctcatcgtgagctacgccagcgcctgctccgagctgatccaggccagctcccggatcacgacctgcagcaccgagggcgtgaacaccaagtgccgcctgtccggcacggccctcatccgggcggggagcgtcggcgccgaggcctgcctgatgctgaagggggtgaaggaggaccagaccaagttcctcaagatcaagaccgtgtccagcgagctgtcctgccgcgagggccagagctactggaccggctccttcagcccgaagtgcctgtccagccggcgctgccacctggtcggggagtgccacgtgaaccggtgcctctcctggcgcgacaacgagacgagcgccgagttctccttcgtgggcgagagcaccaccatgcgcgagaacaagtgcttcgagcagtgcgggggctgggggtgcggctgcttcaacgtcaaccccagctgcctgttcgtgcacacctacctgcagtccgtgcggaaggaggcgctccgcgtcttcaactgcatcgactgggtgcacaagctgacgctggagatcaccgacttcgacggcagcgtgtccaccctcgacctgggggccagctccagccggttcaccaactggggctccgtcagcctgtccctcgacgccgaggggatcagcggctccaacagcttctccttcatcgagagccccgggaagggctacgccatcgtggacgagcccttctccgagatcccgcgccagggcttcctgggggagatccggtgcaacagcgagtccagcgtgctgtccgcccacgagagctgcctccgcgcgcccaacctgatcagctacaagcccatgatcgaccagctggagtgcaccacgaacctcatcgaccccttcgtcgtgttcgagcggggctccctgccgcagacccgcaacgagaagaccttcgccgccagcaaggggaaccggggcgtgcaggccttctccaaggggagcgtccaggccgacctgaccctcatgttcgacaacttcgaggtggacttcgtgggcgcggccgtctcctgcgacgccgccttcctgaacctgacgggctgctacagctgcaacgccggggcgcgcgtgtgcctctccatcaccagcaccggcaccgggacgctgtccgcccacaacaaggacggcagcctgcacatcgtgctcccctccgagaacgggaccaaggaccagtgccagatcctgcacttcaccgtccccgaggtggaggaggagttcatgtacagctgcgacggcgacgagcggcccctgctcgtgaagggcaccctgatcgccatcgacccgttcgacgaccgccgggaggccgggggcgagtccacggtcgtgaaccccaagagcgggtcctggaacttcttcgactggttcagcggcctgatgtcctggttcggcgggcccctcaagaccatcctgctgatctgcctctacgtggcgctgagcatcggcctgttcttcctcctgatctacctggggcgcaccggcctctccaagatgtggctggccgccaccaagaaggccagctga

SEQ ID NO: 12934 - RNA, 3204 nt, synthetic construct
  misc_feature 1..3204: note = derived and/or modified CDS sequence (opt1) from RVFV(Kenya 57 (Rintoul))__DQ380192.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagatcaagcgcgagctcaagagcttcgacatctcccagtgccccaagatcgggggccacggcagcaagaagtgcaccggggacgcggccttctgctccgcctacgagtgcacggcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcaccctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacacggcgctcagcgccttcgtggtcgtgttcgtgttctccagcgtcgccatcatctgcctggccatcctgtacaaggtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggtgctggggaaccccgcccccatcccgcggcacgcccccatcccccgctactccacctacctcatgctgctgctcatcgtgagctacgcgagcgcctgctccgagctgatccaggccagctcccggatcaccacgtgcagcaccgagggcgtcaacaccaagtgccgcctgtccggcaccgccctcatccgggccgggagcgtgggcgcggaggcctgcctgatgctgaagggggtgaaggaggaccagacgaagttcctcaagatcaagaccgtctccagcgagctgtcctgccgcgagggccagagctactggaccggctccttcagcccgaagtgcctgtccagccggcgctgccacctggtgggggagtgccacgtgaaccggtgcctctcctggcgcgacaacgagaccagcgccgagttctccttcgtcggcgagagcacgaccatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcacggacttcgacggcagcgtctccaccgtggacctcggggcgagctccagccggttcaccaactggggctccgtgagcctgtccctggacgccgaggggatcagcggctccaacagcttctccttcatcgagagccccgggaagggctacgccatcgtcgacgagcccttctccgagatcagccgccagggcttcctcggggagatccggtgcaactccgagagctccgtgctgagcgcccacgagagctgcctgcgcgccccgaacctcatctcctacaagcccatgatcgaccagctggagtgcaccaccaacctgatcgaccccttcgtggtcttcgagcggggcagcctcccccagacgcgcaacgacaagaccttcgcggcctccaaggggaaccggggcgtgcaggccttcagcaaggggtccgtgcaggccgacctgaccctgatgttcgacaacttcgaggtcgacttcgtgggcgccgcggtgagctgcgacgccgccttcctcaacctgaccggctgctactcctgcaacgccggggcccgcgtctgcctgagcatcacgtccaccggcaccgggaccctcagcgcgcacaacaaggacggctccctgcacatcgtgctgccgagcgagaacgggacgaaggaccagtgccagatcctccacttcaccgtgcccgaggtcgaggaggagttcatgtactcctgcgacggcgacgagcggcccctgctggtgaagggcaccctcatcgccatcgaccccttcgacgaccgccgggaggccgggggcgagagcaccgtggtcaacccgaagtccgggagctggaacttcttcgactggttctccggcctgatgagctggttcggcgggcccctgaagacgatcctcctgatctgcctgtacgtggccctctccatcggcctgttcttcctgctcatctacctggggcgcaccggcctgagcaagatgtggctcgcggccaccaagaaggccagctga

SEQ ID NO: 12935 - RNA, 3204 nt, synthetic construct
  misc_feature 1..3204: note = derived and/or modified CDS sequence (opt1) from RVFV(RVFBJ01/2016)__KX785331.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagcacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcgtcgccatcatctgcctggccatcctgtacaaggtgctccggtgcctgaagatcgcccccaagaaggtgctgaaccccctcatgtggatcaccgcgttcatccgctgggtctacaagaagatggtggcccgggtggccgacaacatcaaccaggtcaaccgcgagatcggctggatggagggcgggcagctggccctggggaaccccgcccccatcccgcggcacgcgcccatcccccgctactccacctacctcatgctgctgctcatcatcagctacgccagcgcctgctccgagctgatccaggccagctcccggatcacgacctgcagcaccgagggcgtgaacaccaagtgccgcctgtccggcacggccctcatccgggcggggagcgtgggcgccgaggcctgcctgatgctgaagggggtcaaggaggaccagaccaagttcctcaagatcaagaccgtgtccagcgagctgtcctgccgcgagggccagagctactggaccggctccttcagcccgaagtgcctgtccagccggcgctgccacctggtgggggagtgccacgtcaaccggtgcctctcctggcgcgacaacgagacgagcgccgagttctccttcgtgggcgagagcaccaccatgcgcgagaacaagtgcttcgagcagtgcgggggctgggggtgcggctgcttcaacgtgaaccccagctgcctgttcgtccacacctacctgcagtccgtgcggaaggaggcgctccgcgtgttcaactgcatcgactgggtccacaagctgacgctggagatcaccgacttcgacggcagcgtgtccaccatcgacctcggggccagctccagccggttcaccaactggggctccgtgagcctgtccctggacgccgaggggatcagcggctccaacagcttctccttcatcgagagccccgggaagggctacgccatcgtcgacgagcccttctccgagatcccgcgccagggcttcctcggggagatccggtgcaacagcgagtccagcgtgctgtccgcccacgagagctgcctgcgcgcgcccaacctcatcagctacaagcccatgatcgaccagctggagtgcaccacgaacctgatcgaccccttcgtggtcttcgagcggggctccctcccgcagacccgcaacgacaagaccttcgccgccagcaaggggaaccggggcgtgcaggccttctccaaggggagcgtgcaggccgacctgaccctgatgttcgacaacttcgaggtcgacttcgtgggcgcggccgtgtcctgcgacgccgccttcctcaacctgacgggctgctacagctgcaacgccggggcgcgcgtctgcctgtccatcaccagcaccggcaccgggacgctctccgcccacaacaaggacggcagcctgcacatcgtgctgccctccgagaacgggaccaaggaccagtgccagatcctccacttcaccgtgcccgaggtcgaggaggagttcatgtacagctgcgacggcgacgagcggcccctgctggtgaagggcaccctcatcgccatcgacccgttcgacgaccgccgggaggccgggggcgagtccacggtggtcaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcgcaccggcctgtccaagatgtggctcgccgccaccaagaaggccagctga

SEQ ID NO: 12936 - RNA, 3204 nt, synthetic construct
  misc_feature 1..3204: note = derived and/or modified CDS sequence (opt1) from RVFV(clone 13)__DQ380213.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagcacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagaaccccagcaccgagatcacgctcaagtacccggggatctcccagagctccggcggggacatcggcgtccacatggcccacgacgaccagagcgtgtccagcaagatcgtggcccactgcccgccccaggacccctgcctggtccacggctgcatcgtgtgcgcccacgggctgatcaactaccagtgccacaccgcgctctccgccttcgtggtcgtgttcgtgttcagctccatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtacagcacctacctcatgctgctgctcatcgtgtcctacgcgagcgcctgcagcgagctgatccaggcctccagccgcatcacgacctgctccaccgagggcgtgaacaccaagtgccggctgagcggcacggccctcatccgcgccgggtccgtcggcgcggaggcctgcctgatgctgaagggggtgaaggacgaccagaccaagttcctcaagatcaagaccgtgagctccgagctgagctgccgggagggccagtcctactggaccggcagcttctccccgaagtgcctgagctcccgccggtgccacctggtcggggagtgccacgtgaaccgctgcctcagctggcgcgacaacgagacgtccgccgagttcagcttcgtgggcgagtccaccaccatgcgggagaacaagtgcttcgagcagtgcgggggctgggggtgcggctgcttcaacgtcaaccccagctgcctgttcgtgcacacctacctgcagagcgtgcgcaaggaggccctccgggtcttcaactgcatcgactgggtgcacaagctgacgctggagatcaccgacttcgacggctccgtgagcaccatcgacctcggggcgtccagctcccgcttcaccaactggggcagcgtctccctgagcctggacgccgaggggatctccggcagcaactccttcagcttcatcgagtcccccgggaagggctacgccatcgtggacgagcccttcagcgagatcccgcggcagggcttcctcggggagatccgctgcaactccgagagctccgtgctgagcgcccacgagtcctgcctgcgggcccccaacctcatcagctacaagcccatgatcgaccagctggagtgcaccacgaacctgatcgaccccttcgtcgtgttcgagcgcggcagcctcccgcagacccggaacgagaagaccttcgcggcctccaaggggaaccgcggcgtgcaggccttcagcaaggggtccgtccaggccgacctgaccctgatgttcgacaacttcgaggtggacttcgtgggcgccgcggtcagctgcgacgccgccttcctcaacctgacgggctgctactcctgcaacgccggggcccgggtgtgcctgagcatcacctccaccggcaccgggacgctcagcgcgcacaacaaggacggctccctgcacatcgtgctgcccagcgagaacgggaccaaggaccagtgccagatcctccacttcaccgtccccgaggtggaggaggagttcatgtactcctgcgacggcgacgagcgccccctgctggtgaagggcaccctcatcgccatcgacccgttcgacgaccggcgcgaggccgggggcgagagcacggtcgtgaaccccaagtccgggagctggaacttcttcgactggttctccggcctgatgagctggttcggcgggcccctgaagaccatcctcctgatctgcctgtacgtggccctctccatcggcctgttcttcctgctcatctacctggggcggaccggcctgagcaagatgtggctcgcggccaccaagaaggcctcctga

SEQ ID NO: 12937 - RNA, 3204 nt, synthetic construct
  misc_feature 1..3204: note = derived and/or modified CDS sequence (opt1) from RVFV__JQ068143.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatcgactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcgtcgccatcatctgcctggccatcctgtacaaggtgctccggtgcctgaagatcgcccccaagaaggtgctgaaccccctcatgtggatcaccgcgttcatccgctgggtctacaagaagatggtggcccgggtggccgacaacatcaaccaggtcaaccgcgagatcggctggatggagggcgggcagctggccctggggaaccccgcccccatcccgcggcacgcgcccatcccccgctactccacctacctcatgctgctgctcatcatcagctacgccagcgcctgctccgagctgatccaggccagctcccggatcacgacctgcagcaccgagggcgtgaacaccaagtgccgcctgtccggcacggccctcatccgggcggggagcgtgggcgccgaggcctgcctgatgctgaagggggtcaaggaggaccagaccaagttcctcaagatcaagaccgtgtccagcgagctgtcctgccgcgagggccagagctactggaccggctccttcagcccgaagtgcctgtccagccggcgctgccacctggtgggggagtgccacgtcaaccggtgcctctcctggcgcgacaacgagacgagcgccgagttctccttcgtgggcgagagcaccaccatgcgcgagaacaagtgcttcgagcagtgcgggggctgggggtgcggctgcttcaacgtgaaccccagctgcctgttcgtccacacctacctgcagtccgtgcggaaggaggcgctccgcgtgttcaactgcatcgactgggtccacaagctgacgctggagatcaccgacttcgacggcagcgtgtccaccatcgacctcggggccagctccagccggttcaccaactggggctccgtgagcctgtccctggacgccgaggggatcagcggctccaacagcttctccttcatcgagagccccgggaagggctacgccatcgtcgacgagcccttctccgagatcccgcgccagggcttcctcggggagatccggtgcaacagcgagtccagcgtgctgtccgcccacgagagctgcctgcgcgcgcccaacctcatcagctacaagcccatgatcgaccagctggagtgcaccacgaacctgatcgaccccttcgtggtcttcgagcggggctccctcccgcagacccgcaacgacaagaccttcgccgccagcaaggggaaccggggcgtgcaggccttctccaaggggagcgtgcaggccgacctgaccctgatgttcgacaacttcgaggtcgacttcgtgggcgcggccgtgtcctgcgacgccgccttcctcaacctgacgggctgctacagctgcaacgccggggcgcgcgtctgcctgtccatcaccagcaccggcaccgggacgctctccgcccacaacaaggacggcagcctgcacatcgtgctgccctccgagaacgggaccaaggaccagtgccagatcctccacttcaccgtgcccgaggtcgaggaggagttcatgtacagctgcgacggcgacgagcggcccctgctggtgaagggcaccctcatcgccatcgacccgttcgacgaccgccgggaggccgggggcgagtccacggtggtcaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcgcaccggcctgtccaagatgtggctcgccgccaccaagaaggccagctga

SEQ ID NO: 12938 - RNA, 3204 nt, synthetic construct
  misc_feature 1..3204: note = derived and/or modified CDS sequence (opt1) from RVFV(SA-75)__DQ380189.1__Gn-Gc
  source 1..3204: mol_type = other RNA
atggcccgcatcgccatgaccgtgctgcccgcgctcgccgtcttcgccctggccccggtggtgttcgccgaggacccccacctccggaaccgccccggcaaggggcacaactacatcgacggcatgacccaggaggacgcgacgtgcaagcccgtcacctacgccggggcctgcagctccttcgacgtgctgctggagaagggcaagttcccgctgttccagagctacgcccaccaccggaccctcctggaggcggtgcacgacaccatcatcgccaaggccgacccgccctcctgcgacctgcagagcgcccacgggaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccgccagatgaccggcgcctccctcaagaaggggagctaccccctgcaggacctgttctgccagtccagcgaggacgacggctccaagctcaagaccaagatgaagggggtgtgcgaggtcggcgtgcaggccctgaagaagtgcgacgggcagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaagggcaccatggactccgggcagaccaagcgggagctcaagagcttcgacatctcccagtgccccaagatcggcgggcacggcagcaagaagtgcacgggcgacgcggccttctgctccgcctacgagtgcaccgcccagtacgccaacgcgtactgcagccacgccaacgggagcggcgtggtgcagatccaggtctccggggtgtggaagaagcccctgtgcgtgggctacgagcgcgtcgtggtgaagcgggagctgagcgccaagccgatccagcgcgtcgagccctgcacgacctgcatcaccaagtgcgagccccacgggctggtggtccggtccaccggcttcaagatcagctccgccgtggcctgcgcgagcggcgtgtgcgtcaccgggtcccagagcccctccaccgagatcacgctcaagtacccgggcatcagccagtccagcgggggcgacatcggggtgcacatggcccacgacgaccagtccgtgagctccaagatcgtcgcccactgcccgccccaggacccctgcctggtgcacggctgcatcgtgtgcgcccacggcctgatcaactaccagtgccacaccgcgctcagcgccttcgtcgtggtgttcgtcttctccagcgtggccatcatctgcctggccatcctgtacaaggtgctcaagtgcctgaagatcgcgccccgcaaggtcctgaaccccctcatgtggatcaccgtgttcatccggtgggtgtacaagaagatggtcgcccgcgtggccgacaacatcaaccaggtgaaccgggagatcgggtggatggagggcgggcagctggccctgggcaaccccgcccccatcccgcgccacgcccccatcccccggtactccacctacctcatgctgctgctcatcgtcagctacgcgagcgcctgctccgagctgatccaggccagctcccgcatcacgacctgcagcaccgagggggtgaacaccaagtgccggctgtccggcacggccctcatccgcgccggcagcgtgggggcggaggcctgcctgatgctgaagggcgtcaaggaggaccagaccaagttcctcaagatcaagaccgtgtccagcgagctgtcctgccgggaggggcagagctactggaccggctccttcagcccgaagtgcctgtccagccgccggtgccacctggtgggcgagtgccacgtcaaccgctgcctctcctggcgcgacaacgagacgagcgccgagttctccttcgtgggggagagcaccaccatgcgggagaacaagtgcttcgagcagtgcggcgggtggggctgcgggtgcttcaacgtgaaccccagctgcctgttcgtccacacctacctgcagtccgtgcgcaaggaggccctccgggtgttcaactgcatcgactgggtccacaagctgacgctggagatcaccgacttcgacggcagcgtgtccaccatcgacctcggcgcgagctccagccgcttcaccaactgggggtccgtgagcctgtccctggacgccgagggcatcagcgggtccaacagcttctccttcatcgagagccccggcaaggggtacgccatcgtcgacgagcccttctccgagatcccgcggcagggcttcctcggcgagatccgctgcaacagcgagtccagcgtgctgtccgcccacgagagctgcctgcgggcccccaacctcatcagctacaagcccatgatcgaccagctggagtgcaccacgaacctgatcgaccccttcgtggtcttcgagcgcgggtccctcccgcagacccggaacgacaagaccttcgcggccagcaagggcaaccgcggggtgcaggccttctccaagggcagcgtgcaggccgacctgaccctgatgttcgacaacttcgaggtcgacttcgtgggggccgcggtgtcctgcgacgccgccttcctcaacctgacgggctgctacagctgcaacgccggcgcccgggtctgcctgtccatcaccagcaccgggaccggcacgctctccgcgcacaacaaggacgggagcctgcacatcgtgctgccctccgagaacggcaccaaggaccagtgccagatcctccacttcaccgtgcccgaggtcgaggaggagttcatgtacagctgcgacggggacgagcgccccctgctggtgaagggcaccctcatcgccatcgacccgttcgacgaccggcgcgaggccggcggggagtccacggtggtcaaccccaagagcggctcctggaacttcttcgactggttcagcgggctgatgtcctggttcggcggccccctgaagaccatcctcctgatctgcctgtacgtggccctcagcatcgggctgttcttcctgctcatctacctgggccggaccgggctgtccaagatgtggctcgcggccaccaagaaggccagctga

SEQ ID NO: 12939 - RNA, 3204 nt, synthetic construct
  misc_feature 1..3204: note = derived and/or modified CDS sequence (opt1) from RVFV(ANK-6087)__DQ380216.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaagctggactccggccagaccaagcgcgagctcaagagcttcgacatctcccagtgccccaagatcgggggccacggcagcaagaagtgcaccggggacgcggccttctgctccgcctacgagtgcacggcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcaccctgaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctcatcaactaccagtgccacacggcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtgggtgtaccgcaagatggtcgcccgggtggccgacaacatcaaccaggtgaaccgcgagatcggctggatggagggcgggcagctggtcctcgggaaccccgcccccatcccgcggcacgtgcccatcccccgctactccacctacctgatgctgctcctgatcgtgagctacgccagcgcgtgctccgagctgatccaggccagctcccggatcaccacgtgcagcaccgagggcgtcaacaccaagtgccgcctctccggcaccgccctgatccgggccgggagcgtgggcgccgaggcgtgcctgatgctcaagggggtgaaggaggaccagacgaagttcctgaagatcaagaccgtctccagcgagctgtcctgccgcgagggccagagctactggaccggctccttcagcccgaagtgcctgtccagccggcgctgccacctcgtgggggagtgccacgtgaaccgctgcctgtcctggcgggacaacgagaccagcgccgagttctccttcgtcggcgagagcacgaccatgcgcgagaacaagtgcttcgagcagtgcgggggctgggggtgcggctgcttcaacgtgaaccccagctgcctgttcgtgcacacctacctccagtccgtccggaaggaggccctgcgcgtgttcaactgcatcgactgggtgcacaagctgaccctcgagatcacggacttcgacggcagcgtctccaccatcgacctgggggccagctccagccggttcaccaactggggctccgtgagcctgtccctcgacgcggaggggatcagcggctccaacagcttctccttcatcgagagccccgggaagggctacgccatcgtggacgagcccttctccgagatcccgcgccagggcttcctgggggagatccggtgcaacagcgagtccagcgtcctgtccgcccacgagagctgcctccgcgcccccaacctgatcagctacaagcccatgatcgaccagctggagtgctccaccaacctcatcgaccccttcgtggtgttcaagcggggcagcctgccgcagacccgcaacgacaagacgttcgccgcgtccaaggggaaccggggcgtccaggccttcagcaaggggtccgtgcaggccgacctgaccctcatgttcgacaacttcgaggtggacttcgtcggcgccgccgtgagctgcgacgcggccttcctgaacctgaccggctgctactcctgcaacgccggggcccgcgtgtgcctcagcatcacctccacgggcaccgggaccctgagcgcccacaacaaggacggctccctgcacatcgtcctccccagcgagaacgggaccaaggaccagtgccagatcctgcacttcacggtgcccgaggtggaggaggagttcatgtactcctgcgacggcgacgagcggcccctgctcgtccgcggcaccctgatcgcgatcgacccgttcgacgaccggcgcgaggccgggggcgagagcaccgtggtgaaccccaagtccgggagctggaacttcttcgactggttctccggcctgatgagctggttcggcgggcccctcaagaccatcctgctgatctgcctctacgtcgccctgtccatcggcctgttcttcctcctgatctacctggggcggacgggcctcagcaagatgtggctggccgcgaccaagaaggccagctga

SEQ ID NO: 12940 - RNA, 3204 nt, synthetic construct
  misc_feature 1..3204: note = derived and/or modified CDS sequence (opt1) from RVFV(KEN/Kil-006/07)__HM586966.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgccgacggcaacaagtgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgccggacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagcccatccagcgggtggagccgtgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtaccccgggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccgggtcctcaagtgcctgaagatcgcgccccgcaaggtgctgaacccgctcatgtggatcaccgccttcatccggtgggtgtacaagaagatggtcgcccgcgtggccgacaacatcaaccaggtgaaccgggagatcggctggatggagggcgggcagctggccctggggaaccccgcccccatcccccgccacgcgccgatcccccggtactccacgtacctcatgctgctgctcatcgtcagctacgccagcgcctgctccgagctgatccaggccagctcccgcatcacgacctgcagcaccgagggcgtgaacaccaagtgccggctgtccggcaccgccctcatccgcgcggggagcgtgggcgccgaggcctgcctgatgctgaagggggtcaaggaggaccagaccaagttcctcaagatcaagaccgtgtccagcgagctgtcctgccgggagggccagagctactggacgggctccttcagccccaagtgcctgtccagccgccggtgccacctggtgggggagtgccacgtcaaccgctgcctctcctggcgcgacaacgagaccagcgccgagttctccttcgtgggcgagagcaccaccatgcgggagaacaagtgcttcgagcagtgcgggggctgggggtgcggctgcttcaacgtgaacccgagctgcctgttcgtccacacgtacctgcagtccgtgcgcaaggaggcgctccgggtgttcaactgcatcgactgggtccacaagctgaccctggagatcaccgacttcgacggcagcgtgtccaccatcgacctcggggccagctccagccgcttcaccaactggggctccgtgagcctgtccctggacgccgaggggatcagcggctccaacagcttctccttcatcgagagccccgggaagggctacgccatcgtcgacgagcccttctccgagatcccccggcagggcttcctcggggagatccgctgcaacagcgagtccagcgtgctgtccgcccacgagagctgcctgcgggcgccgaacctcgtgagctacaagcccatgatcgaccagctggagtgcacgaccaacctgatcgaccccttcgtcgtgttcgagcgcggctccctcccccagacccggaacgacaagaccttcgccgccagcaaggggaaccgcggcgtgcaggccttctccaaggggagcgtccaggccgacctgacgctgatgttcgacaacttcgaggtggacttcgtgggcgcggccgtctcctgcgacgccgccttcctcaacctgaccggctgctacagctgcaacgccggggcgcgggtgtgcctgtccatcaccagcaccggcacggggaccctctccgcccacaacaaggacggcagcctgcacatcgtgctgccgtccgagaacgggaccaaggaccagtgccagatcctccacttcaccgtccccgaggtggaggaggagttcatgtacagctgcgacggcgacgagcgccccctgctggtgaagggcacgctcatcgccatcgaccccttcgacgaccggcgcgaggccgggggcgagtccaccgtcgtgaaccccaagagcgggtcctggaacttcttcgactggttcagcggcctgatgtcctggttcggcgggcccctgaagaccatcctcctgatctgcctgtacgtggcgctcagcatcggcctgttcttcctgctcatctacctggggcggaccggcctgtccaagatgtggctcgccgccacgaagaaggccagctga

SEQ ID NO: 12941 - RNA, 3204 nt, synthetic construct
  misc_feature 1..3204: note = derived and/or modified CDS sequence (opt1) from RVFV(MgH824)__DQ380210.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggctacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcgcaagggccagtacaaggggaccatggactccggccagaccaagcgggagctcaagagcttcgacatctcccagtgccccaagatcgggggccacggcagcaagaagtgcacgggggacgcggccttctgctccgcctacgagtgcaccacccagtacgccaacgcctactgcagccacgcgaacggcagcggggtggtgcagatccaggtctccggcgtgtggaagaagcccctgtgcgtggggtacgagcgcgtcgtggtgaagcgggagctgagcgccaagccgatccagcgcgtcgagccctgcaccacgtgcatcaccaagtgcgagccccacggcctggtggtccggtccaccggcttcaagatcagctccgccgtggcctgcgccagcggggtgtgcgtcaccggctcccagagcccctccacggagatcaccctcaagtacccggggatcagccagtccagcggcggggacatcggcgtgcacatggcgcacgacgaccagtccgtgagctccaagatcgtcgcccactgcccgccccaggacccctgcctggtgcacggctgcatcgtgtgcgcccacgggctgatcaactaccagtgccacaccgccctcagcgcgttcgtcgtggtgttcgtcttctccagcatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaaccccgcccccatcccgcggcacgcccccatcccccgctactccacgtacctcatgctgctgctcatcgtgagctacgccagcgcgtgctccgagctgatccaggccagctcccggatcacgacctgcagcaccgagggcgtggacaccaagtgccgcctgtccggcaccgccctcatccgggccgggagcgtcggcgccgaggcgtgcctgatgctgaagggggtgaaggaggaccagaccaagttcctcaagatcaagaccgtgtccagcgagctgtcctgccgcgagggccagagctactggacgggctccttcagcccgaagtgcctgtccagccggcgctgccacctggtcggggagtgccacgtgaaccgctgcctctcctggcgggacaacgagaccagcgccgagttctccttcgtgggcgagagcaccaccatgcgcgagaacaagtgcttcgagcagtgcgggggctgggggtgcggctgcttcaacgtcaaccccagctgcctgttcgtgcacacgtacctgcagtccgtgcggaaggaggccctccgcgtcttcaactgcatcgactgggtgcacaagctgaccctggagatcaccgacttcgacggcagcgtgtccaccatcgacctcggggccagctccagccggttcaccaactggggctccgtcagcctgtccctggacgcggaggggatcagcggctccaacagcttctccttcatcgagagccccgggaagggctacgccatcgtggacgagcccttcccggagatcccccgccagggcttcctcggggagatccggtgcaactccgagagctccgtgctgagcgcccacgagtcctgcctgcgcgcccccaacctcatcagctacaagcccatgatcgaccagctggagtgcacgaccaacctgatcgacccgttcgtcgtgttcgagcggggcagcctcccccagacccgcaacgacaagaccttcgccgcgtccaaggggaaccggggcgtgcaggccttcagcaaggggtccgtccaggccgacctgacgctgatgttcgacaacttcgaggtggacttcgtgggcgccgccgtcagctgcgacgcggccttcctcaacctgaccggctgctactcctgcaacgccggggcccgcgtgtgcctgagcatcacctccaccggcacggggagcctctccgcccacaacaaggacggcagcctgcacatcgtgctgccctccgagaacgggaccaaggaccagtgccagatcctccacttcaccgtccccgaggtggaggaggagttcatgtacagctgcgacggcgacgagcggccgctgctggtgaagggcaccctcatcgcgatcgaccccttcgacgaccgccgggaggccgggggcgagtccacggtcgtgaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcgcaccggcctgtccaagatgtggctcgccgcgaccaagaaggccagctga

SEQ ID NO: 12942 - RNA, 3204 nt, synthetic construct
  misc_feature 1..3204: note = derived and/or modified CDS sequence (opt1) from RVFV(KEN/Mal-032/07)__HM586967.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggcgcctgcaggaggacgcgacctgcaagcccgtcacgtacgccggcgcctgcagctccttcgacgtgctgctggagaaggggaagttccccctcttccagagctacgcccaccaccggaccctgctggaggcggtgcacgacaccatcatcgccaaggccgacccgccctcctgcgacctccagagcgccgacggcaacaagtgcatgaaggagaagctggtcatgaagacccactgccccaacgactaccagtccgcccactacctgaacaacgacggcaagatggcgagcgtgaagtgcccgcccaagtacgagctcacggaggactgcaacttctgccgccagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcaccgcccacgaggtggtccccttcgccgtgttcaagaactccaagaaggtgtacctggacaagctggacctcaagacggaggagaacctgctgccggacagcttcgtctgcttcgagcacaagggccagtacaaggggaccatggactccggccagaccaagcgggagctcaagagcttcgacatctcccagtgccccaagatcgggggccacggcagcaagaagtgcaccggggacgcggccttctgctccgcctacgagtgcacggcccagtacgccaacgcgtactgcagccacgccaacggcagcgggatcgtgcagatccaggtgtccggcgtctggaagaagcccctgtgcgtggggtacgagcgcgtggtcgtgaagcgggagctgagcgccaagcccatccagcgcgtggagccgtgcacgacctgcatcaccaagtgcgagccccacggcctcgtcgtgcggtccaccggcttcaagatcagctccgccgtcgcctgcgcgagcggggtgtgcgtgaccggctcccagagcccctccaccgagatcaccctgaagtaccccgggatcagccagtccagcggcggggacatcggcgtccacatggcccacgacgaccagtccgtgagctccaagatcgtggcccactgcccgccccaggacccctgcctggtccacggctgcatcgtgtgcgcccacgggctcatcaactaccagtgccacacggcgctgagcgccttcgtggtcatcttcgtgttctccagcaccgccatcatctgcctggccgtgctctaccgcgtcctgaagtgcctgaagatcgccccgcggaaggtgctcaacccgctgatgtggatcaccgcgttcatccgctgggtgtacaagaagatggtcgcccgggtggccgacaacatcaaccaggtgaaccgcgagatcggctggatggagggcgggcagctggccctcgggaaccccgcccccatcccccggcacgcgccgatcccccgctactccacctacctgatgctgctcctgatcgtcagctacgccagcgcctgctccgagctgatccaggccagctcccggatcacgacctgcagcaccgagggcgtgaacaccaagtgccgcctctccggcacggccctgatccgggcggggagcgtgggcgccgaggcctgcctgatgctcaagggggtcaaggaggaccagaccaagttcctgaagatcaagaccgtgtccagcgagctgtcctgccgcgagggccagagctactggaccggctccttcagccccaagtgcctgtccagccggcgctgccacctcgtgggggagtgccacgtcaaccgctgcctgtcctggcgggacaacgagacgagcgccgagttctccttcgtgggcgagagcaccaccatgcgcgagaacaagtgcttcgagcagtgcgggggctgggggtgcggctgcttcaacgtgaacccgagctgcctgttcgtccacacctacctccagtccgtgcggaaggaggcgctgcgcgtgttcaactgcatcgactgggtccacaagctgacgctcgagatcaccgacttcgacggcagcgtgtccaccatcgacctgggggccagctccagccggttcaccaactggggctccgtgagcctgtccctcgacgccgaggggatcagcggctccaacagcttctccttcatcgagagccccgggaagggctacgccatcgtcgacgagcccttctccgagatcccccgccagggcttcctgggggagatccggtgcaacagcgagtccagcgtgctgtccgcccacgagagctgcctccgcgcgccgaacctggtgagctacaagcccatgatcgaccagctggagtgcaccacgaacctcatcgaccccttcgtcgtgttcgagcggggctccctgccccagacccgcaacgacaagaccttcgccgccagcaaggggaaccggggcgtgcaggccttctccaaggggagcgtccaggccgacctgaccctcatgttcgacaacttcgaggtggacttcgtgggcgcggccgtctcctgcgacgccgccttcctgaacctgacgggctgctacagctgcaacgccggggcgcgcgtgtgcctctccatcaccagcaccggcaccgggacgctgtccgcccacaacaaggacggcagcctgcacatcgtgctcccgtccgagaacgggaccaaggaccagtgccagatcctgcacttcaccgtccccgaggtggaggaggagttcatgtacagctgcgacggcgacgagcggcccctgctcgtgaagggcaccctgatcgccatcgaccccttcgacgaccgccgggaggccgggggcgagtccacggtcgtgaaccccaagagcgggtcctggaacttcttcgactggttcagcggcctgatgtcctggttcggcgggcccctcaagaccatcctgctgatctgcctctacgtggcgctgagcatcggcctgttcttcctcctgatctacctggggcgcaccggcctctccaagatgtggctggccgccaccaagaaggccagctga

SEQ ID NO: 12943 - RNA, 3204 nt, synthetic construct
  misc_feature 1..3204: note = derived and/or modified CDS sequence (opt1) from RVFV(Kenya 56 (IB8))__DQ380190.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccagggcgacgcgacgtgcaagcccgtcacctacgccggggcctgcagctccttcgacgtgctgctggagaagggcaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaaggactaccagtccgcccactacctgaacaacgacgggaagatggcgagcgtgaagtgcccgcccaagtacgagctgaccgaggactgcaacttctgccggcagatgaccggcgcctccctcaagaaggggagctaccccctgcaggacctgttctgccagtccagcgaggacgacggctccaagctcaagaccaagatgaagggggtgtgcgaggtcggcgtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaaggggcagtacaagggcaccatggactccgggcagaccaagcgcgagctcaagagcttcgacatctcccagtgccccaagatcggcggccacgggagcaagaagtgcacgggcgacgcggccttctgctccgcctacgagtgcaccgcccagtacgccaacgcgtactgcagccacgccaacgggagcggcatcgtgcagatccaggtgtccggggtctggaagcggcccctgtgcgtgggctacgagcgcgtggtcgtgaagcgggagctgagcgccaagccgatccagcgcgtggagccctgcacgacctgcatcaccaagtgcgagccccacggcctggtcgtgcggtccaccgggttcaagatcagctccgccgtcgcctgcgcgagcggcgtgtgcgtgaccgggtcccagagcccctccaccgagatcacgctcaagtacccgggcatgagccagtccagcgggggcgacatcggcgtccacatggcccacgacgaccagtccgtgagctccaagatcgtggcccactgcccgccccaggacccctgcctggtccacgggtgcatcgtgtgcgcccacggcctgatcaactaccagtgccacaccgcgctcagcgccttcgtggtcgtgttcgtgttctccagcgtcgccatcatctgcctggccatcctgtacaaggtgctcaagtgcctgaagatcgcgccccgcaaggtgctgaaccccctcatgtggatcaccgccttcatccggtgggtctacaagaagatggtggcccgcgtggccgacaacatcaaccaggtcaaccgggagatcgggtggatggagggcgggcagcccgccctgggcaaccccgccccgatcccccgccacgcgcccatcccgcggtactccacctacctgatgctcctgctgatcgtgagctacgccagcgcctgctccgagctcatccaggccagctcccgcatcacgacctgcagcaccgagggcgtgaacaccaagtgccggctgtccgggacggccctgatccgcgcgggcagcgtcggggccgaggcctgcctcatgctgaagggcgtgaaggaggaccagaccaagttcctgaagatcaagaccgtgtccagcgagctctcctgccgggagggccagagctactggaccgggtccttcagccccaagtgcctgtccagccgccggtgccacctggtcggcgagtgccacgtgaaccgctgcctgtcctggcgcgacaacgagacgagcgccgagttctccttcgtgggggagagcaccaccatgcgggagaacaagtgcttcgagcagtgcggcgggtggggctgcggctgcttcaacgtcaaccccagctgcctcttcgtgcacacctacctgcagtccgtgcgcaaggaggcgctgcgggtcttcaactgcatcgactgggtgcacaagctcacgctggagatcaccgacttcgacgggagcgtgtccaccatcgacctgggcgccagctccagccgcttcaccaactgggggtccgtcagcctctccctggacgccgagggcatcagcgggtccaacagcttctccttcatcgagagccccggcaagggctacgccatcgtggacgagccgttctccgagatcccccggcaggggttcctgggcgagatccgctgcaacagcgagtccagcgtgctctccgcccacgagagctgcctgcgggcgcccaacctgatcagctacaagcccatgatcgaccagctcgagtgcaccacgaacctgatcgacccgttcgtcgccttcgagcgcgggtccctgccccagacccggaacgacaagaccttcgccgccagcaagggcaaccgcggggtgcaggccttctccaagggcagcgtgcaggcggacctcaccctgatgttcgacaacttcgaggtcgacttcgtgggcgccgccgtgtcctgcgacgccgccttcctgaacctcacggggtgctacagctgcaacgcgggcgcccgggtctgcctgtccatcaccagcaccgggaccggcacgctgtccgcccacaacaaggacgggagcctccacatcgtgctgccctccgagaacggcaccaaggaccagtgccagatcctgcacttcaccgtgcccgaggtcgaggaggagttcatgtacagctgcgacggcgacgagcgcccgctcctggtgaaggggaccctgatcgccatcgaccccttcgacgaccggcgcgaggcgggcggggagtccacggtggtcaaccccaagagcggctcctggaacttcttcgactggttcagcggcctcatgtcctggttcgggggccccctgaagaccatcctgctcatctgcctgtacgtggccctgagcatcggcctcttcttcctgctgatctacctcgggcggaccgggctgtccaagatgtggctggccgccaccaagaaggccagctga

SEQ ID NO: 12944 - RNA, 3204 nt, synthetic construct
  misc_feature 1..3204: note = derived and/or modified CDS sequence (opt1) from RVFV(KEN/Gar-008/06)__HM586965.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgcccgaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtcccgggtctggaagaagcccctgtgcgtgggctacgagcgcgtggtcgtgaagcgggagctgagcgccaagccgatccagcgcgtggagccctgcacgacctgcatcaccaagtgcgagccccacgggctggtcgtgcggtccaccggcttcaagatcagctccgccgtcgcctgcgcgagcggcgtgtgcgtgaccgggtcccagagcccctccaccgagatcacgctcaagtacccgggcatcagccagtccagcgggggcgacatcggggtccacatggcccacgacgaccagtccgtgagctccaagatcgtggcccactgcccgccccaggacccctgcctggtccacggctgcatcgtgtgcgcccacggcctgatcaactaccagtgccacaccgcgctcagcgccttcgtggtcatcttcgtgttctccagcaccgccatcatctgcctggccgtgctgtaccgcgtcctcaagtgcctgaagatcgcgccccggaaggtgctgaaccccctcatgtggatcaccgccttcatccgctgggtgtacaagaagatggtcgcccgggtggccgacaacatcaaccaggtgaaccgcgagatcgggtggatggagggcgggcagctggccctgggcaaccccgcccccatcccgcggcacgcgcccatcccccgctactccacgtacctcatgctgctgctcatcgtcagctacgccagcgcctgctccgagctgatccaggccagctcccggatcacgacctgcagcaccgagggggtgaacaccaagtgccgcctgtccggcaccgccctcatccgggcgggcagcgtgggggccgaggcctgcctgatgctgaagggcgtcaaggaggaccagaccaagttcctcaagatcaagaccgtgtccagcgagctgtcctgccgcgaggggcagagctactggacgggctccttcagcccgaagtgcctgtccagccggcgctgccacctggtgggcgagtgccacgtcaaccgctgcctctcctggcgggacaacgagaccagcgccgagttctccttcgtgggggagagcaccaccatgcgcgagaacaagtgcttcgagcagtgcggcgggtggggctgcgggtgcttcaacgtgaaccccagctgcctgttcgtccacacgtacctgcagtccgtgcggaaggaggcgctccgcgtgttcaactgcatcgactgggtccacaagctgaccctggagatcaccgacttcgacggcagcgtgtccaccatcgacctcggcgccagctccagccggttcaccaactgggggtccgtgagcctgtccctggacgccgagggcatcagcgggtccaacagcttctccttcatcgagagccccggcaaggggtacgccatcgtcgacgagcccttctccgagatcccgcgccagggcttcctcggcgagatccggtgcaacagcgagtccagcgtgctgtccgcccacgagagctgcctgcgcgcgcccaacctcgtgagctacaagcccatgatcgaccagctggagtgcacgaccaacctgatcgaccccttcgtcgtgttcgagcgggggtccctcccgcagacccgcaacgacaagaccttcgccgccagcaagggcaaccgcggggtgcaggccttctccaagggcagcgtccaggccgacctgacgctgatgttcgacaacctcaaggtggacttcgtgggggcggccgtctcctgcgacgccgccttcctgaacctgaccggctgctacagctgcaacgccggcgcgcgggtgtgcctctccatcaccagcaccgggacgggcaccctgtccgcccacaacaaggacgggagcctgcacatcgtgctcccctccgagaacggcaccaaggaccagtgccagatcctgcacttcaccgtccccgaggtgaaggaggagttcatgtacagctgcgacggggacgagcgggccctgctcatgaagggcacgctgatcgccatcgaccccttcgacgaccgccgggaggcgggcggggagtccaccgtggtcaaccccaagagcggctcctggaacttcttcgactggttcagcgggctgatgtcctggttcggcggccccctcaagaccatcctgctgatctgcctctacgtggccctgagcatcgggctgttcttcctcctgatctacctgggccgcaccgggctctccaagatgtggctggccgccacgaagaaggccagctga

SEQ ID NO: 12945 - RNA, 3204 nt, synthetic construct
  misc_feature 1..3204: note = derived and/or modified CDS sequence (opt1) from RVFV(KEN/Bar-035/07)__HM586969.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggcgcctgcaggaggacgcgacctgcaagcccgtcacgtacgccggcgcctgcagctccttcgacgtgctgctggagaaggggaagttccccctcttccagagctacgcccaccaccggaccctgctggaggcggtgcacgacaccatcatcgccaaggccgacccgccctcctgcgacctccagagcgccgacggcaacaagtgcatgaaggagaagctggtcatgaagacccactgccccaacgactaccagtccgcccactacctgaacaacgacggcaagatggcgagcgtgaagtgcccgcccaagtacgagctcacggaggactgcaacttctgccgccagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcaccgcccacgaggtggtccccttcgccgtgttcaagaactccaagaaggtgtacctggacaagctggacctcaagacggaggagaacctgctgccggacagcttcgtctgcttcgagcacaagggccagtacaaggggaccatggactccggccagaccaagcgggagctcaagagcttcgacatctcccagtgccccaagatcgggggccacggcagcaagaagtgcaccggggacgcggccttctgctccgcctacgagtgcacggcccagtacgccaacgcgtactgcagccacgccaacggcagcgggatcgtgcagatccaggtgtccggcgtctggaagaagcccctgtgcgtggggtacgagcgcgtggtcgtgaagcgggagctgagcgccaagcccatccagcgcgtggagccgtgcacgacctgcatcaccaagtgcgagccccacggcctcgtcgtgcggtccaccggcttcaagatcagctccgccgtcgcctgcgcgagcggggtgtgcgtgaccggctcccagagcccctccaccgagatcaccctgaagtaccccgggatcagccagtccagcggcggggacatcggcgtccacatggcccacgacgaccagtccgtgagctccaagatcgtggcccactgcccgccccaggacccctgcctggtccacggctgcatcgtgtgcgcccacgggctcatcaactaccagtgccacacggcgctgagcgccttcgtggtcatcttcgtgttctccagcaccgccatcatctgcctggccgtgctctaccgcgtcctgaagtgcctgaagatcgccccgcggaaggtgctcaacccgctgatgtggatcaccgcgttcatccgctgggtgtacaagaagatggtcgcccgggtggccgacaacatcaaccaggtgaaccgcgagatcggctggatggagggcgggcagctggccctcgggaaccccgcccccatcccccggcacgcgccgatcccccgctactccacctacctgatgctgctcctgatcgtcagctacgccagcgcctgctccgagctgatccaggccagctcccggatcacgacctgcagcaccgagggcgtgaacaccaagtgccgcctctccggcacggccctgatccgggcgcgcagcgtgggggccgaggcctgcctgatgctcaagggcgtcaaggaggaccagaccaagttcctgaagatcaagaccgtgtccagcgagctgtcctgccgggaggggcagagctactggaccggctccttcagccccaagtgcctgtccagccgccgctgccacctcgtgggcgagtgccacgtcaaccggtgcctgtcctggcgcgacaacgagacgagcgccgagttctccttcgtgggggagagcaccaccatgcgggagaacaagtgcttcgagcagtgcggcgggtggggctgcgggtgcttcaacgtgaacccgagctgcctgttcgtccacacctacctccagtccgtgcgcaaggaggcgctgcgggtgttcaactgcatcgactgggtccacaagctgacgctcgagatcaccgacttcgacggcagcgtgtccaccatcgacctgggcgccagctccagccgcttcaccaactgggggtccgtgagcctgtccctcgacgccgagggcatcagcgggtccaacagcttctccttcatcgagagccccggcaaggggtacgccatcgtcgacgagcccttctccgagatcccccggcagggcttcctgggcgagatccgctgcaacagcgagtccagcgtgctgtccgcccacgagagctgcctccgggcgccgaacctggtgagctacaagcccatgatcgaccagctggagtgcaccacgaacctcatcgaccccttcgtcgtgttcgagcgcgggtccctgccccagacccggaacgacaagaccttcgccgccagcaagggcaaccgcggggtgcaggccttctccaagggcagcgtccaggccgacctgaccctcatgttcgacaacttcgaggtggacttcgtgggggcggccgtctcctgcgacgccgccttcctgaacctgacgggctgctacagctgcaacgccggcgcgcgggtgtgcctctccatcaccagcaccgggaccggcacgctgtccgcccacaacaaggacgggagcctgcacatcgtgctcccgtccgagaacggcaccaaggaccagtgccagatcctgcacttcaccgtccccgaggtggaggaggagttcatgtacagctgcgacggggacgagcgccccctgctcgtgaagggcaccctgatcgccatcgaccccttcgacgaccggcgcgaggccggcggggagtccacggtcgtgaaccccaagagcggctcctggaacttcttcgactggttcagcgggctgatgtcctggttcggcggccccctcaagaccatcctgctgatctgcctctacgtggcgctgagcatcgggctgttcttcctcctgatctacctgggccggaccgggctctccaagatgtggctggccgccaccaagaaggccagctga

SEQ ID NO: 12946 - RNA, 3204 nt, synthetic construct
  misc_feature 1..3204: note = derived and/or modified CDS sequence (opt1) from RVFV(Smithburn)__DQ380193.1__Gn-Gc
  source 1..3204: mol_type = other RNA
atggccggcatcgccatgaccgtgttccccgcgctggtcgtgttcgccctcgccccggtggtcttcgccgaggacccccacctccgcaaccggcccgggaagggccacaactacatcgacgggatgacccaggaggacgccacgtgcaagcccgtgacctacgcgggcgcctgcagctccttcgacgtgctgctggagaaggggaagttcccgctgttccagagctacgcccaccaccgcaccctgctcgaggccgtccacgacatcatcatcgcgaaggccgacccgccctcctgcaacctgcagagcgcccacggcaacccctgcatgaaggagaagctggtgatgaagacctactgccccaacgactaccagtccgcccactacctcaacaacgacggcaagatggccagcgtgaagtgcccgcccaagcacgagctgacggaggactgcaacttctgccggcagatgaccggggcgtccctgaaggagggcagctaccccctccaggacctgttctgccagtccagcgaggacgacgggtccaagctgaagaccaagatgaagggcgtctgcgaggtgggggtgcaggtcctcaagaagtgcgacggccagctgagcaccgcccacgaggtggtgcccttcgccgtcttcaagaactccaagaaggtgtacctggacaagctcgacctgaagacggaggagaacctgctccccgacagcttcgtgtgcttcgagcacaagggccagtacaaggggaccatggactccggccagatcaagcgcgagctcaagagcttcgacatctcccagtgccccaagatcgggggccacggcagcaagaagtgcaccggggacgccgccttctgctccgcgtacgagtgcaccgcccagtacgccaacgcctactgcagccacgccaacggcagcgggatcgtccagatccaggtgtccggcgtgtggaagaagcccctgtgcgtcgggtacgagcgggtggtggtcaagcgcgagctgagcgcgaagccgatccagcgggtggagccctgcacgacctgcatcaccaagtgcgagccccacggcctggtcgtgcgctccaccggcttcaagatcagctccgccgtggcctgcgccagcggggtctgcgtgacgggctcccagagcccctccaccgagatcaccctgaagtacccggggatcagccagtccagcggcggggacatcggcgtgcacatggcccacgacgaccagtccgtcagctccaagatcgtggcgcactgcccgccccaggacccctgcctcgtgcacggctgcatcgtctgcgcccacgggctgatcaactaccagtgccacaccgccttcagcgccttcgtggtggtcttcgtgttctccagcgtggtcatcatctgcctggcgatcctctacaaggtgctgaagtgcctgaagatcgcgccccggaaggtgctcaaccccctgatgtggatcacggccttcatccgctgggtctacaagaagatggtggcccgggtggccgacaacatcaaccaggtcaaccgcgagatcggctggatggagggcgggcagctggtgctcgggaaccccgcccccatcccgcggcacgcccccatcccccgctactccacctacctgatgctgctcctgatcgtgagctacgccagcgcctgctccgagctgatccaggccagctcccggatcacgacctgcagcaccgagggcgtcaacaccaagtgccgcctctccggcaccgcgctgatccgggccgggagcgtgggcgccgaggcctgcctgatgctcaagggggtgaaggaggaccagaccaagttcctgaagatcaagacggtctccagcgagctgtcctgccgcgagggccagagctactggaccggctccttcagcccgaagtgcctctccagccggcgctgccacctggtgggggagtgccacgtgaaccggtgcctgtcctggcgcgacaacgagaccagcgccgagttctccttcgtcggcgagagcaccacgatgcgcgagaacaagtgcttcgagcagtgcgggggctgggggtgcggctgcttcaacgtgaaccccagctgcctgttcgtgcacacctacctccagtccgtccggaaggaggcgctgcgcgtgttcaactgcatcgactgggtgcacaagctgaccctcgagatcaccgacttcgacggcagcgtctccacggtggacctgggggccagctccagccggttcaccaactggggctccgtgagcctgtccctcgacgccgaggggatcagcggctccaacagcttctccttcatcgagagccccgggaagggctacgccatcgtcgacgagcccttctccgagatcccgcgccagggcttcctgggggagatccggtgcaacagcgagtccagcgtgctgtccgcgcacgagagctgcctccgcgcccccaacctgatcagctacaagcccatgatcgaccagctggagtgcaccaccaacctcatcgaccccttcgtggtcttcgagcggggctccctgccgcagacccgcaacgacaagacgttcgccgccagcaaggggaaccggggcgtgcaggccttctccaaggggagcgtgcaggcggacctgaccctcatgttcgacaacttcgaggtcgacttcgtgggcgccgccgtgtcctgcgacgccgccttcctgaacctgaccggctgctacagctgcaacgcgggggcccgcgtctgcctctccatcaccagcacgggcaccgggaccctgtccgcccacaacaaggacggcagcctgcacatcgtgctcccctccgagaacgggaccaaggaccagtgccagatcctgcacttcacggtgcccgaggtcgaggaggagttcatgtacagctgcgacggcgacgagcggcccctgctcgtgaagggcaccctgatcgccatcgacccgttcgacgaccgccgggaggccgggggcgagtccaccgtcgtgaaccccaagagcgggtcctggaacttcttcgactggttcagcggcctgatgtcctggttcggcgggcccctcaagaccatcctgctgatctgcctctacgtggcgctgagcatcggcctgttcttcttcctcatctacctggggcgcacgggcctgtccaagatgtggctcgccgccaccaagaaggccagctga

SEQ ID NO: 12947 - RNA, 3204 nt, synthetic construct
  misc_feature 1..3204: note = derived and/or modified CDS sequence (opt1) from RVFV(Beijing-01)__KX611606.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacggggtcacccaggaggacgcgacgtgcaagcccgtgacctacgccggcgcctgcagctccttcgacgtgctgctggagaaggggaagttcccgctgttccagagctacgcccaccaccgcaccctcctggaggcggtccacgacaccatcatcgccaaggccgacccgccctcctgcgacctgcagagcgcccacggcaacccctgcatgaaggagaagctcgtgatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtctgcgaggtgggggtgcaggccctgaagaagtgcgacggccgcctgagcacggcccacgaggtcgtgcccttcgccgtgttcaagaactccaagaaggtctacctcgacaagctggacctgaagaccgaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtctccggcgtgtggaagaagcccctgtgcgtggggtacgagcgcgtcgtggtgaagcgggagctgagcgccaagccgatccagcgcgtcgagccctgcacgacctgcatcaccaagtgcgagccccacggcctggtggtccggtccaccggcttcaagatcagctccgccgtggcctgcgcgagcggggtgtgcgtcaccggctcccagagcccctccaccgagatcacgctcaagtacccggggatcagccagtccagcggcggggacatcggcgtgcacatggcccacgacgaccagtccgtgagctccaagatcgtcttcgactgcccgccccaggacccctgcctggtgcacggctgcatcgtgtgcgcccacgggctgatcaactaccagtgccacaccgccctcagcgcgttcgtcgtggtgttcgtcttctccagcgtggccatcatctgcctggccatcctgtacaaggtgctccgctgcctgaagatcgcccccaagaaggtcctgaaccccctcatgtggatcaccgccttcatccggtgggtgtacaagaagatggtggcgcgcgtcgccgacaacatcaaccaggtgaaccgggagatcggctggatggagggcgggcagctggccctggggaaccccgcccccatcccgcgccacgcccccatcccccggtactccacctacctcatgctgctgctcatcatcagctacgcgagcgcctgctccgagctgatccaggccagctcccgcatcacgacctgcagcaccgagggcgtgaacaccaagtgccggctgtccggcacggccctcatccgcgccgggagcgtcggcgcggaggcctgcctgatgttcgagggggtgaaggaggaccagaccaagttcctgaagatcaagaccgtgtccagcgagctctcctgccgggagggccagagctactggaccggctccttcagcccgaagtgcctgtccagccgccggtgccacctggtcggggagtgccacgtgaaccgctgcctgtcctggcgcgacaacgagacgagcgccgagttctccttcgtgggcgagagcaccaccatgcgggagaacaagtgcttcgagcagtgcgggggctgggggtgcggctgcttcaacgtcaaccccagctgcctcttcgtgcacacctacctgcagtccgtgcgcaaggaggccctgcgggtcttcaactgcatcgactgggtgcacaagctcacgctggagatcaccgacttcgacggcagcgtgtccaccatcgacctgggggcgagctccagccgcttcaccaactggggctccgtcagcctctccctggacgccgaggggatcagcggctccaacagcttctccttcatcgagagccccgggaagggctacgccatcgtggacgagcccttctccgagatcccgcggcagggcttcctgggggagatccgctgcaacagcgagtccagcgtgctctccgcccacgagagctgcctgcgggcccccaacctgatcagctacaagcccatgatcgaccagctcgagtgcaccacgaacctgatcgaccccttcgtcgtgttcgagcgcggctccctgccgcagacccggaacgacaagaccttcgcggccagcaaggggaaccgcggcgtgcaggccttctccaaggggagcgtccaggccgacctcaccctgatgttcgacaacttcgaggtggacttcgtgggcgccgcggtctcctgcgacgccgccttcctgaacctcacgggctgctacagctgcaacgccggggcccgggtgtgcctgtccatcaccagcaccggcaccgggacgctgtccgcgcacaacaaggacggcagcctccacatcgtgctgccctccgagaacgggaccaaggaccagtgccagatcctgcacttcaccgtccccgaggtggaggaggagttcatgtacagctgcgacggcgacgagcgccccctcctggtgaagggcaccctgatcgccatcgacccgttcgacgaccggcgcgaggccgggggcgagtccacggtcgtgaaccccaagagcgggtcctggaacttcttcgactggttcagcggcctcatgtcctggttcggcgggcccctgaagaccatcctgctcatctgcctgtacgtggccctgagcatcggcctcttcttcctgctgatctacctcgggcggaccggcctgtccaagatgtggctggcggccaccaagaaggccagctga

SEQ ID NO: 12948 - RNA, 3204 nt, synthetic construct
  misc_feature 1..3204: note = derived and/or modified CDS sequence (opt1) from RVFV(KEN/Bar-032/07)__HM586968.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggcgcctgcaggaggacgcgacctgcaagcccgtcacgtacgccggcgcctgcagctccttcgacgtgctgctggagaaggggaagttccccctcttccagagctacgcccaccaccggaccctgctggaggcggtgcacgacaccatcatcgccaaggccgacccgccctcctgcgacctccagagcgccgacggcaacaagtgcatgaaggagaagctggtcatgaagacccactgccccaacgactaccagtccgcccactacctgaacaacgacggcaagatggcgagcgtgaagtgcccgcccaagtacgagctcacggaggactgcaacttctgccgccagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcaccgcccacgaggtggtccccttcgccgtgttcaagaactccaagaaggtgtacctggacaagctggacctcaagacggaggagaacctgctgccggacagcttcgtctgcttcgagcacaagggccagtacaaggggaccatggactccggccagaccaagcgggagctcaagagcttcgacatctcccagtgccccaagatcgggggccacggcagcaagaagtgcaccggggacgcggccttctgctccgcctacgagtgcacggcccagtacgccaacgcgtactgcagccacgccaacggcagcgggatcgtgcagatccaggtgtccggcgtctggaagaagcccctgtgcgtggggtacgagcgcgtggtcgtgaagcgggagctgagcgccaagcccatccagcgcgtggagccgtgcacgacctgcatcaccaagtgcgagccccacggcctcgtcgtgcggtccaccggcttcaagatcagctccgccgtcgcctgcgcgagcggggtgtgcgtgaccggctcccagagcccctccaccgagatcaccctgaagtaccccgggatcagccagtccagcgtcggcgacatcggggtgcacatggcccacgacgaccagtccgtgagctccaagatcgtcgcccactgcccgccccaggacccctgcctggtgcacggctgcatcgtgtgcgcccacggcctcatcaactaccagtgccacacggcgctgagcgccttcgtcgtgatcttcgtgttctccagcaccgccatcatctgcctggccgtcctctaccgcgtgctgaagtgcctgaagatcgccccgcggaaggtgctcaacccgctgatgtggatcaccgcgttcatccgctgggtctacaagaagatggtggcccgggtggccgacaacatcaaccaggtcaaccgcgagatcgggtggatggagggcgggcagctggccctcggcaaccccgcccccatcccccggcacgcgccgatcccccgctactccacctacctgatgctgctcctgatcgtgagctacgccagcgcctgctccgagctgatccaggccagctcccggatcacgacctgcagcaccgagggggtgaacaccaagtgccgcctctcccacacggccctgatccgggcgggcagcgtcggcgccgaggcctgcctgatgctcaagggggtgaaggaggaccagaccaagttcctgaagatcaagaccgtgtccagcgagctgtcctgccgcgagggccagagctactggaccgggtccttcagccccaagtgcctgtccagccggcgctgccacctcgtcggcgagtgccacgtgaaccgctgcctgtcctggcgggacaacgagacgagcgccgagttctccttcgtgggcgagagcaccaccatgcgcgagaacaagtgcttcgagcagtgcgggggctgggggtgcggctgcttcaacgtcaacccgagctgcctgttcgtgcacacctacctccagtccgtgcggaaggaggcgctgcgcgtcttcaactgcatcgactgggtgcacaagctgacgctcgagatcaccgacttcgacgggagcgtgtccaccatcgacctgggcgccagctccagccggttcaccaactggggctccgtcagcctgtccctcgacgccgaggggatcagcggctccaacagcttctccttcatcgagagccccgggaagggctacgccatcgtggacgagcccttctccgagatcccccgccaggggttcctgggcgagatccggtgcaacagcgagtccagcgtgctgtccgcccacgagagctgcctccgcgcgccgaacctggtcagctacaagcccatgatcgaccagctggagtgcaccacgaacctcatcgaccccttcgtggtgttcgagcggggctccctgccccagacccgcaacgacaagaccttcgccgccagcaaggggaaccggggcgtccaggccttctccaaggggagcgtgcaggccgacctgaccctccgcttcgacaacttcgaggtggacttcgtcggcgcggccgtgtcctgcgacgccgccttcctgaacctgacggggtgctacagctgcaacgccggcgcgcgggtgtgcctctccatcaccagcaccggcaccgggacgctgtccgcccacaacaaggacggcagcctgcacatcgtcctcccgtccgagaacgggaccaaggaccagtgccagatcctgcacttcaccgtgcccgaggtggaggaggagttcatgtacagctgcgacggcgacgagcgccccctgctcgtcaaggggaccctgatcgccatcgaccccttcgacgaccggcgcgaggccggcggcgagtccacggtggtgaaccccaagagcgggtcctggaacttcttcgactggttcagcggcctgatgtcctggttcgggggccccctcaagaccatcctgctgatctgcctctacgtcgcgctgagcatcggcctgttcttcctcctgatctacctggggcggaccggcctctccaagatgtggctggccgccaccaagaaggccagctga

SEQ ID NO: 12949 - RNA, 3204 nt, synthetic construct
  misc_feature 1..3204: note = derived and/or modified CDS sequence (opt1) from RVFV(TAN/Dod-002/07)__HM586971.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctcctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggccggaagaagtgcacgggggacgcggccttctgcagcgcctacgagtgcaccgcccagtacgccaacgcgtactgctcccacgccaacggcagcgggatcgtgcagatccaggtgagcggcgtctggaagaagcccctgtgcgtggggtacgagcgcgtggtcgtgaagcgggagctgtccgccaagccgatccagcgcgtggagccctgcacgacctgcatcaccaagtgcgagccccacggcctggtcgtgcggagcaccggcttcaagatctccagcgccgtcgcctgcgcgtccggggtgtgcgtgaccggcagccagtcccccagcaccgagatcacgctcaagtacccggggatctcccagagctccggcggggacatcggcgtccacatggcccacgacgaccagagcgtgtccagcaagatcgtggcccactgcccgccccaggacccctgcctggtccacggctgcatcgtgtgcgcccaggcgtggatcatctcccagtggcacaccgccctgagcgccttcgtggtcatcttcgtgttctccagcaccgccatcatctgcctcgccgtgctgtaccgcgtcctgaagtgcctcaagatcgcgccccggaaggtgctgaaccccctgatgtggatcaccgccttcatccgctgggtgtacaagaagatggtcgcccgggtggccgacaacatcaaccaggtgaaccgcgagatcgggtggatggagggcgggcagctcgccctgggcaaccccgcgcccatcccgcggcacgcccccatcccccgctactccacgtacctgatgctcctgctgatcgtcagctacgccagcgcctgctccgagctcatccaggccagctcccggatcacgacctgcagcaccgagggggtgaacaccaagtgccgcctgtccggcaccgcgctgatccgggccggcagcgtgggggccgaggcctgcctcatgctgaagggcgtcaaggaggaccagaccaagttcctgaagatcaagaccgtgtccagcgagctctcctgccgcgaggggcagagctactggacgggctccttcagcccgaagtgcctgtccagccggcgctgccacctggtgggcgagtgccacgtcaaccgctgcctgtcctggcgggacaacgagaccagcgcggagttctccttcgtgggggagagcaccaccatgcgcgagaacaagtgcttcgagcagtgcggcgggtggggctgcgggtgcttcaacgtgaaccccagctgcctcttcgtccacacgtacctgcagtccgtgcggaaggaggccctgcgcgtgttcaactgcatcgactgggtccacaagctcaccctggagatcaccgacttcgacggcagcgtgtccaccatcgacctgggcgccagctccagccggttcaccaactgggggtccgtgagcctctccctggacgccgagggcatcagcgggtccaacagcttctccttcatcgagagccccggcaaggggtacgccatcgtcgacgagcccttctccgagatcccgcgccagggcttcctgggcgagatccggtgcaacagcgagtccagcgtgctctccgcgcacgagagctgcctgcgcgcccccaacctggtgagctacaagcccatgatcgaccagctcgagtgcacgaccaacctgatcgaccccttcgtcgtgttcgagcgggggtccctgccgcagacccgcaacgacaagaccttcgccgccagcaagggcaaccgcggggtgcaggccttctccaagggcagcgtccaggcggacctcacgctgatgttcgacaacttcgaggtggacttcgtgggggccgccgtctcctgcgacgccgccttcctgaacctcaccggctgctacagctgcaacgcgggcgcccgggtgtgcctgtccatcaccagcaccgggacgggcaccctgtccgcccacaacaaggacgggagcctccacatcgtgctgccctccgagaacggcaccaaggaccagtgccagatcctgcacttcaccgtccccgaggtggaggaggagttcatgtacagctgcgacggggacgagcggcccctcctggtgaagggcacgctgatcgccatcgacccgttcgacgaccgccgggaggcgggcggggagtccaccgtcgtgaaccccaagagcggctcctggaacttcttcgactggttcagcgggctcatgtcctggttcggcggccccctgaagaccatcctgctcatctgcctgtacgtggccctgagcatcgggctgttcttcctgctgatctacctcggccgcaccgggctgtccaagatgtggctggccgccacgaagaaggccagctga

SEQ ID NO: 12950 - RNA, 3204 nt, synthetic construct
  misc_feature 1..3204: note = derived and/or modified CDS sequence (opt1) from RVFV(KEN/Gar-004/06)__HM586964.1__Gn-Gc
  source 1..3204: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactcccagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggccggaagaagcgcacgggggacgcggccttctgcagcgcctacgagtgcaccgcccagtacgccaacgcgtactgctcccgggccaacggcagcgggatcgtgcagatccaggtgagccgcgtctggaagaagcccctgtgcgtgggctacgagcgggtggtcgtgaagcgcgagctgtccgccaagccgatccagcgggtggagccctgcacgacctgcatcaccaagtgcgagccccacgggctggtcgtgcgcagcaccggcttcaagatctccagcgccgtcgcctgcgcgtccggcgtgtgcgtgaccgggagccagtcccccagcaccgagatcacgctcaagtacccgggcatctcccagagctccgggggcgacatcggggtccacatggcccacgacgaccagagcgtgtccagcaagatcgtggcccactgcccgccccaggacccctgcctggtccacggctgcatcgtgtgcgcccacggcctgatcaacaaccagtcccacagcgcgctctccgccttcgtggtcatcttcgtgttcagctccaccgccatcatctgcctggccgtgctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcgggtggatggagggcgggcagctggccctgggcaaccccgcccccatcccgcgccacgcgcccatcccccggtacagcacctacctcatgctgctgctcatcgtcagctacgcctccgcctgcagcgagctgatccaggcctccagccgcatcacgacctgctccaccgagggggtgaacaccaagtgccggctgagcggcacggccctcatccgcgcgggctccgtgggggccgaggcctgcctgatgctgaagggcgtcaaggaggaccagaccaagttcctcaagatcaagaccgtgagctccgagctgagctgccgcgaggggcagtcctactggaccggcagcttctccccgaagtgcctgagctcccggcgctgccacctggtgggcgagtgccacgtcaaccggtgcctcagctggcgcgacaacgagacgtccgccgagttcagcttcgtgggggagagcaccaccatgcgggagaacaagtgcttcgagcagtgcggcgggtggggctgcgggtgcttcaacgtgaacccctcctgcctgttcgtccacacctacctgcagagcgtgcgcaaggaggcgctccgggtgttcaactgcatcgactgggtccacaagctgacgctggagatcaccgacttcgacggctccgtgagcaccatcgacctcggcgcctccagctcccgcttcaccaactgggggagcgtgtccctgagcctggacgccgagggcatctccgggagcaactccttcagcttcatcgagtcccccggcaaggggtacgccatcgtcgacgagcccttcagcgagatcccgcggcagggcttcctcggcgagatccgctgcaactccgagagctccgtgctgagcgcccacgagagctgcctgcgggcgcccaacctcgtgtcctacaagcccatgatcgaccagctggagtgcaccacgaacctgatcgaccccttcgtcgtgttcgagcgcgggagcctcccgcagacccggaacgacaagaccttcgccgcctccaagggcaaccgcggggtgcaggccttcagcaagggctccgtccaggccgacctgaccctgcggttcgacaacttcgaggtggacttcgtgggggcggccgtcagctgcgacgccgccttcctcaacctgacgggctgctactcctgcaacgccggcgcgcgcgtgtgcctgagcatcacctccaccgggaccggcacgctcagcgcccacaacaaggacgggtccctgcacatcgtgctgcccagcgagaacggcaccaaggaccagtgccagatcctccacttcaccgtccccgaggtggaggaggagttcatgtactcctgcgacggggacgagcggcccctgctggtgaagggcaccctcatcgccatcgacccgttcgacgaccgccgggaggccggcggggagagcacggtcgtgaaccccaagtccggcagctggaacttcttcgactggttctccgggctgatgagctggttcggcggccccctgaagaccatcctcctgatctgcctgtacgtggcgctctccatcgggctgttcttcctgctcatctacctgggccgcaccgggctgagcaagatgtggctcgccgccaccaagaaggccagctga

SEQ ID NO: 12951 - RNA, 1680 nt, synthetic construct
  misc_feature 1..1680: note = derived and/or modified CDS sequence (opt1) from RVFV(ZH-548)__DQ380206.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgctcagcgcccacggcaacccctgcatgaaggagaagctggtcatgaagacgcactgccccaacgactaccagtccgcccactacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcccacggcctcatcaactaccagtgccacaccgcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtggatctacaagaagatggtggcccgcgtcgccgacaacatcaaccaggtgaaccgggagatcgggtggatggagggcgggcagctggtgctcggcaaccccgcccccatcccgcgccacgcccccatcccccggtactccacctacctgatgctgctcctgatcgtcagctacgcgagcgcc

SEQ ID NO: 12952 - RNA, 1680 nt, synthetic construct
  misc_feature 1..1680: note = derived and/or modified CDS sequence (opt1) from RVFV(MP-12)__DQ380208.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgctcagcgcccacggcaacccctgcatgaaggagaagctggtcatgaagacgcactgccccaacgactaccagtccgcccaccacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcccacggcctcatcaactaccagtgccacaccgcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtggatctacaagaagatggtggcccgcgtcgccgacaacatcaaccaggtgaaccgggagatcgggtggatggagggcgggcagctggtgctcggcaaccccgcccccatcccgcgccacgcccccatcccccggtactccacctacctgatgctgctcctgatcgtcagctacgcgagcgcc

SEQ ID NO: 12953 - RNA, 1680 nt, synthetic construct
  misc_feature 1..1680: note = derived and/or modified CDS sequence (opt1) from RVFV(MP12)__Z30318.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgctcagcgcccacggcaacccctgcatgaaggagaagctggtcatgaagacgcactgccccaacgactaccagtccgcccaccacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcccacggcctcatcaactaccagtgccacaccgcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtggatctacaagaagatggtggcccgcgtcgcccacaacatcaaccaggtgaaccgggagatcgggtggatggagggcgggcagctggtgctcggcaaccccgcccccatcccgcgccacgcccccatcccccggtactccacctacctgatgctgctcctgatcgtcagctacgcgagcgcc

SEQ ID NO: 12954 - RNA, 1680 nt, synthetic construct
  misc_feature 1..1680: note = derived and/or modified CDS sequence (opt1) from RVFV(2007001811)__EU574040.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcc

SEQ ID NO: 12955 - RNA, 1680 nt, synthetic construct
  misc_feature 1..1680: note = derived and/or modified CDS sequence (opt1) from RVFV(2250/74)__DQ380209.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtggatctacaagaagatggtggcccgcgtcgccgacaacatcaaccaggtgaaccgggagatcggctggatggagggcgggcagctggtgctggggaaccccgcccccatcccgcgccacgcccccatcccccggtactccacctacctcatgctgctgctcatcgtcagctacgcgagcgcc

SEQ ID NO: 12956 - RNA, 1680 nt, synthetic construct
  misc_feature 1..1680: note = derived and/or modified CDS sequence (opt1) from RVFV(T1)__DQ380201.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccgtcctgtaccgggtgctcaagtgcctgaagatcgcgccccgcaaggtgctgaaccccctcatgtggatcaccgccttcatccggtggatctacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcc

SEQ ID NO: 12957 - RNA, 1680 nt, synthetic construct
  misc_feature 1..1680: note = derived and/or modified CDS sequence (opt1) from RVFV(Ken 199800523)__KU978777.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgttctgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcc

SEQ ID NO: 12958 - RNA, 1680 nt, synthetic construct
  misc_feature 1..1680: note = derived and/or modified CDS sequence (opt1) from RVFV(1853/78)__DQ380220.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcggggtggtgcagatccaggtctccggcgtgtggaagaagcccctgtgcgtggggtacgagcgggtcgtggtgaagcgcgagctgagcgccaagccgatccagcgggtcgagccctgcacgacctgcatcaccaagtgcgagccccacggcctggtggtccgctccaccggcttcaagatcagctccgccgtggcctgcgcgagcggggtgtgcgtcaccggctcccagagcccctccaccgagatcacgctcaagtacccggggatcagccagtccagcggcggggacatcggcgtgcacatggcccacgacgaccagtccgtgagctccaagatcgtcgcccactgcccgccccaggacccctgcctggtgcacggctgcatcgtgtgcgcccacgggctgatcaactaccagtgccacaccgcgctcagcgccttcgtcgtggtgttcgtcttctccagcatcgccatcatctgcctggccatcctgtaccgggtgctcaagtgcctgaagatcgcgccccgcaaggtgctgaaccccctcatgtggatcaccgccttcatccggtgggtctacaagaagatggtggcccgcgtggccgacaacatcaaccaggtcaaccgggagatcggctggatggagggcgggcagctggtgctggggaaccccgcccccatcccgcgccacgcccccatcccccggtactccacctacctcatgctgctgctcatcgtgagctacgcgagcgcc

SEQ ID NO: 12959 - RNA, 1680 nt, synthetic construct
  misc_feature 1..1680: note = derived and/or modified CDS sequence (opt1) from RVFV(73HB1449)__DQ380211.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagaaccccagcaccgagatcacgctcaagtacccggggatctcccagagctccggcggggacatcggcgtccacatggcccacgacgaccagagcgtgtccagcaagatcgtggcccactgcccgccccaggacccctgcctggtccacggctgcatcgtgtgcgcccacgggctgatcaactaccagtgccacaccgcgctctccgccttcgtggtcgtgttcgtgttcagctccatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtacagcacctacctcatgctgctgctcatcgtgtcctacgcgagcgcc

SEQ ID NO: 12960 - RNA, 1680 nt, synthetic construct
  misc_feature 1..1680: note = derived and/or modified CDS sequence (opt1) from RVFV(2007000234)__JF326191.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggccctggggaaccccgcccccatcccgcgccacgcgcccatcccccggtactccacgtacctcatgctgctgctcatcgtcagctacgccagcgcc

SEQ ID NO: 12961 - RNA, 1680 nt, synthetic construct
  misc_feature 1..1680: note = derived and/or modified CDS sequence (opt1) from RVFV(73HB1230)__DQ380221.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagaaggagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgcgtggtcgtgaagcgggagctgagcgccaagccgatccagcgcgtggagccctgcacgacctgcatcaccaagtgcgagccccacggcctggtcgtgcggtccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgcgtcctcaagtgcctgaagatcgcgccccggaaggtgctgaaccccctcatgtggatcaccgccttcatccgctgggtgtacaagaagatggtcgcccgggtggccgacaacatcaaccaggtgaaccgcgagatcggctggatggagggcgggcagctggtcctggggaaccccgcccccatcccgcggcacgcccccatcccccgctactccacctacctcatgctgctgctcatcgtgagctacgcgagcgcc

SEQ ID NO: 12962 - RNA, 1680 nt, synthetic construct
  misc_feature 1..1680: note = derived and/or modified CDS sequence (opt1) from RVFV(ZM-657)__DQ380204.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaaggcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtggatctacaagaagatggtggcccgcgtcgccgacaacatcaaccaggtgaaccgggagatcggctggatggagggcgggcagctggtgctggggaaccccgcccccatcccgcgccacgcccccatcccccggtactccacctacctcatgctgctgctcatcgtcagctacgcgagcgcc

SEQ ID NO: 12963 - RNA, 1680 nt, synthetic construct
  misc_feature 1..1680: note = derived and/or modified CDS sequence (opt1) from RVFV(Kenya 83 (21445))__DQ380198.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggccctggggaaccccgcccccatcccgcgccacgcgcccatcccccggtactccacctacctcatgctgctgctcatcgtcagctacgccagcgcc

SEQ ID NO: 12964 - RNA, 1680 nt, synthetic construct
  misc_feature 1..1680: note = derived and/or modified CDS sequence (opt1) from RVFV(SAUDI 200010901)__KU978778.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgttctgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcatcagctacgcgagcgcc

SEQ ID NO: 12965 - RNA, 1680 nt, synthetic construct
  misc_feature 1..1680: note = derived and/or modified CDS sequence (opt1) from RVFV(2007004194)__EU574031.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgagcaacgacggcaagatggcgtccgtgaagtgcccgcccaagtacgagctgaccgaggactgcaacttctgccggcagatgaccggggccagcctcaagaagggctcctaccccctgcaggacctgttctgccagagctccgaggacgacgggagcaagctcaagaccaagatgaagggcgtgtgcgaggtcggggtgcaggccctgaagaagtgcgacggccagctgtccacggcccacgaggtggtccccttcgccgtgttcaagaacagcaagaaggtgtacctcgacaagctggacctgaagaccgaggagaacctcctgcccgactccttcgtctgcttcgagcacaagggccagtacaaggggaccatggacagcggccagaccaagcgcgagctgaagtccttcgacatcagccagtgccccaagatcgggggccacggctccaagaagtgcacgggggacgcggccttctgcagcgcctacgagtgcaccgcccagtacgccaacgcgtactgcagccacgccaacggctccgggatcgtgcagatccaggtgagcggcgtctggaagaagcccctctgcgtggggtacgagcgggtggtcgtgaagcgcgagctgtccgccaagccgatccagcgggtggagccctgcacgacctgcatcaccaagtgcgagccccacggcctggtcgtgcgcagcaccggcttcaagatctccagcgccgtcgcctgcgcgtccggggtgtgcgtgaccggcagccagtcccccagcaccgagatcacgctcaagtacccggggatctcccagagctccggcggggacatcggcgtccacatggcccacgacgaccagagcgtgtccagcaagatcgtggcccactgcccgccccaggacccctgcctggtccacggctgcatcgtgtgcgcccacgggctgatcaactaccagtgccacaccgcgctctccgccttcgtggtcgtgttcgtgttcagctccatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtacagcacctacctcatgctgctgctcatcgtgagctacgcgtccgcc

SEQ ID NO: 12966 - RNA, 1680 nt, synthetic construct
  misc_feature 1..1680: note = derived and/or modified CDS sequence (opt1) from RVFV(ZH-501-777)__DQ380202.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggaccccggccagaccaagcgcgagctgaagtccttcgacatcagccagtgccccaagatcgggggccacggctccaagaagtgcacgggggacgcggccttctgcagcgcctacgagtgcaccgcccagtacgccaacgcgtactgctcccacgccaacggcagcgggatcgtgcagatccaggtgagcggcgtctggaagaagccgctctgcgtggggtacgagcgggtggtcgtgaagcgcgagctgtccgccaagcccatccagcgggtggagccctgcacgacctgcatcaccaagtgcgagccccacggcctggtcgtgcgcagcaccggcttcaagatctccagcgccgtcgcctgcgcgtccggggtgtgcgtgaccggcagccagtccccgagcaccgagatcacgctcaagtaccccgggatctcccagagctccggcggggacatcggcgtccacatggcccacgacgaccagagcgtgtccagcaagatcgtggcccactgcccgccccaggacccctgcctggtccacggctgcatcgtgtgcgcccacgggctgatcaactaccagtgccacaccgcgctctccgccttcgtggtcgtgttcgtgttcagctccatcgccatcatctgcctggccgtcctgtaccgggtgctcaagtgcctgaagatcgcgccccgcaaggtgctgaaccccctcatgtggatcaccgccttcatccggtggatctacaagaagatggtcgcccgcgtggccgacaacatcaaccaggtgaaccgggagatcggctggatggagggcgggcagctggtcctggggaaccccgccccgatcccccgccacgcccccatcccgcggtacagcacctacctcatgctgctgctcatcgtgtcctacgcgagcgcc

SEQ ID NO: 12967 - RNA, 1680 nt, synthetic construct
  misc_feature 1..1680: note = derived and/or modified CDS sequence (opt1) from RVFV(ZC-3349)__DQ380207.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccaggccgtgtccagcaagatcgtggcccactgcccgccccaggacccctgcctggtccacggctgcatcgtgtgcgcgcacgggctgatcaactaccagtgccacaccgccctctccgccttcgtggtcgtgttcgtgttcagctccatcgccatcatctgcctggccatcctgtaccgggtcctcaagtgcctgaagatcgcgccccgcaaggtgctgaaccccctcatgtggatcaccgccttcatccggtggatctacaagaagatggtggcccgcgtcgccgacaacatcaaccacgtgaaccgggagatcggctggatggagggcgggcagctggtgctggggaaccccgcccccatcccgcgccacgcgcccatcccccggtacagcacctacctcatgctgctgctcatcgtctcctacgccagcgcc

SEQ ID NO: 12968 - RNA, 1680 nt, synthetic construct
  misc_feature 1..1680: note = derived and/or modified CDS sequence (opt1) from RVFV(200803166)__JF311381.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctgaagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgacggcc

SEQ ID NO: 12969 - RNA, 1680 nt, synthetic construct
  misc_feature 1..1680: note = derived and/or modified CDS sequence (opt1) from RVFV(1260/78)__DQ380214.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgcaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcc

SEQ ID NO: 12970 - RNA, 1680 nt, synthetic construct
  misc_feature 1..1680: note = derived and/or modified CDS sequence (opt1) from RVFV(T-46 (228113))__DQ380199.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccaaggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccgtcctgtaccgggtgctcaagtgcctgaagatcgcgccccgcaaggtgctgaaccccctcatgtggatcaccgccttcatccggtggatctacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcc

SEQ ID NO: 12971 - RNA, 1680 nt, synthetic construct
  misc_feature 1..1680: note = derived and/or modified CDS sequence (opt1) from RVFV(ZINGA J83 R1)__KU978776.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggctcatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctcatcaactaccagtgccacaccgcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtgggtgtaccgcaagatggtcgcccgggtggccgacaacatcaaccaggtgaaccgcgagatcggctggatggagggcgggcagctggtcctcgggaaccccgcccccatcccgcggcacgtgcccatcccccgctactccacctacctgatgctgctcctgatcgtgagctacgccagcgcg

SEQ ID NO: 12972 - RNA, 1680 nt, synthetic construct
  misc_feature 1..1680: note = derived and/or modified CDS sequence (opt1) from RVFV(clone 13)__DQ380213.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagcacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagaaccccagcaccgagatcacgctcaagtacccggggatctcccagagctccggcggggacatcggcgtccacatggcccacgacgaccagagcgtgtccagcaagatcgtggcccactgcccgccccaggacccctgcctggtccacggctgcatcgtgtgcgcccacgggctgatcaactaccagtgccacaccgcgctctccgccttcgtggtcgtgttcgtgttcagctccatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtacagcacctacctcatgctgctgctcatcgtgtcctacgcgagcgcc

SEQ ID NO: 12973 - RNA, 1680 nt, synthetic construct
  misc_feature 1..1680: note = derived and/or modified CDS sequence (opt1) from RVFV(SA01-1322)__KX096942.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgttctgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctgggggaccccgcccccatcccgcgccacgcccccatcccccggtactccacctacctcatgctgctgctcatcatcagctacgcgagcgcc

SEQ ID NO: 12974 - RNA, 1680 nt, synthetic construct
  misc_feature 1..1680: note = derived and/or modified CDS sequence (opt1) from RVFV(25010-24)__KM210509.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctgatcgtccgctccaccggcttcaagatcagctccgccgtggcctgcgcgagcggggtctgcgtgaccggctcccagagcccctccaccgagatcacgctcaagtacccggggatcagccagtccagcggcggggacatcggcgtgcacatggcccacgacgaccagtccgtcagctccaagatcgtggcccactgcccgccccaggacccctgcctggtgcacggctgcatcgtctgcgcccacgggctgatcaactaccagtgccacaccgcgctcagcgccttcgtggtggtcttcgtgttctccagcgtggccatcatctgcctggccatcctgtacaaggtcctcaagtgcctgaagatcgcccccaagaaggtgctgaaccccctcatgtggatcaccgcgttcatccggtgggtgtacaagaagatggtcgcccgcgtggccgacaacatcaaccaggtgaaccgggagatcggctggatggagggcgggcagctggccctggggaaccccgcccccatcccgcgccacgcgcccatcccccggtactccacctacctcatgctgctgctcatcgtcagctacgccagcgcc

SEQ ID NO: 12975 - RNA, 1680 nt, synthetic construct
  misc_feature 1..1680: note = derived and/or modified CDS sequence (opt1) from RVFV(200803162)__JF311377.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcgccaagtgcgagccccacggcctggtcgtgcgctccaccggcttcaagatcagctccgccgtcgcgtgcgccagcggggtgtgcgtgaccggctcccagagcccctccaccgagatcaccctcaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcgcacggcctgatcaactaccagtgccacacggccctcagcgccttcgtggtcatcttcgtgttctccagcaccgccatcatctgcctggccgtgctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcgggtggatggagggcgggcagctggccctgcgcaaccccgcgcccatcccgcggcacgcccccatcccccgctactccacctacctcatgctgctgctcatcgtcagctacgccagcgcc

SEQ ID NO: 12976 - RNA, 1680 nt, synthetic construct
  misc_feature 1..1680: note = derived and/or modified CDS sequence (opt1) from RVFV(2007002476)__EU574036.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccgggtcctcaagtgcctgaagatcgcgccccgcaaggtgctgaaccccctcatgtggatcaccgccttcatcaagtgggtgtacaagaagatggtcgcccgggtggccgacaacatcaaccaggtgaaccgcgagatcggctggatggagggcgggcagctggccctggggaaccccgcccccatcccgcggcacgcgcccatcccccgctactccacgtacctcatgctgctgctcatcgtcagctacgccagcgcc

SEQ ID NO: 12977 - RNA, 1680 nt, synthetic construct
  misc_feature 1..1680: note = derived and/or modified CDS sequence (opt1) from RVFV(Hv-B375)__DQ380218.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagaacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcatcgccatcatctgcctggccatcctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcggctggatggagggcgggcagctggtcctggggaaccccgcccccatcccgcgccacgcccccatcccccggtactccacctacctcatgctgctgctcatcgtgagctacgcgagcgcc

SEQ ID NO: 12978 - RNA, 1680 nt, synthetic construct
  misc_feature 1..1680: note = derived and/or modified CDS sequence (opt1) from RVFV(OS-1)__DQ380186.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcggggtggtgcagatccaggtctccggcgtgtggaagaagcccctgtgcgtggggtacgagcgggtcgtggtgaagcgcgagctgagcgccaagccgatccagcgggtcgagccctgcacgacctgcatcaccaagtgcgagccccacggcctggtggtccgctccaccggcttcaagatcagctccgccgtggcctgcgcgagcggggtgtgcgtcaccggctcccagagcccctccaccgagatcacgctcaagtacccggggatcagccagtccagcggcggggacatcggcgtgcacatggcccacgacgaccagtccgtgagctccaagatcgtcgcccactgcccgccccaggacccctgcctggtgcacggctgcatcgtgtgcgcccacgggctgatcaactaccagtgccacaccgcgctcagcgccttcgtcgtggtgttcgtcttctccagcgtggccatcatctgcctggccatcctgtacaaggtgctcaagtgcctgaagatcgcgccccggaaggtcctgaaccccctcatgtggatcaccgccttcatccgctgggtgtacaagaagatggtggcccgggtcgccgacaacatcaaccaggtgaaccgcgagatcggctggatggagggcgggcagctggccctggggaaccccgcccccatcccgcggcacgcgcccatcccccgctactccacctacctcatgctgctgctcatcgtgagctacgccagcgcc

SEQ ID NO: 12979 - RNA, 1680 nt, synthetic construct
  misc_feature 1..1680: note = derived and/or modified CDS sequence (opt1) from RVFV(2373/74)__DQ380194.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatggtggcccactgcccgccccaggacccctgcctggtccacggctgcatcgtgtgcgcccacgggctgatcaactaccagtgccacaccgcgctcagcgccttcgtggtcgtgttcgtgttctccagcgtcgccatcatctgcctggccatcctgtacaaggtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggccctggggaaccccgcccccatcccgcggcacgcgcccatcccccgctactccacctacctcatgctgctgctcatcgtgagctacgccagcgcc

SEQ ID NO: 12980 - RNA, 1680 nt, synthetic construct
  misc_feature 1..1680: note = derived and/or modified CDS sequence (opt1) from RVFV(Kenya 57 (Rintoul))__DQ380192.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagatcaagcgcgagctcaagagcttcgacatctcccagtgccccaagatcgggggccacggcagcaagaagtgcaccggggacgcggccttctgctccgcctacgagtgcacggcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcaccctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacacggcgctcagcgccttcgtggtcgtgttcgtgttctccagcgtcgccatcatctgcctggccatcctgtacaaggtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcggctggatggagggcgggcagctggtgctggggaaccccgcccccatcccgcggcacgcccccatcccccgctactccacctacctcatgctgctgctcatcgtgagctacgcgagcgcc

SEQ ID NO: 12981 - RNA, 1680 nt, synthetic construct
  misc_feature 1..1680: note = derived and/or modified CDS sequence (opt1) from RVFV(Sudan 2V-2007)__JQ820490.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcagcgtccacggctgcatcgtgtgcgcccacgggctgatcaactaccagtgccacaccgcgctgtccgccttcgtggtcgtgttcgtgttcagctccatcgccatcatctgcctcgccatcctgtaccgggtcctgaagtgcctcaagatcgcgccccgcaaggtgctgaaccccctgatgtggatcaccgccttcatccggtgggtgtacaagaagatggtcgcccgcgtggccgacaacatcaaccaggtgaaccgggagatcggctggatggagggcgggcagctcgtcctggggaaccccgcccccatcccgcgccacgcccccatcccccggtacagcacctacctgatgctcctgctgatcgtgagccacgcgtccgcc

SEQ ID NO: 12982 - RNA, 1680 nt, synthetic construct
  misc_feature 1..1680: note = derived and/or modified CDS sequence (opt1) from RVFV(200803167)__JF311382.1__Gn
  source 1..1680: mol_type = other RNA
atggccggcatcgccatgaccgtgctgcccgcgctcgccgtcttcgccctggccccggtggtgttcgccgaggacctgcacctccgcaaccggcccgggaagggccacaactacatcgacgggatgacccaggaggacgcgacgtgcaagcccgtcacctacgccggcgcctgcagctccttcgacgtgctgctggagaaggggaagttccccctcttccagagctacgcccaccaccgcaccctgctggaggcggtgcacgacaccatcatcgccaaggccgacccgccctcctgcgacctccagagcgcccacggcaacccctgcatgaaggagaagctggtcatgaagacgcactgccccaacgactaccagtccgcccactacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgccggacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagcccatccagcgggtggagccgtgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcgccctgaagtaccccgggatcagccagtccagcggcggggacatcggcgtccacatggcccacgacgaccagtccgtgagctccaagatcgtggcccactgcccgccccaggacccctgcctggtccacggctgcatcgtgtgcgcgcacgggctcatcaactaccagtgccacacggccctgagcgccttcgtggtcgtgttcgtgttctccagcatcgccatcatctgcctggccatcctctaccgggtcctgaagtgcctgaagatcgcgccccgcaaggtgctcaacccgctgatgtggatcaccgccttcatccggtgggtgtacaagaagatggtcgcccgcgtggccgacaacatcaaccaggtgaaccgggagatcggctggatggagggcgggcagctggtcctcgggaaccccgcccccatcccccgccacgcgccgatcccccggtactccacctacctgatgctgctcctgatcgtgagctacgccagcgcc

SEQ ID NO: 12983 - RNA, 1680 nt, synthetic construct
  misc_feature 1..1680: note = derived and/or modified CDS sequence (opt1) from RVFV(KEN/Gar-008/06)__HM586965.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtcccgggtctggaagaagcccctgtgcgtgggctacgagcgcgtggtcgtgaagcgggagctgagcgccaagccgatccagcgcgtggagccctgcacgacctgcatcaccaagtgcgagccccacgggctggtcgtgcggtccaccggcttcaagatcagctccgccgtcgcctgcgcgagcggcgtgtgcgtgaccgggtcccagagcccctccaccgagatcacgctcaagtacccgggcatcagccagtccagcgggggcgacatcggggtccacatggcccacgacgaccagtccgtgagctccaagatcgtggcccactgcccgccccaggacccctgcctggtccacggctgcatcgtgtgcgcccacggcctgatcaactaccagtgccacaccgcgctcagcgccttcgtggtcatcttcgtgttctccagcaccgccatcatctgcctggccgtgctgtaccgcgtcctcaagtgcctgaagatcgcgccccggaaggtgctgaaccccctcatgtggatcaccgccttcatccgctgggtgtacaagaagatggtcgcccgggtggccgacaacatcaaccaggtgaaccgcgagatcgggtggatggagggcgggcagctggccctgggcaaccccgcccccatcccgcggcacgcgcccatcccccgctactccacgtacctcatgctgctgctcatcgtcagctacgccagcgcc

SEQ ID NO: 12984 - RNA, 1680 nt, synthetic construct
  misc_feature 1..1680: note = derived and/or modified CDS sequence (opt1) from RVFV(ANK-6087)__DQ380216.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaagctggactccggccagaccaagcgcgagctcaagagcttcgacatctcccagtgccccaagatcgggggccacggcagcaagaagtgcaccggggacgcggccttctgctccgcctacgagtgcacggcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcaccctgaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctcatcaactaccagtgccacacggcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtgggtgtaccgcaagatggtcgcccgggtggccgacaacatcaaccaggtgaaccgcgagatcggctggatggagggcgggcagctggtcctcgggaaccccgcccccatcccgcggcacgtgcccatcccccgctactccacctacctgatgctgctcctgatcgtgagctacgccagcgcg

SEQ ID NO: 12985 - RNA, 1680 nt, synthetic construct
  misc_feature 1..1680: note = derived and/or modified CDS sequence (opt1) from RVFV(763/70)__DQ380188.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgggctgaccgaggactgcaacttctgccggcagatgaccggcgcctccctcaagaaggggagctaccccctgcaggacctgttctgccagtccagcgaggacgacggctccaagctcaagaccaagatgaagggggtgtgcgaggtcggcgtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaaggggcagtacaagggcaccatggactccgggcagaccaagcgcgagctcaagagcttcgacatctcccagtgccccaagatcggcggccacgggagcaagaagtgcacgggcgacgcggccttctgctccgcctacgagtgcaccgcccagtacgccaacgcgtactgcagccacgccaacgggagcggcatcgtgcagatccaggtgtccggggtctggaagaagcccctgtgcgtgggctacgagcgggtggtcgtgaagcgcgagctgagcgccaagccgatccagcgggtggagccctgcacgacctgcatcaccaagtgcgagccccacggcctggtcgtgcgctccaccgggttcaagatcagctccgccgtcgcctgcgcgagcggcgtgtgcgtgaccgggtcccagagcccctccaccgagatcacgctcaagtacccgggcatcagccagtccagcgggggcgacatcggcgtccacatggcccacgacgaccagtccgtgagctccaagatcgtggcccactgcccgccccaggacccctgcctggtccacgggtgcatcgtgtgcgcccacggcctgatcaactaccagtgccacaccgcgctcagcgccttcgtggtcgtgttcgtgttctccagcgtcgccatcatctgcctggccatcctgtacaaggtgctcaagtgcctgaagatcgcgccccggaaggtgctgaaccccctcatgtggatcaccgccttcatccgctgggtctacaagaagatggtggcccgggtggccgacaacatcaaccaggtcaaccgcgagatcgggtggatggagggcgggcagctggccctgggcaaccccgcccccatcccgcggcacgcgcccatcccccgctactccacctacctcatgctgctgctcatcgtgagctacgccagcgcc

SEQ ID NO: 12986 - RNA, 1680 nt, synthetic construct
  misc_feature 1..1680: note = derived and/or modified CDS sequence (opt1) from RVFV(BIME-01)__KX609032.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcgtcgccatcatctgcctggccatcctgtacaaggtgctccggtgcctgaagatcgcccccaagaaggtgctgaaccccctcatgtggatcaccgcgttcatccgctgggtctacaagaagatggtggcccgggtggccgacaacatcaaccaggtcaaccgcgagatcggctggatggagggcgggcagctggccctggggaaccccgcccccatcccgcggcacgcgcccatcccccgctactccacctacctcatgctgctgctcatcatcagctacgccagcgcc

SEQ ID NO: 12987 - RNA, 1680 nt, synthetic construct
  misc_feature 1..1680: note = derived and/or modified CDS sequence (opt1) from RVFV(KEN07-KUR340)__EF460404.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccggatgctcaagtgcctgaagatcgcgccccgcatcgtcctgaaccccctcatgtggatcaccgccttcatccggtgggtgtacaagaagatggtggcccgcgtcgccgacaacatcaaccaggtgaaccgggagatcggctggatggagggcgggcagctggccctggggaaccccgcccccatcccgcgccacgcgcccatcccccggtactccacgtacctcatgctgctgctcatcgtgagctacgccagcgcc

SEQ ID NO: 12988 - RNA, 1680 nt, synthetic construct
  misc_feature 1..1680: note = derived and/or modified CDS sequence (opt1) from RVFV(SA-51 (Van Wyck))__DQ380195.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccggggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgcgtggtcgtgaagcgggagctgagcgccaagccgatccagcgcgtggagccctgcacgacctgcatcaccaagtgcgagccccacggcctggtcgtgcggtccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcgtcgccatcatctgcctggccatcctgtacaaggtgctcaagtgcctgaagatcgcgccccgcaaggtgctgaaccccctcatgtggatcaccgccttcatccggtgggtctacaagaagatggtggcccgcgtggccgacaacatcaaccaggtcaaccgggagatcggctggatggagggcgggcagctggccctggggaaccccgcccccatcccgcgccacgcgcccatcccccggtactccacctacctcatgctgctgctcatcgtgagctacgccagcgcc

SEQ ID NO: 12989 - RNA, 1680 nt, synthetic construct
  misc_feature 1..1680: note = derived and/or modified CDS sequence (opt1) from RVFV(Lunyo)__KU167026.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggtgtccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtctccggcgtgtggaagaagcccctgtgcgtggggtacgagcgggtcgtggtgaagcgcgagctgagcgccaagccgatccagcgggtcgagccctgcacgacctgcatcaccaagtgcgagccccacggcctggtggtccgctccaccggcttcaagatcagctccgccgtggcctgcgcgagcggggtgtgcgtcaccggctcccagagcccctccaccgagatcacgctcaagtacccggggatcagccagtccagcggcggggacatcggcgtgcacatggcccacgacgaccagtccgtgagctccaagatcgtcgcccactgcccgccccaggacccctgcctggtgcacggctgcatcgtgtgcgcccacgggctgatcaactaccagtgccacaccgcgctcagcgccttcgtcgtggtgttcgtcttctccagcgtggccatcatctgcctggccatcctgtacaaggtgctcaagtgcctgaagatcgcgccccggaaggtcctgaaccccctcatgtggatcaccgccttcatccgctgggtgtacaagaagatggtggcccgggtcgccgacaacatcaaccaggtgaaccgcgagatcggctggatggagggcgggcagctggccctggggaaccccgcccccatcccgcggcacgcgcccatcccccgctactccacctacctcatgctgctgctcatcgtgagctacgccagcgcc

SEQ ID NO: 12990 - RNA, 1680 nt, synthetic construct
  misc_feature 1..1680: note = derived and/or modified CDS sequence (opt1) from RVFV(2269/74)__DQ380222.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagcacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcgtcgccatcatctgcctggccatcctgtacaaggtgctcaagtgcctgaagatcgcccccaagaaggtgctgaaccccctcatgtggatcaccgcgttcatccggtgggtctacaagaagatggtggcccgcgtggccgacaacatcaaccaggtcaaccgggagatcggctggatggagggcgggcagctggccctggggaaccccgcccccatcccgcgccacgcgcccatcccccggtactccacctacctcatgctgctgctcatcgtgagctacgccagcgcc

SEQ ID NO: 12991 - RNA, 1680 nt, synthetic construct
  misc_feature 1..1680: note = derived and/or modified CDS sequence (opt1) from RVFV(MgH824)__DQ380210.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggctacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcgcaagggccagtacaaggggaccatggactccggccagaccaagcgggagctcaagagcttcgacatctcccagtgccccaagatcgggggccacggcagcaagaagtgcacgggggacgcggccttctgctccgcctacgagtgcaccacccagtacgccaacgcctactgcagccacgcgaacggcagcggggtggtgcagatccaggtctccggcgtgtggaagaagcccctgtgcgtggggtacgagcgcgtcgtggtgaagcgggagctgagcgccaagccgatccagcgcgtcgagccctgcaccacgtgcatcaccaagtgcgagccccacggcctggtggtccggtccaccggcttcaagatcagctccgccgtggcctgcgccagcggggtgtgcgtcaccggctcccagagcccctccacggagatcaccctcaagtacccggggatcagccagtccagcggcggggacatcggcgtgcacatggcgcacgacgaccagtccgtgagctccaagatcgtcgcccactgcccgccccaggacccctgcctggtgcacggctgcatcgtgtgcgcccacgggctgatcaactaccagtgccacaccgccctcagcgcgttcgtcgtggtgttcgtcttctccagcatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaaccccgcccccatcccgcggcacgcccccatcccccgctactccacgtacctcatgctgctgctcatcgtgagctacgccagcgcg

SEQ ID NO: 12992 - RNA, 1680 nt, synthetic construct
  misc_feature 1..1680: note = derived and/or modified CDS sequence (opt1) from RVFV__JQ068143.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatcgactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcgtcgccatcatctgcctggccatcctgtacaaggtgctccggtgcctgaagatcgcccccaagaaggtgctgaaccccctcatgtggatcaccgcgttcatccgctgggtctacaagaagatggtggcccgggtggccgacaacatcaaccaggtcaaccgcgagatcggctggatggagggcgggcagctggccctggggaaccccgcccccatcccgcggcacgcgcccatcccccgctactccacctacctcatgctgctgctcatcatcagctacgccagcgcc

SEQ ID NO: 12993 - RNA, 1680 nt, synthetic construct
  misc_feature 1..1680: note = derived and/or modified CDS sequence (opt1) from RVFV(RVFBJ01/2016)__KX785331.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagcacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtacccggggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcgtgttcgtgttctccagcgtcgccatcatctgcctggccatcctgtacaaggtgctccggtgcctgaagatcgcccccaagaaggtgctgaaccccctcatgtggatcaccgcgttcatccgctgggtctacaagaagatggtggcccgggtggccgacaacatcaaccaggtcaaccgcgagatcggctggatggagggcgggcagctggccctggggaaccccgcccccatcccgcggcacgcgcccatcccccgctactccacctacctcatgctgctgctcatcatcagctacgccagcgcc

SEQ ID NO: 12994 - RNA, 1680 nt, synthetic construct
  misc_feature 1..1680: note = derived and/or modified CDS sequence (opt1) from RVFV(KEN/Kil-006/07)__HM586966.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgccgacggcaacaagtgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagcccatccagcgggtggagccgtgcacgacctgcatcaccaagtgcgagccccacggcctggtcgtgcgctccaccggcttcaagatcagctccgccgtcgcctgcgcgagcggggtgtgcgtgaccggctcccagagcccctccaccgagatcacgctcaagtaccccgggatcagccagtccagcggcggggacatcggcgtccacatggcccacgacgaccagtccgtgagctccaagatcgtggcccactgcccgccccaggacccctgcctggtccacggctgcatcgtgtgcgcccacgggctgatcaactaccagtgccacaccgcgctcagcgccttcgtggtcatcttcgtgttctccagcaccgccatcatctgcctggccgtgctgtaccgggtcctcaagtgcctgaagatcgcgccccgcaaggtgctgaacccgctcatgtggatcaccgccttcatccggtgggtgtacaagaagatggtcgcccgcgtggccgacaacatcaaccaggtgaaccgggagatcggctggatggagggcgggcagctggccctggggaaccccgcccccatcccccgccacgcgccgatcccccggtactccacgtacctcatgctgctgctcatcgtcagctacgccagcgcc

SEQ ID NO: 12995 - RNA, 1680 nt, synthetic construct
  misc_feature 1..1680: note = derived and/or modified CDS sequence (opt1) from RVFV(SA-75)__DQ380189.1__Gn
  source 1..1680: mol_type = other RNA
atggcccgcatcgccatgaccgtgctgcccgcgctcgccgtcttcgccctggccccggtggtgttcgccgaggacccccacctccggaaccgccccggcaaggggcacaactacatcgacggcatgacccaggaggacgcgacgtgcaagcccgtcacctacgccggggcctgcagctccttcgacgtgctgctggagaagggcaagttcccgctgttccagagctacgcccaccaccggaccctcctggaggcggtgcacgacaccatcatcgccaaggccgacccgccctcctgcgacctgcagagcgcccacgggaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccgccagatgaccggcgcctccctcaagaaggggagctaccccctgcaggacctgttctgccagtccagcgaggacgacggctccaagctcaagaccaagatgaagggggtgtgcgaggtcggcgtgcaggccctgaagaagtgcgacgggcagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaagggcaccatggactccgggcagaccaagcgggagctcaagagcttcgacatctcccagtgccccaagatcggcgggcacggcagcaagaagtgcacgggcgacgcggccttctgctccgcctacgagtgcaccgcccagtacgccaacgcgtactgcagccacgccaacgggagcggcgtggtgcagatccaggtctccggggtgtggaagaagcccctgtgcgtgggctacgagcgcgtcgtggtgaagcgggagctgagcgccaagccgatccagcgcgtcgagccctgcacgacctgcatcaccaagtgcgagccccacgggctggtggtccggtccaccggcttcaagatcagctccgccgtggcctgcgcgagcggcgtgtgcgtcaccgggtcccagagcccctccaccgagatcacgctcaagtacccgggcatcagccagtccagcgggggcgacatcggggtgcacatggcccacgacgaccagtccgtgagctccaagatcgtcgcccactgcccgccccaggacccctgcctggtgcacggctgcatcgtgtgcgcccacggcctgatcaactaccagtgccacaccgcgctcagcgccttcgtcgtggtgttcgtcttctccagcgtggccatcatctgcctggccatcctgtacaaggtgctcaagtgcctgaagatcgcgccccgcaaggtcctgaaccccctcatgtggatcaccgtgttcatccggtgggtgtacaagaagatggtcgcccgcgtggccgacaacatcaaccaggtgaaccgggagatcgggtggatggagggcgggcagctggccctgggcaaccccgcccccatcccgcgccacgcccccatcccccggtactccacctacctcatgctgctgctcatcgtcagctacgcgagcgcc

SEQ ID NO: 12996 - RNA, 1680 nt, synthetic construct
  misc_feature 1..1680: note = derived and/or modified CDS sequence (opt1) from RVFV(35/74)__JF784387.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcggggtggtgcagatccaggtctccggcgtgtggaagaagcccctgtgcgtggggtacgagcgggtcgtggtgaagcgcgagctgagcgccaagccgatccagcgggtcgagccctgcacgacctgcatcaccaagtgcgagccccacggcctggtggtccgctccaccggcttcaagatcagctccgccgtggcctgcgcgagcggggtgtgcgtcaccggctcccagagcccctccaccgagatcacgctcaagtacccggggatcagccagtccagcggcggggacatcggcgtgcacatggcccacgacgaccagtccgtgagctccaagatcgtcgcccactgcccgccccaggacccctgcctggtgcacggctgcatcgtgtgcgcccacgggctgatcaactaccagtgccacaccgcgctcagcgccttcgtcgtggtgttcgtcttctccagcgtggccatcatctgcctggccatcctgtacaaggtgctcaagtgcctgaagatcgcgccccggaaggtcctggaccccctcatgtggatcaccgtgttcatccgctgggtgtacaagaagatggtcgcccgggtggccgacaacatcaaccaggtgaaccgcgagatcggctggatggagggcgggcagctggccctggggaaccccgcccccatcccgcggcacgcccccatcccccgctactccacctacctcatgctgctgctcatcgtcagctacgcgagcgcc

SEQ ID NO: 12997 - RNA, 1680 nt, synthetic construct
  misc_feature 1..1680: note = derived and/or modified CDS sequence (opt1) from RVFV__M11157.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgggctgaccgaggactgcaacttctgccggcagatgaccggcgcctccctcaagaaggggagctaccccctgcaggacctgttctgccagtccagcgaggacgacggctccaagctcaagaccaagatgaagggggtgtgcgaggtcggcgtgcaggcccacaagaagtgcgacggccagctgagcacggcccacgaggtggtccccttcgccgtgttcaagaactccaagaaggtgtacctggacaagctcgacctgaagaccgaggagaacctgctccccgacagcttcgtctgcttcgagcacaaggggcagtacaagggcaccatggactccgggcagaccaagcgcgagctcaagagcttcgacatctcccagtgccccaagatcggcggccacgggagcaagaagtgcacgggcgacgcggccttctgctccgcctacgagtgcaccgcccagtacgccaacgcgtactgcagccacgccaacgggagcggcatcgtgcagatccaggtgtccggggtctggaagaagcccctgtgcgtgggctacgagcgggtggtcgtgaagcgcgagctgagcgccaagccgatccagcgggtggagccctgcacgacctgcatcaccaagtgcgagccccacggcctggtcgtgcgctccaccgggttcaagatcagctccgccgtcgcctgcgcgagcggcgtgtgcgtgaccgggtcccagagcccctccaccgagatcacgctgaagtacccgggcatcagccagtccagcgggggcgacatcggcgtccacatggcccacgacgaccagtccgtgagctccaagatcgtggcccactgcccgccccaggacccctgcctcgtccacgggtgcatcgtgtgcgcccacggcctgatcaactaccagtgccacaccgcgctgagcgccttcgtggtcgtgttcgtgttctccagcatcgccatcatctgcctcgccgtcctgtaccgggtgctgaagtgcctcaagatcgcgccccgcaaggtgctgaaccccctgatgtggatcaccgccttcatccggtggatctacaagaagatggtcgcccgcgtggcccacaacatcaaccaggtgaaccgggagatcgggtggatggagggcgggcagctcgtcctgggcaaccccgcccccatcccgcgccacgcccccatcccccggtactccacctacctgatgctcctgctgatcgtgagctacgcgagcgcc

SEQ ID NO: 12998 - RNA, 1680 nt, synthetic construct
  misc_feature 1..1680: note = derived and/or modified CDS sequence (opt1) from RVFV(KEN/Bar-035/07)__HM586969.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggcgcctgcaggaggacgcgacctgcaagcccgtcacgtacgccggcgcctgcagctccttcgacgtgctgctggagaaggggaagttccccctcttccagagctacgcccaccaccggaccctgctggaggcggtgcacgacaccatcatcgccaaggccgacccgccctcctgcgacctccagagcgccgacggcaacaagtgcatgaaggagaagctggtcatgaagacccactgccccaacgactaccagtccgcccactacctgaacaacgacggcaagatggcgagcgtgaagtgcccgcccaagtacgagctcacggaggactgcaacttctgccgccagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcaccgcccacgaggtggtccccttcgccgtgttcaagaactccaagaaggtgtacctggacaagctggacctcaagacggaggagaacctgctgccggacagcttcgtctgcttcgagcacaagggccagtacaaggggaccatggactccggccagaccaagcgggagctcaagagcttcgacatctcccagtgccccaagatcgggggccacggcagcaagaagtgcaccggggacgcggccttctgctccgcctacgagtgcacggcccagtacgccaacgcgtactgcagccacgccaacggcagcgggatcgtgcagatccaggtgtccggcgtctggaagaagcccctgtgcgtggggtacgagcgcgtggtcgtgaagcgggagctgagcgccaagcccatccagcgcgtggagccgtgcacgacctgcatcaccaagtgcgagccccacggcctcgtcgtgcggtccaccggcttcaagatcagctccgccgtcgcctgcgcgagcggggtgtgcgtgaccggctcccagagcccctccaccgagatcaccctgaagtaccccgggatcagccagtccagcggcggggacatcggcgtccacatggcccacgacgaccagtccgtgagctccaagatcgtggcccactgcccgccccaggacccctgcctggtccacggctgcatcgtgtgcgcccacgggctcatcaactaccagtgccacacggcgctgagcgccttcgtggtcatcttcgtgttctccagcaccgccatcatctgcctggccgtgctctaccgcgtcctgaagtgcctgaagatcgcgccccggaaggtgctcaacccgctgatgtggatcaccgccttcatccgctgggtgtacaagaagatggtcgcccgggtggccgacaacatcaaccaggtgaaccgcgagatcggctggatggagggcgggcagctggccctcgggaaccccgcccccatcccccggcacgcgccgatcccccgctactccacctacctgatgctgctcctgatcgtcagctacgccagcgcc

SEQ ID NO: 12999 - RNA, 1680 nt, synthetic construct
  misc_feature 1..1680: note = derived and/or modified CDS sequence (opt1) from RVFV(Kenya 56 (IB8))__DQ380190.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccagggcgacgcgacgtgcaagcccgtcacctacgccggggcctgcagctccttcgacgtgctgctggagaagggcaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaaggactaccagtccgcccactacctgaacaacgacgggaagatggcgagcgtgaagtgcccgcccaagtacgagctgaccgaggactgcaacttctgccggcagatgaccggcgcctccctcaagaaggggagctaccccctgcaggacctgttctgccagtccagcgaggacgacggctccaagctcaagaccaagatgaagggggtgtgcgaggtcggcgtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaaggggcagtacaagggcaccatggactccgggcagaccaagcgcgagctcaagagcttcgacatctcccagtgccccaagatcggcggccacgggagcaagaagtgcacgggcgacgcggccttctgctccgcctacgagtgcaccgcccagtacgccaacgcgtactgcagccacgccaacgggagcggcatcgtgcagatccaggtgtccggggtctggaagcggcccctgtgcgtgggctacgagcgcgtggtcgtgaagcgggagctgagcgccaagccgatccagcgcgtggagccctgcacgacctgcatcaccaagtgcgagccccacggcctggtcgtgcggtccaccgggttcaagatcagctccgccgtcgcctgcgcgagcggcgtgtgcgtgaccgggtcccagagcccctccaccgagatcacgctcaagtacccgggcatgagccagtccagcgggggcgacatcggcgtccacatggcccacgacgaccagtccgtgagctccaagatcgtggcccactgcccgccccaggacccctgcctggtccacgggtgcatcgtgtgcgcccacggcctgatcaactaccagtgccacaccgcgctcagcgccttcgtggtcgtgttcgtgttctccagcgtcgccatcatctgcctggccatcctgtacaaggtgctcaagtgcctgaagatcgcgccccgcaaggtgctgaaccccctcatgtggatcaccgccttcatccggtgggtctacaagaagatggtggcccgcgtggccgacaacatcaaccaggtcaaccgggagatcgggtggatggagggcgggcagcccgccctgggcaaccccgccccgatcccccgccacgcgcccatcccgcggtactccacctacctgatgctcctgctgatcgtgagctacgccagcgcc

SEQ ID NO: 13000 - RNA, 1680 nt, synthetic construct
  misc_feature 1..1680: note = derived and/or modified CDS sequence (opt1) from RVFV(KEN/Bar-032/07)__HM586968.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggcgcctgcaggaggacgcgacctgcaagcccgtcacgtacgccggcgcctgcagctccttcgacgtgctgctggagaaggggaagttccccctcttccagagctacgcccaccaccggaccctgctggaggcggtgcacgacaccatcatcgccaaggccgacccgccctcctgcgacctccagagcgccgacggcaacaagtgcatgaaggagaagctggtcatgaagacccactgccccaacgactaccagtccgcccactacctgaacaacgacggcaagatggcgagcgtgaagtgcccgcccaagtacgagctcacggaggactgcaacttctgccgccagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcaccgcccacgaggtggtccccttcgccgtgttcaagaactccaagaaggtgtacctggacaagctggacctcaagacggaggagaacctgctgccggacagcttcgtctgcttcgagcacaagggccagtacaaggggaccatggactccggccagaccaagcgggagctcaagagcttcgacatctcccagtgccccaagatcgggggccacggcagcaagaagtgcaccggggacgcggccttctgctccgcctacgagtgcacggcccagtacgccaacgcgtactgcagccacgccaacggcagcgggatcgtgcagatccaggtgtccggcgtctggaagaagcccctgtgcgtggggtacgagcgcgtggtcgtgaagcgggagctgagcgccaagcccatccagcgcgtggagccgtgcacgacctgcatcaccaagtgcgagccccacggcctcgtcgtgcggtccaccggcttcaagatcagctccgccgtcgcctgcgcgagcggggtgtgcgtgaccggctcccagagcccctccaccgagatcaccctgaagtaccccgggatcagccagtccagcgtcggcgacatcggggtgcacatggcccacgacgaccagtccgtgagctccaagatcgtcgcccactgcccgccccaggacccctgcctggtgcacggctgcatcgtgtgcgcccacggcctcatcaactaccagtgccacacggcgctgagcgccttcgtcgtgatcttcgtgttctccagcaccgccatcatctgcctggccgtcctctaccgcgtgctgaagtgcctgaagatcgcgccccggaaggtgctcaacccgctgatgtggatcaccgccttcatccgctgggtctacaagaagatggtggcccgggtggccgacaacatcaaccaggtcaaccgcgagatcgggtggatggagggcgggcagctggccctcggcaaccccgcccccatcccccggcacgcgccgatcccccgctactccacctacctgatgctgctcctgatcgtgagctacgccagcgcc

SEQ ID NO: 13001 - RNA, 1680 nt, synthetic construct
  misc_feature 1..1680: note = derived and/or modified CDS sequence (opt1) from RVFV(Beijing-01)__KX611606.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacggggtcacccaggaggacgcgacgtgcaagcccgtgacctacgccggcgcctgcagctccttcgacgtgctgctggagaaggggaagttcccgctgttccagagctacgcccaccaccgcaccctcctggaggcggtccacgacaccatcatcgccaaggccgacccgccctcctgcgacctgcagagcgcccacggcaacccctgcatgaaggagaagctcgtgatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtctgcgaggtgggggtgcaggccctgaagaagtgcgacggccgcctgagcacggcccacgaggtcgtgcccttcgccgtgttcaagaactccaagaaggtctacctcgacaagctggacctgaagaccgaggagaacctcctgcccgacagcttcgtgtgcttcgagcacaagggccagtacaaggggaccatggactccggccagaccaagcgggagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtctccggcgtgtggaagaagcccctgtgcgtggggtacgagcgcgtcgtggtgaagcgggagctgagcgccaagccgatccagcgcgtcgagccctgcacgacctgcatcaccaagtgcgagccccacggcctggtggtccggtccaccggcttcaagatcagctccgccgtggcctgcgcgagcggggtgtgcgtcaccggctcccagagcccctccaccgagatcacgctcaagtacccggggatcagccagtccagcggcggggacatcggcgtgcacatggcccacgacgaccagtccgtgagctccaagatcgtcttcgactgcccgccccaggacccctgcctggtgcacggctgcatcgtgtgcgcccacgggctgatcaactaccagtgccacaccgccctcagcgcgttcgtcgtggtgttcgtcttctccagcgtggccatcatctgcctggccatcctgtacaaggtgctccgctgcctgaagatcgcccccaagaaggtcctgaaccccctcatgtggatcaccgccttcatccggtgggtgtacaagaagatggtggcgcgcgtcgccgacaacatcaaccaggtgaaccgggagatcggctggatggagggcgggcagctggccctggggaaccccgcccccatcccgcgccacgcccccatcccccggtactccacctacctcatgctgctgctcatcatcagctacgcgagcgcc

SEQ ID NO: 13002 - RNA, 1680 nt, synthetic construct
  misc_feature 1..1680: note = derived and/or modified CDS sequence (opt1) from RVFV(Smithburn)__DQ380193.1__Gn
  source 1..1680: mol_type = other RNA
atggccggcatcgccatgaccgtgttccccgcgctggtcgtgttcgccctcgccccggtggtcttcgccgaggacccccacctccgcaaccggcccgggaagggccacaactacatcgacgggatgacccaggaggacgccacgtgcaagcccgtgacctacgcgggcgcctgcagctccttcgacgtgctgctggagaaggggaagttcccgctgttccagagctacgcccaccaccgcaccctgctcgaggccgtccacgacatcatcatcgcgaaggccgacccgccctcctgcaacctgcagagcgcccacggcaacccctgcatgaaggagaagctggtgatgaagacctactgccccaacgactaccagtccgcccactacctcaacaacgacggcaagatggccagcgtgaagtgcccgcccaagcacgagctgacggaggactgcaacttctgccggcagatgaccggggcgtccctgaaggagggcagctaccccctccaggacctgttctgccagtccagcgaggacgacgggtccaagctgaagaccaagatgaagggcgtctgcgaggtgggggtgcaggtcctcaagaagtgcgacggccagctgagcaccgcccacgaggtggtgcccttcgccgtcttcaagaactccaagaaggtgtacctggacaagctcgacctgaagacggaggagaacctgctccccgacagcttcgtgtgcttcgagcacaagggccagtacaaggggaccatggactccggccagatcaagcgcgagctcaagagcttcgacatctcccagtgccccaagatcgggggccacggcagcaagaagtgcaccggggacgccgccttctgctccgcgtacgagtgcaccgcccagtacgccaacgcctactgcagccacgccaacggcagcgggatcgtccagatccaggtgtccggcgtgtggaagaagcccctgtgcgtcgggtacgagcgggtggtggtcaagcgcgagctgagcgcgaagccgatccagcgggtggagccctgcacgacctgcatcaccaagtgcgagccccacggcctggtcgtgcgctccaccggcttcaagatcagctccgccgtggcctgcgccagcggggtctgcgtgacgggctcccagagcccctccaccgagatcaccctgaagtacccggggatcagccagtccagcggcggggacatcggcgtgcacatggcccacgacgaccagtccgtcagctccaagatcgtggcgcactgcccgccccaggacccctgcctcgtgcacggctgcatcgtctgcgcccacgggctgatcaactaccagtgccacaccgccttcagcgccttcgtggtggtcttcgtgttctccagcgtggtcatcatctgcctggcgatcctctacaaggtgctgaagtgcctgaagatcgcgccccggaaggtgctcaaccccctgatgtggatcacggccttcatccgctgggtctacaagaagatggtggcccgggtggccgacaacatcaaccaggtcaaccgcgagatcggctggatggagggcgggcagctggtgctcgggaaccccgcccccatcccgcggcacgcccccatcccccgctactccacctacctgatgctgctcctgatcgtgagctacgccagcgcc

SEQ ID NO: 13003 - RNA, 1680 nt, synthetic construct
  misc_feature 1..1680: note = derived and/or modified CDS sequence (opt1) from RVFV(TAN/Dod-002/07)__HM586971.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactccaagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggccggaagaagtgcacgggggacgcggccttctgcagcgcctacgagtgcaccgcccagtacgccaacgcgtactgctcccacgccaacggcagcgggatcgtgcagatccaggtgagcggcgtctggaagaagcccctgtgcgtggggtacgagcgcgtggtcgtgaagcgggagctgtccgccaagccgatccagcgcgtggagccctgcacgacctgcatcaccaagtgcgagccccacggcctggtcgtgcggagcaccggcttcaagatctccagcgccgtcgcctgcgcgtccggggtgtgcgtgaccggcagccagtcccccagcaccgagatcacgctcaagtacccggggatctcccagagctccggcggggacatcggcgtccacatggcccacgacgaccagagcgtgtccagcaagatcgtggcccactgcccgccccaggacccctgcctggtccacggctgcatcgtgtgcgcccaggcgtggatcatctcccagtggcacaccgccctgagcgccttcgtggtcatcttcgtgttctccagcaccgccatcatctgcctcgccgtgctgtaccgcgtcctgaagtgcctcaagatcgcgccccggaaggtgctgaaccccctgatgtggatcaccgccttcatccgctgggtgtacaagaagatggtcgcccgggtggccgacaacatcaaccaggtgaaccgcgagatcgggtggatggagggcgggcagctcgccctgggcaaccccgcgcccatcccgcggcacgcccccatcccccgctactccacgtacctgatgctcctgctgatcgtcagctacgccagcgcc

SEQ ID NO: 13004 - RNA, 1680 nt, synthetic construct
  misc_feature 1..1680: note = derived and/or modified CDS sequence (opt1) from RVFV(KEN/Gar-004/06)__HM586964.1__Gn
  source 1..1680: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgcagagcgcccacggcaacccctgcatgaaggagaagctcgtcatgaagacgcactgccccaacgactaccagtccgcccactacctgaacaacgacggcaagatggcgagcgtgaagtgcccgcccaagtacgagctgaccgaggactgcaacttctgccggcagatgaccggggcctccctcaagaagggcagctaccccctgcaggacctgttctgccagtccagcgaggacgacgggtccaagctcaagaccaagatgaagggcgtgtgcgaggtcggggtgcaggccctgaagaagtgcgacggccagctgagcacggcccacgaggtggtccccttcgccgtgttcaagaactcccagaaggtgtacctcgacaagctggacctgaagaccgaggagaacctcctgcccgacagcttcgtctgcttcgagcacaagggccagtacaaggggaccatggactccggccagaccaagcgcgagctcaagagcttcgacatctcccagtgccccaagatcgggggccacggccggaagaagcgcacgggggacgcggccttctgcagcgcctacgagtgcaccgcccagtacgccaacgcgtactgctcccgggccaacggcagcgggatcgtgcagatccaggtgagccgcgtctggaagaagcccctgtgcgtgggctacgagcgggtggtcgtgaagcgcgagctgtccgccaagccgatccagcgggtggagccctgcacgacctgcatcaccaagtgcgagccccacgggctggtcgtgcgcagcaccggcttcaagatctccagcgccgtcgcctgcgcgtccggcgtgtgcgtgaccgggagccagtcccccagcaccgagatcacgctcaagtacccgggcatctcccagagctccgggggcgacatcggggtccacatggcccacgacgaccagagcgtgtccagcaagatcgtggcccactgcccgccccaggacccctgcctggtccacggctgcatcgtgtgcgcccacggcctgatcaacaaccagtcccacagcgcgctctccgccttcgtggtcatcttcgtgttcagctccaccgccatcatctgcctggccgtgctgtaccgggtcctcaagtgcctgaagatcgcgccccgcaaggtgctgaaccccctcatgtggatcaccgccttcatccggtgggtgtacaagaagatggtcgcccgcgtggccgacaacatcaaccaggtgaaccgggagatcgggtggatggagggcgggcagctggccctgggcaaccccgcccccatcccgcgccacgcgcccatcccccggtacagcacctacctcatgctgctgctcatcgtcagctacgcctccgcc

SEQ ID NO: 13005 - RNA, 1521 nt, synthetic construct
  misc_feature 1..1521: note = derived and/or modified CDS sequence (opt1) from RVFV(ZH-548)__DQ380206.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacgcgcaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcagcctgtccgcccacaacaaggacgggagcctccacatcgtgctgccgtccgagaacggcaccaaggaccagtgccagatcctgcacttcacggtccccgaggtggaggaggagttcatgtacagctgcgacggcgacgagcggcccctcctggtcaaggggaccctgatcgccatcgaccccttcgacgaccgccgggaggccggcggggagtccaccgtggtgaaccccaagagcggctcctggaacttcttcgactggttcagcgggctcatgtcctggttcggcggcccgctgaagaccatcctgctcatctgcctgtacgtcgccctgagcatcggcctcttcttcctgctgatctacctcgggcgcacggggctgtccaagatgtggctggcggccaccaagaaggccagc

SEQ ID NO: 13006 - RNA, 1521 nt, synthetic construct
  misc_feature 1..1521: note = derived and/or modified CDS sequence (opt1) from RVFV(35/74)__JF784387.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacgcgcaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcggcccctcctggtcaaggggaccctgatcgccatcgaccccttcgacgaccgccgggaggccggcggggagagcaccgtggtgaacccgaagtccggcagctggaacttcttcgactggttctccgggctcatgagctggttcggcggccccctgaagacgatcctgctcatctgcctgtacgtcgccctgtccatcggcctcttcttcctgctgatctacctcgggcgcaccgggctgagcaagatgtggctggcggccaccaagaaggcctcc

SEQ ID NO: 13007 - RNA, 1521 nt, synthetic construct
  misc_feature 1..1521: note = derived and/or modified CDS sequence (opt1) from RVFV(200803162)__JF311377.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctggtcagctacaagcccatgatcgaccagctcgagtgcaccaccaacctgatcgaccccttcgtggtgttcgagcgggggtccctgccccagacgcgcaacgacaagaccttcgccgccagcaagggcaaccgcggggtccaggccttcagcaagggctccgtgcaggccgacctcaccctgatgttcgacaacttcgaggtggacttcgtcggcgcggccgtgagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtcctgccgagcgagaacggcacgaaggaccagtgccagatcctgcacttcaccgtgcccgaggtcgaggaggagttcatgtactcctgcgacggcgacgagcggcccctcctggtgaaggggaccctgatcgccatcgaccccttcgacgaccgccgggaggccggcggggagagcaccgtggtcaacccgaagtccggcagctggaacttcttcgactggttctccgggctcatgagctggttcggcggccccctgaagacgatcctgctcatctgcctgtacgtggccctgtccatcggcctcttcttcctgctgatctacctcgggcgcaccgggctgagcaagatgtggctggcggccaccaagaaggcctcc

SEQ ID NO: 13008 - RNA, 1521 nt, synthetic construct
  misc_feature 1..1521: note = derived and/or modified CDS sequence (opt1) from RVFV(200803166)__JF311381.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacgcgcaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacgtggtcctgccgagcgagaacggcacgaaggaccagtgccagatcctgcacttcaccgtgcccgaggtcgaggaggagttcatgtactcctgcgacggcgacgagcggcccctcctggtgaaggggaccctgatcgccatcgaccccttcgacgaccgccgggaggccggcggggagagcaccgtggtcaacccgaagtccggcagctggaacttcttcgactggttctccgggctcatgagctggttcggcggccccctgaagacgatcctgctcatctgcctgtacgtggccctgtccatcggcctcttcttcctgctgatctacctcgggcgcaccgggctgagcaagatgtggctggcggccaccaagaaggcctcc

SEQ ID NO: 13009 - RNA, 1521 nt, synthetic construct
  misc_feature 1..1521: note = derived and/or modified CDS sequence (opt1) from RVFV(SA-51 (Van Wyck))__DQ380195.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggaggtgaccgacttcgacggcagcgtcagcacgatcgacctgggcgcgtccagctcccggttcaccaactgggggagcgtgtccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtcctcagcgcccacgagtcctgcctgcgcgcgccgaacctgatcagctacaagcccatgatcgaccagctcgagtgcaccaccaacctgatcgaccccttcgtggtgttcgagcgggggtccctgccccagacgcgcaacgacaagaccttcgccgccagcaagggcaaccgcggggtccaggccttcagcaagggctccgtgcaggccgacctcaccctgatgttcgacaacttcgaggtggacttcgtcggcgcggccgtgagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtcctgccgagcgagaacggcacgaaggaccagtgccagatcctgcacttcaccgtgcccgaggtcgaggaggagttcatgtactcctgcgacggcgacgagcggcccctcctggtgaaggggaccctgatcgccatcgaccccttcgacgaccgccgggaggccggcggggagagcaccgtggtcaacccgaagtccggcagctggaacttcttcgactggttctccgggctcatgagctggttcggcggccccctgaagacgatcctgctcatctgcctgtacgtggccctgtccatcggcctcttcttcctgctgatctacctcgggcgcaccgggctgagcaagatgtggctggcggccaccaagaaggcctcc

SEQ ID NO: 13010 - RNA, 1521 nt, synthetic construct
  misc_feature 1..1521: note = derived and/or modified CDS sequence (opt1) from RVFV(ZINGA J83 R1)__KU978776.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacgcgcaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcggcccctcctggtccgcgggaccctgatcgccatcgaccccttcgacgaccggcgcgaggccggcggggagagcaccgtggtgaacccgaagtccggcagctggaacttcttcgactggttctccgggctcatgagctggttcggcggccccctgaagacgatcctgctcatctgcctgtacgtcgccctgtccatcggcctcttcttcctgctgatctacctcgggcgcaccgggctgagcaagatgtggctggcggccaccaagaaggcctcc

SEQ ID NO: 13011 - RNA, 1521 nt, synthetic construct
  misc_feature 1..1521: note = derived and/or modified CDS sequence (opt1) from RVFV(Entebbe)__DQ380191.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacggtcgacctgggcgcgtccagctcccggttcaccaactgggggagcgtgtccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtcctcagcgcccacgagtcctgcctgcgcgcgccgaacctgatcagctacaagcccatgatcgaccagctcgagtgcaccaccaacctgatcgaccccttcgtggtgttcgagcgggggtccctgccccagacgcgcaacgacaagaccttcgccgccagcaagggcaaccgcggggtccaggccttcagcaagggctccgtgcaggccgacctcaccctgatgttcgacaacttcgaggtggacttcgtcggcgcggccgtgagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtcctgccgagcgagaacggcacgaaggaccagtgccagatcctgcacttcaccgtgcccgaggtcgaggaggagttcatgtactcctgcgacggcgacgagcggcccctcctggtgaaggggaccctgatcgccatcgaccccttcgacgaccgccgggaggccggcggggagagcaccgtggtcaacccgaagtccggcagctggaacttcttcgactggttctccgggctcatgagctggttcggcggccccctgaagacgatcctgctcatctgcctgtacgtggccctgtccatcggcctcttcttcctgctgatctacctcgggcgcaccgggctgagcaagatgtggctggcggccaccaagaaggcctcc

SEQ ID NO: 13012 - RNA, 1521 nt, synthetic construct
  misc_feature 1..1521: note = derived and/or modified CDS sequence (opt1) from RVFV(Sudan 2V-2007)__JQ820490.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacgcgcaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcggcccctcctggtcaaggggaccctgatggccatcgaccccttcgacgaccgccgggaggccggcggggagagcaccgtggtgaacccgaagtccggcagctggaacttcttcgactggttctccgggctcatgagctggttcggcggccccctgaagacgatcctgctcatctgcctgtacgtcgccctgtccatcggcctcttcttcctgctgatctacctcgggcgcaccgggctgagcaagatgtggctggcggccaccaagaaggcctcc

SEQ ID NO: 13013 - RNA, 1521 nt, synthetic construct
  misc_feature 1..1521: note = derived and/or modified CDS sequence (opt1) from RVFV(Sudan 86-2010)__JQ820489.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcatcttcgagcgggggtccctgccccagacgcgcaacgacaagaccttcgccgccagcaagggcaaccgcggggtgcaggccttcagcaagggctccgtgcaggccgacctcaccctgatgttcgacaacttcgaggtcgacttcgtgggcgcggccgtgagctgcgacgccgccttcctgaacctcaccgggtgctactcctgcaacgccggcgcgcgggtctgcctgagcatcacgtccaccgggaccggcaccctgagcgcccacaacaaggacgggtccctccacatcgtgctgccgagcgagaacggcacgaaggaccagtgccagatcctgcacttcaccgtgcccgaggtcgaggaggagttcatgtactcctgcgacggcgacgagcggcccctcctggtgaaggggaccctgatcgccatcgaccccttcgacgaccgccgggaggccggcggggagagcaccgtcgtgaacccgaagtccggcagctggaacttcttcgactggttctccgggctcatgagctggttcggcggccccctgaagacgatcctgctcatctgcctgtacgtggccctgtccatcggcctcttcttcctgctgatctacctcgggcgcaccgggctgagcaagatgtggctggcggccaccaagaaggcctcc

SEQ ID NO: 13014 - RNA, 1521 nt, synthetic construct
  misc_feature 1..1521: note = derived and/or modified CDS sequence (opt1) from RVFV(Kenya 56 (IB8))__DQ380190.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgccttcgagcgggggtccctgccccagacgcgcaacgacaagaccttcgccgccagcaagggcaaccgcggggtgcaggccttcagcaagggctccgtgcaggcggacctcaccctgatgttcgacaacttcgaggtcgacttcgtgggcgccgccgtgagctgcgacgccgccttcctgaacctcaccgggtgctactcctgcaacgcgggcgcccgggtctgcctgagcatcacgtccaccgggaccggcaccctgagcgcccacaacaaggacgggtccctccacatcgtgctgccgagcgagaacggcacgaaggaccagtgccagatcctgcacttcaccgtgcccgaggtcgaggaggagttcatgtactcctgcgacggcgacgagcggcccctcctggtgaaggggaccctgatcgccatcgaccccttcgacgaccgccgggaggccggcggggagagcaccgtcgtgaacccgaagtccggcagctggaacttcttcgactggttctccgggctcatgagctggttcggcggccccctgaagacgatcctgctcatctgcctgtacgtggcgctgtccatcggcctcttcttcctgctgatctacctcgggcgcaccgggctgagcaagatgtggctggccgccaccaagaaggcctcc

SEQ ID NO: 13015 - RNA, 1521 nt, synthetic construct
  misc_feature 1..1521: note = derived and/or modified CDS sequence (opt1) from RVFV(ARD-38388)__DQ380187.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcatcggggagtccaccacgatgcgcgagaacaagtgcttcgagcagtgcggcgggtggggctgcgggtgcttcaacgtgaacccgagctgcctcttcgtccacacctacctgcagtccgtgcggaaggaggccctgcgcgtgttcaactgcatcgactgggtccacaagctcaccctggagatcaccgacttcgacggcagcgtgagcacgatcgacctgggcgcgtccagctcccggttcaccaactgggggagcgtgtccctcagcctggacgccgagggcatctccgggagcaactccttcagcttcatcgagtcccccggcaagggctacgccatcgtcgacgagcccttcagcgagatcccccgccaggggttcctgggcgagatccggtgcaactccgagagctccatcctcagcgcccacgagtcctgcctgcgcgcgccgaacctgatcagctacaagcccatgatcgaccagctcgagtgcaccaccaacctgatcgaccccttcgtggtgttcgagcgggggtccctgccccagacgcgcaacgacaagaccttcgccgccagcaagggcaaccgcggggtccaggccttcagcaagggctccgtgcaggccgacctcaccctgatgttcgacaacttcgaggtggacttcgtcggcgcggccgtgagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtcctgccgagcgagaacggcacgaaggaccagtgccagatcctgcacttcaccgtgcccgaggtggaggaggagttcatgtactcctgcgacggcgacgagcggcccctcctggtcaaggggaccctgatcgccatcgaccccttcgacgaccgccgggaggccggcggggagagcaccgtggtcaacccgaagtccggcagctggaacttcttcgactggttctccgggctcatgagctggttcggcggccccctgaagacgatcctgctcatctgcctgtacgtggccctgtccatcggcctcttcttcctgctgatctacctcgggcgcaccgggctgagcaagatgtggctggcggccaccaagaaggcctcc

SEQ ID NO: 13016 - RNA, 1521 nt, synthetic construct
  misc_feature 1..1521: note = derived and/or modified CDS sequence (opt1) from RVFV(Sudan 28-2010)__JQ820491.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacgcgcaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcggcccctcctggtcaaggggaccctgatcgccatcgaccccttcgacgaccgccgggaggccggcggggagagcaccgtggtgaacccgaagtccggcagctggaacttcttcgactggttctccgggctcatgagctggttcggcggccccctgaagacgatcctgctcatctgcctgtacgtcgtgctgtccatcggcctcttcttcctgctgatctacctcgggcgcaccgggctgagcaagatgtggctggccgcgaccaagaaggcctcc

SEQ ID NO: 13017 - RNA, 1521 nt, synthetic construct
  misc_feature 1..1521: note = derived and/or modified CDS sequence (opt1) from RVFV(200803167)__JF311382.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacgcgcaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcggcccctcctggtcaaggggaccctgatcgccatcgaccccttcgacgaccgccgggaggccggcggggagagcaccgtggtgaacccgaagtccggcagctggaacttcttcgactggttctccgggctcatgagctggttcggcggccccctgaagacgatgctgctcatctgcctgtacgtcgccctgtccatcggcctcttcttcctgctgatctacctcgggcgcaccgggctgagcaagatgtggctggcggccaccaagaaggcctcc

SEQ ID NO: 13018 - RNA, 1521 nt, synthetic construct
  misc_feature 1..1521: note = derived and/or modified CDS sequence (opt1) from RVFV(73HB1230)__DQ380221.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccatcatgcgcgagaacaagtgcttcgagcagtgcggcgggtggggctgcgggtgcttcaacgtcaacccgagctgcctcttcgtgcacacgtacctgcagtccgtgcggaaggaggccctgcgcgtcttcaactgcatcgactgggtgcacaagctcaccctggagatcaccgacttcgacggcagcgtgagcaccatcgacctgggcgcgtccagctcccggttcacgaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacccgcaacgacaagacgttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacctccacggggaccggcaccctgagcgcccacaacaaggacgggtccctccacatcgtgctgccgagcgagaacggcaccaaggaccagtgccagatcctgcacttcacggtccccgaggtggaggaggagttcatgtactcctgcgacggcgacgagcggcccctcctggtcaaggggaccctgatcgccatcgaccccttcgacgaccgccgggaggccggcggggagagcaccgtggtgaacccgaagtccggcagctggaacttcttcgactggttctccgggctcatgagctggttcggcggccccctgaagaccatcctgctcatctgcctgtacgtcgccctgtccatcggcctcttcttcctgctgatctacctcgggcgcacggggctgagcaagatgtggctggcggccaccaagaaggcctcc

SEQ ID NO: 13019 - RNA, 1521 nt, synthetic construct
  misc_feature 1..1521: note = derived and/or modified CDS sequence (opt1) from RVFV(2250/74)__DQ380209.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacgcgcaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgaaggtgtgcctgagcatcacgtccaccgggaccggcagcctgtccgcccacaacaaggacgggagcctccacatcgtgctgccgtccgagaacggcaccaaggaccagtgccagatcctgcacttcacggtccccgaggtggaggaggagttcatgtacagctgcgacggcgacgagcggcccctcctggtcaaggggaccctgatcgccatcgaccccttcgacgaccggcgcgaggccggcggggagtccaccgtggtgaaccccaagagcggctcctggaacttcttcgactggttcagcgggctcatgtcctggttcggcggcccgctgaagaccatcctgctcatctgcctgtacgtcgccctgagcatcggcctcttcttcctgctgatctacctcgggcggacggggctgtccaagatgtggctggcggccaccaagaaggccagc

SEQ ID NO: 13020 - RNA, 1521 nt, synthetic construct
  misc_feature 1..1521: note = derived and/or modified CDS sequence (opt1) from RVFV(SAUDI 200010901)__KU978778.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacgcgcaacgagaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcggcccctcctggtcaaggggaccctgatcgccatcgaccccttcgacgaccgccgggaggccggcggggagagcaccgtggtgaacccgaagtccggcagctggaacttcttcgactggttctccgggctcatgagctggttcggcggccccctgaagacgatcctgctcatctgcctgtacgtcgccctgtccatcggcctcttcttcctgctgatctacctcgggcgcaccgggctgagcaagatgtggctggcggccaccaagaaggcctcc

SEQ ID NO: 13021 - RNA, 1521 nt, synthetic construct
  misc_feature 1..1521: note = derived and/or modified CDS sequence (opt1) from RVFV(Lunyo)__KU167026.1__Gc
  source 1..1521: mol_type = other RNA
tgcagcgagctgatccaggcctccagccgcatcacgacctgctccaccgagggcgtgaacacccggtgccgcctcagcgggaccgccctgatccgggcgggctccgtcggggccgaggcctgcctgatgctcaagggcgtgaaggaggaccagaccaagttcctgaagatcaagacggtgagctccgagctgagctgccgcgaggggcagtcctactggaccggcagcttctcccccaagtgcctcagctcccggcgctgccacctggtcggcgagtgccacgtgaaccggtgcctgagctggcgcgacaacgagacctccgccgagttcagcttcgtgggggagtccaccacgatgcgggagaacaagtgcttcgagcagtgcggcgggtggggctgcgggtgcttcaacgtcaacccgagctgcctcttcgtgcacacctacctgcagtccgtgcgcaaggaggccctgcgggtcttcaactgcatcgactgggtgcacaagctcaccctggagatcaccgacttcgacggcagcgtgagcacgatcgacctgggcgcgtccagctcccgcttcaccaactgggggagcgtctccctcagcctggacgccgagggcatctccgggagcaactccttcagcttcatcgagtcccccggcaagggctacgccatcgtggacgagcccttcagcgagatcccccggcaggggttcctgggcgagatccgctgcaactccgagagctccgtgctcagcgcccacgagtcctgcctgcgggcgccgaacctgatcagctacaagcccatgatcgaccagctcgagtgcaccaccaacctgatcgaccccttcgtcgtgttcgagcgcgggtccctgccccagacgcggaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcgccccctcctggtcaaggggaccctgatcgccatcgaccccttcgacgaccggcgcgaggccggcggggagagcaccgtggtgaacccgaagtccggcagctggaacttcttcgactggttctccgggctcatgagctggttcggcggccccctgaagacgatcctgctcatctgcctgtacgtcgccctgtccatcggcctcttcttcctgctgatctacctcgggcgcaccgggctgagcaagatgtggctggcggccaccaagaaggcctcc

SEQ ID NO: 13022 - RNA, 1521 nt, synthetic construct
  misc_feature 1..1521: note = derived and/or modified CDS sequence (opt1) from RVFV(25010-24)__KM210509.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggacgaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacgcgcaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcggcccctcctggtcaaggggaccctgatcgccatcgaccccttcgacgaccgccgggaggccggcggggagagcaccgtggtgaacccgaagtccggcagctggaacttcttcgactggttctccgggctcatgagctggttcggcggccccctgaagacgatcctgctcatctgcctgtacgtcgccctgtccatcggcctcttcttcctgctgatctacctcgggcgcaccgggctgagcaagatgtggctggcggccaccaagaaggcctcc

SEQ ID NO: 13023 - RNA, 1521 nt, synthetic construct
  misc_feature 1..1521: note = derived and/or modified CDS sequence (opt1) from RVFV(2007000253)__JF326192.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgccggggccgaggcctgcctgatgctcaagggcgtcaaggaggaccagaccaagttcctgaagatcaagacggtgagctccgagctgagctgccgggaggggcagtcctactggaccggcagcttctcccccaagtgcctcagctcccgccggtgccacctggtgggcgagtgccacgtcaaccgctgcctgagctggcgggacaacgagacctccgccgagttcagcttcgtgggggagtccaccacgatgcgcgagaacaagtgcttcgagcagtgcggcgggtggggctgcgggtgcttcaacgtgaacccgagctgcctcttcgtccacacctacctgcagtccgtgcggaaggaggcgctgcgcgtgttcaactgcatcgactgggtccacaagctcaccctggagatcaccgacttcgacggcagcgtgagcacgatcgacctgggcgcctccagctcccggttcaccaactgggggagcgtgtccctcagcctggacgccgagggcatctccgggagcaactccttcagcttcatcgagtcccccggcaagggctacgccatcgtcgacgagcccttcagcgagatcccccgccaggggttcctgggcgagatccggtgcaactccgagagctccgtgctcagcgcgcacgagtcctgcctgcgcgccccgaacctggtgagctacaagcccatgatcgaccagctcgagtgcaccaccaacctgatcgaccccttcgtcgtgttcgagcgggggtccctgccccagacgcgcaacgacaagaccttcgccgccagcaagggcaaccgcggggtgcaggccttcagcaagggctccgtccaggcggacctcaccctgatgttcgacaacttcgaggtggacttcgtgggcgccgccgtcagctgcgacgccgccttcctgaacctcaccgggtgctactcctgcaacgcgggcgcccgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcggcccctcctggtcaaggggaccctgatcgccatcgaccccttcgacgaccgccgggaggccggcggggagagcaccgtggtgaacccgaagtccggcagctggaacttcttcgactggttctccgggctcatgagctggttcggcggccccctgaagacgatcctgctcatctgcctgtacgtcgcgctgtccatcggcctcttcttcctgctgatctacctcgggcgcaccgggctgagcaagatgtggctggccgccaccaagaaggcctcc

SEQ ID NO: 13024 - RNA, 1521 nt, synthetic construct
  misc_feature 1..1521: note = derived and/or modified CDS sequence (opt1) from RVFV(ZC-3349)__DQ380207.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgaaggcgccgaacctgatcagctacaagcccatgatcgaccagctcgagtgcaccaccaacctgatcgaccccttcgtcgtgttcgagcgcgggtccctgccccagacgcggaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcagcctgtccgcccacaacaaggacgggagcctccacatcgtgctgccgtccgagaacggcaccaaggaccagtgccagatcctgcacttcacggtccccgaggtggaggaggagttcatgtacagctgcgacggcgacgagcgccccctcctggtcaaggggaccctgatcgccatcgaccccttcgacgaccggcgcgaggccggcggggagtccaccgtggtgaaccccaagagcggctcctggaacttcttcgactggttcagcgggctcatgtcctggttcggcggcccgctgaagaccatcctgctcatctgcctgtacgtcgccctgagcatcggcctcttcttcctgctgatctacctcgggcggacggggctgtccaagatgtggctggcggccaccaagaaggccagc

SEQ ID NO: 13025 - RNA, 1521 nt, synthetic construct
  misc_feature 1..1521: note = derived and/or modified CDS sequence (opt1) from RVFV(OS-1)__DQ380186.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgaaggtcttcaactgcatcgactgggtgcacaagctcaccctggagatcaccgacttcgacggcagcgtgagcacgatcgacctgggcgcgtccagctcccgcttcaccaactgggggagcgtctccctcagcctggacgccgagggcatctccgggagcaactccttcagcttcatcgagtcccccggcaagggctacgccatcgtggacgagcccttcagcgagatcccccggcaggggttcctgggcgagatccgctgcaactccgagagctccgtgctcagcgcccacgagtcctgcctgcgggcgccgaacctgatcagctacaagcccatgatcgaccagctcgagtgcaccaccaacctgatcgaccccttcgtcgtgttcgagcgcgggtccctgccccagacgcggaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcgccccctcctggtcaaggggaccctgatcgccatcgaccccttcgacgaccggcgcgaggccggcggggagagcaccgtggtgaacccgaagtccggcagctggaacttcttcgactggttctccgggctcatgagctggttcggcggccccctgaagacgatcctgctcatctgcctgtacgtcgccctgtccatcggcctcttcttcctgctgatctacctcgggcggaccgggctgagcaagatgtggctggcggccaccaagaaggcctcc

SEQ ID NO: 13026 - RNA, 1521 nt, synthetic construct
  misc_feature 1..1521: note = derived and/or modified CDS sequence (opt1) from RVFV(KEN/Gar-004/06)__HM586964.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctggtcagctacaagcccatgatcgaccagctcgagtgcaccaccaacctgatcgaccccttcgtggtgttcgagcgggggtccctgccccagacgcgcaacgacaagaccttcgccgccagcaagggcaaccgcggggtccaggccttcagcaagggctccgtgcaggccgacctcaccctgcggttcgacaacttcgaggtggacttcgtcggcgcggccgtgagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtcctgccgagcgagaacggcacgaaggaccagtgccagatcctgcacttcaccgtgcccgaggtcgaggaggagttcatgtactcctgcgacggcgacgagcgccccctcctggtgaaggggaccctgatcgccatcgaccccttcgacgaccggcgcgaggccggcggggagagcaccgtggtcaacccgaagtccggcagctggaacttcttcgactggttctccgggctcatgagctggttcggcggccccctgaagacgatcctgctcatctgcctgtacgtggccctgtccatcggcctcttcttcctgctgatctacctcgggcgcaccgggctgagcaagatgtggctggcggccaccaagaaggcctcc

SEQ ID NO: 13027 - RNA, 1521 nt, synthetic construct
  misc_feature 1..1521: note = derived and/or modified CDS sequence (opt1) from RVFV(Smithburn)__DQ380193.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacggtcgacctgggcgcgtccagctcccggttcaccaactgggggagcgtgtccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtcctcagcgcccacgagtcctgcctgcgcgcgccgaacctgatcagctacaagcccatgatcgaccagctcgagtgcaccaccaacctgatcgaccccttcgtggtgttcgagcgggggtccctgccccagacgcgcaacgacaagaccttcgccgccagcaagggcaaccgcggggtccaggccttcagcaagggctccgtgcaggccgacctcaccctgatgttcgacaacttcgaggtggacttcgtcggcgcggccgtgagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtcctgccgagcgagaacggcacgaaggaccagtgccagatcctgcacttcaccgtgcccgaggtcgaggaggagttcatgtactcctgcgacggcgacgagcggcccctcctggtgaaggggaccctgatcgccatcgaccccttcgacgaccgccgggaggccggcggggagagcaccgtggtcaacccgaagtccggcagctggaacttcttcgactggttctccgggctcatgagctggttcggcggccccctgaagacgatcctgctcatctgcctgtacgtggccctgtccatcggcctcttcttcttcctgatctacctggggcgcaccgggctcagcaagatgtggctggcggccaccaagaaggcctcc

SEQ ID NO: 13028 - RNA, 1521 nt, synthetic construct
  misc_feature 1..1521: note = derived and/or modified CDS sequence (opt1) from RVFV(2008/00101)__HE687306.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctggtcagctacaagcccatgatcgaccagctcgagtgcaccaccaacctgatcgaccccttcgtggtgttcgagcgggggtccctgccccagacgcgcaacgacaagaccttcgccgccagcaagggcaaccgcggggtccaggccttcagcaagggctccgtgcaggccgacctcaccctgatgttcgacaacttcgaggtggacttcgtcggcgcggccgtgagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtcctgccgagcgagaacggcacgaaggaccagtgccagatcctgcacttcaccgtgcccgaggtcgaggaggagttcatgtactcctgcgacggcgacgagcggcccctcctggtgaaggggaccctgatcgccatcgaccccttcgacgaccgccgggaggccggcggggagagcaccgtggtcaacccgaagtccggcagctggaacttcttcgactggttctccgggctcatgagctggttcggcggccccctgaagacgaccctgctcatctgcctgtacgtggccctgtccatcggcctcttcttcctgctgatctacctcgggcgcaccgggctgagcaagatgtggctggcggccaccaagaaggcctcc

SEQ ID NO: 13029 - RNA, 1521 nt, synthetic construct
  misc_feature 1..1521: note = derived and/or modified CDS sequence (opt1) from RVFV(2007001292)__EU574046.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctggtcagctacaagcccatgatcgaccagctcgagtgcaccaccaacctgatcgaccccttcgtggtgttcgagcgggggtccctgccccagacgcgcaacgacaagaccttcgccgccagcaagggcaaccgcggggtccaggccttcagcaagggctccgtgcaggccgacctcaccctgatgttcgacaacttcgaggtggacttcgtcggcgcggccgtgagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtcctgccgagcgagaacggcacgaaggaccagtgccagatcctgcacttcaccgtgcccgaggtcgaggaggagttcatgtactcctgcgacggcgacgagcggcccctcctggtgaaggggaccctgatcgccatcgaccccttcgacgaccgccgggaggccggcggggagagcaccgtggtcaacccgaagtccggcagctggaacctcttcgactggttctccgggctgatgagctggttcggcggccccctgaagacgatcctcctgatctgcctgtacgtggccctctccatcgggctgttcttcctgctcatctacctgggccgcaccgggctgagcaagatgtggctcgcggccaccaagaaggcctcc

SEQ ID NO: 13030 - RNA, 1521 nt, synthetic construct
  misc_feature 1..1521: note = derived and/or modified CDS sequence (opt1) from RVFV(2007002445)__EU574037.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctggtcagctacaagcccatgatcgaccagctcgagtgcaccaccaacctgatcgaccccttcgtggtgttcgagcgggggtccctgccccagacgcgcaacgagaagaccttcgccgccagcaagggcaaccgcggggtccaggccttcagcaagggctccatccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcggcccctcctggtcaaggggaccctgatcgccatcgaccccttcgacgaccgccgggaggccggcggggagagcaccgtggtgaacccgaagtccggcagctggaacttcttcgactggttctccgggctcatgagctggttcggcggccccctgaagacgatcctgctcatctgcctgtacgtcgccctgtccatcggcctcttcttcctgctgatctacctcgggcgcaccgggctgagcaagatgtggctggcggccaccaagaaggcctcc

SEQ ID NO: 13031 - RNA, 1521 nt, synthetic construct
  misc_feature 1..1521: note = derived and/or modified CDS sequence (opt1) from RVFV(Ken 199800523)__KU978777.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcaacgcccacgagagctgcctgcgcgcgccgaacctgatctcctacaagcccatgatcgaccagctcgagtgcaccaccaacctgatcgaccccttcgtcgtgttcgagcgggggagcctgccccagacgcgcaacgacaagaccttcgccgcctccaagggcaaccgcggggtgcaggccttcagcaagggcagcgtccaggccgacctcaccctgatgttcgacaacttcgaggtggacttcgtgggcgcggccgtctcctgcgacgccgccttcctgaacctcaccgggtgctacagctgcaacgccggcgcgcgggtgtgcctgtccatcacgagcaccgggaccggcaccctgtccgcccacaacaaggaggggagcctccacatcgtgctgccgtccgagaacggcacgaaggaccagtgccagatcctgcacttcaccgtccccgaggtggaggaggagttcatgtacagctgcgacggcgacgagcggcccctcctggtcaaggggaccctgatcgccatcgaccccttcgacgaccgccgggaggccggcggggagtccaccgtggtgaaccccaagagcggctcctggaacttcttcgactggttcagcgggctcatgtcctggttcggcggcccgctgaagacgatcctgctcatctgcctgtacgtcgccctgagcatcggcctcttcttcctgctgatctacctcgggcgcaccgggctgtccaagatgtggctggcggccaccaagaaggccagc

SEQ ID NO: 13032 - RNA, 1521 nt, synthetic construct
  misc_feature 1..1521: note = derived and/or modified CDS sequence (opt1) from RVFV(clone 13)__DQ380213.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggacgaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacgcgcaacgagaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcggcccctcctggtcaaggggaccctgatcgccatcgaccccttcgacgaccgccgggaggccggcggggagagcaccgtggtgaacccgaagtccggcagctggaacttcttcgactggttctccgggctcatgagctggttcggcggccccctgaagacgatcctgctcatctgcctgtacgtcgccctgtccatcggcctcttcttcctgctgatctacctcgggcgcaccgggctgagcaagatgtggctggcggccaccaagaaggcctcc

SEQ ID NO: 13033 - RNA, 1521 nt, synthetic construct
  misc_feature 1..1521: note = derived and/or modified CDS sequence (opt1) from RVFV(2373/74)__DQ380194.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgctggacctcggcgcgtccagctcccggttcaccaactgggggagcgtctccctgagcctggacgccgagggcatctccgggagcaactccttcagcttcatcgagtcccccggcaagggctacgccatcgtggacgagcccttcagcgagatcccccgccaggggttcctcggcgagatccggtgcaactccgagagctccgtgctgagcgcccacgagtcctgcctgcgcgcgccgaacctcatcagctacaagcccatgatcgaccagctggagtgcaccaccaacctgatcgaccccttcgtcgtgttcgagcgggggtccctcccccagacgcgcaacgagaagaccttcgccgccagcaagggcaaccgcggggtgcaggccttcagcaagggctccgtccaggccgacctgaccctgatgttcgacaacttcgaggtggacttcgtgggcgcggccgtcagctgcgacgccgccttcctcaacctgaccgggtgctactcctgcaacgccggcgcgcgggtgtgcctgagcatcacgtccaccgggaccggcaccctcagcgcccacaacaaggacgggtccctgcacatcgtgctgccgagcgagaacggcacgaaggaccagtgccagatcctccacttcaccgtccccgaggtggaggaggagttcatgtactcctgcgacggcgacgagcggcccctgctggtcaaggggaccctcatcgccatcgaccccttcgacgaccgccgggaggccggcggggagagcaccgtggtgaacccgaagtccggcagctggaacttcttcgactggttctccgggctgatgagctggttcggcggccccctgaagacgatcctcctgatctgcctgtacgtcgccctctccatcgggctgttcttcctgctcatctacctgggccgcaccgggctgagcaagatgtggctcgcggccaccaagaaggcctcc

SEQ ID NO: 13034 - RNA, 1521 nt, synthetic construct
  misc_feature 1..1521: note = derived and/or modified CDS sequence (opt1) from RVFV(OS-8)__DQ380185.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgcggatcaagacggtgagctccgagctgagctgccgcgaggggcagtcctactggaccggcagcttctcccccaagtgcctcagctcccggcgctgccacctggtcggcgagtgccacgtgaaccggtgcctgagctggcgcgacaacgagacctccgccgagttcagcttcgtgggggagtccaccacgatgcgggagaacaagtgcttcgagcagtgcggcgggtggggctgcgggtgcttcaacgtcaacccgagctgcctcttcgtgcacacctacctgcagtccgtgcgcaaggaggccctgcgggtcttcaactgcatcgactgggtgcacaagctcaccctggagatcaccgacttcgacggcagcgtgagcacgatcgacctgggcgcgtccagctcccgcttcaccaactgggggagcgtctccctcagcctggacgccgagggcatctccgggagcaactccttcagcttcatcgagtcccccggcaagggctacgccatcgtggacgagcccttcagcgagatcccccggcaggggttcctgggcgagatccgctgcaactccgagagctccgtgctcagcgcccacgagtcctgcctgcgggcgccgaacctgatcagctacaagcccatgatcgaccagctcgagtgcaccaccaacctgatcgaccccttcgtcgtgttcgagcgcgggtccctgccccagacgcggaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctctccgggtgctacagctgcaacgccggcgcgcgggtgtgcctgtccatcaccagcacggggaccggcaccctgtccgcccacaacaaggacgggagcctccacatcgtgctgccgtccgagaacggcaccaaggaccagtgccagatcctgcacttcacggtccccgaggtggaggaggagttcatgtacagctgcgacggcgacgagcgccccctcctggtcaaggggaccctgatcgccatcgaccccttcgacgaccggcgcgaggccggcggggagtccaccgtggtgaaccccaagagcggctcctggaacttcttcgactggttcagcgggctcatgtcctggttcggcggcccgctgaagaccatcctgctcatctgcctgtacgtcgccctgagcatcggcctcttcttcctgctgatctacctcgggcgcacggggctgtccaagatgtggctggcggccaccaagaaggccagc

SEQ ID NO: 13035 - RNA, 1521 nt, synthetic construct
  misc_feature 1..1521: note = derived and/or modified CDS sequence (opt1) from RVFV(KEN/Bar-035/07)__HM586969.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgcggtccgtcggcgccgaggcctgcctgatgctcaagggggtgaaggaggaccagaccaagttcctgaagatcaagacggtgagctccgagctgagctgccgcgagggccagtcctactggaccgggagcttctcccccaagtgcctcagctcccggcgctgccacctggtcggcgagtgccacgtgaaccggtgcctgagctggcgcgacaacgagacctccgccgagttcagcttcgtgggcgagtccaccacgatgcgggagaacaagtgcttcgagcagtgcgggggctgggggtgcggctgcttcaacgtcaacccgagctgcctcttcgtgcacacctacctgcagtccgtgcgcaaggaggccctgcgggtcttcaactgcatcgactgggtgcacaagctcaccctggagatcaccgacttcgacgggagcgtgagcacgatcgacctgggcgcgtccagctcccgcttcaccaactggggcagcgtctccctcagcctggacgccgaggggatctccggcagcaactccttcagcttcatcgagtcccccgggaagggctacgccatcgtggacgagcccttcagcgagatcccccggcagggcttcctgggggagatccgctgcaactccgagagctccgtgctcagcgcccacgagtcctgcctgcgggcgccgaacctggtcagctacaagcccatgatcgaccagctcgagtgcaccaccaacctgatcgaccccttcgtggtgttcgagcgcggctccctgccccagacgcggaacgacaagaccttcgccgccagcaaggggaaccgcggcgtccaggccttcagcaaggggtccgtgcaggccgacctcaccctgatgttcgacaacttcgaggtggacttcgtcggcgcggccgtgagctgcgacgccgccttcctgaacctcaccggctgctactcctgcaacgccggggcgcgggtgtgcctgagcatcacgtccaccggcaccgggaccctgagcgcccacaacaaggacggctccctccacatcgtcctgccgagcgagaacgggacgaaggaccagtgccagatcctgcacttcaccgtgcccgaggtcgaggaggagttcatgtactcctgcgacggcgacgagcgccccctcctggtgaagggcaccctgatcgccatcgaccccttcgacgaccggcgcgaggccgggggcgagagcaccgtggtcaacccgaagtccgggagctggaacttcttcgactggttctccggcctcatgagctggttcgggggccccctgaagacgatcctgctcatctgcctgtacgtggccctgtccatcggcctcttcttcctgctgatctacctcgggcgcaccggcctgagcaagatgtggctggcggccaccaagaaggcctcc

SEQ ID NO: 13036 - RNA, 1521 nt, synthetic construct
  misc_feature 1..1521: note = derived and/or modified CDS sequence (opt1) from RVFV(MgH824)__DQ380210.1__Gc
  source 1..1521: mol_type = other RNA
tgcagcgagctgatccaggcctccagccgcatcacgacctgctccaccgagggcgtggacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttccccgagatcccgcgccaggggttcctgggcgagatccggtgcaacagcgagtccagcgtgctctccgcccacgagagctgcctgcgcgcgcccaacctgatctcctacaagcccatgatcgaccagctcgagtgcaccaccaacctgatcgaccccttcgtcgtgttcgagcgggggagcctgccgcagacgcgcaacgacaagaccttcgccgcctccaagggcaaccgcggggtgcaggccttcagcaagggcagcgtccaggccgacctcaccctgatgttcgacaacttcgaggtggacttcgtgggcgcggccgtctcctgcgacgccgccttcctgaacctcaccgggtgctacagctgcaacgccggcgcgcgggtgtgcctgtccatcacgagcaccgggaccggctccctgagcgcccacaacaaggacgggtccctccacatcgtgctgcccagcgagaacggcaccaaggaccagtgccagatcctgcacttcacggtccccgaggtggaggaggagttcatgtactcctgcgacggcgacgagcggcccctcctggtcaaggggaccctgatcgccatcgacccgttcgacgaccgccgggaggccggcggggagagcaccgtggtgaaccccaagtccggcagctggaacttcttcgactggttctccgggctcatgagctggttcggcggccccctgaagaccatcctgctcatctgcctgtacgtcgccctgtccatcggcctcttcttcctgctgatctacctcgggcgcacggggctgagcaagatgtggctggcggccaccaagaaggcctcc

SEQ ID NO: 13037 - RNA, 1521 nt, synthetic construct
  misc_feature 1..1521: note = derived and/or modified CDS sequence (opt1) from RVFV(200803169)__JF311384.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggtggaccagaccaagttcctgaagatcaagacggtcagctccgagctgagctgccgggaggggcagtcctactggaccggcagcttctcccccaagtgcctcagctcccgccggtgccacctggtgggcgagtgccacgtgaaccgctgcctgagctggcgggacaacgagacctccgccgagttcagcttcgtcggggagtccaccacgatgcgcgagaacaagtgcttcgagcagtgcggcgggtggggctgcgggtgcttcaacgtgaacccgagctgcctcttcgtgcacacctacctgcagtccgtccggaaggaggccctgcgcgtgttcaactgcatcgactgggtgcacaagctcaccctggagatcaccgacttcgacggcagcgtcagcacgatcgacctgggcgcgtccagctcccggttcaccaactgggggagcgtgtccctcagcctggacgccgagggcatctccgggagcaactccttcagcttcatcgagtcccccggcaagggctacgccatcgtggacgagcccttcagcgagatcccccgccaggggttcctgggcgaggtccggtgcaactccgagagctccgtgctcagcgcccacgagtcctgcctgcgcgcgccgaacctggtgagctacaagcccatgatcgaccagctcgagtgcaccaccaacctgatcgaccccttcgtcgtgttcgagcgggggtccctgccccagacgcgcaacgacaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtcctgccgagcgagaacggcacgaaggaccagtgccagatcctgcacttcaccgtgcccgaggtggaggaggagttcatgtactcctgcgacggcgacgagcggcccctcctggtcaaggggaccctgatcgccatcgaccccttcgacgaccgccgggaggccggcggggagagcaccgtggtgaacccgaagtccggcagctggaacttcttcgactggttctccgggctcatgagctggttcggcggccccctgaagacgatcctgctcatctgcctgtacgtcgccctgtccatcggcctcttcttcctgctgatctacctcgggcgcaccgggctgagcaagatgtggctggcggccaccaagaaggcctcc

SEQ ID NO: 13038 - RNA, 1521 nt, synthetic construct
  misc_feature 1..1521: note = derived and/or modified CDS sequence (opt1) from RVFV(2007001811)__EU574040.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgatgatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgcaccaccaacctgatcgaccccttcgtcgtgttcgagcgggggtccctgccccagacgcgcaacgagaagaccttcgccgccagcaagggcaaccgcggggtgcaggccttcagcaagggctccgtccaggccgacctcaccctgatgttcgacaacttcgaggtggacttcgtgggcgcggccgtcagctgcgacgccgccttcctgaacctcaccgggtgctactcctgcaacgccggcgcgcgggtgtgcctgagcatcacgtccaccgggaccggcaccctgagcgcccacaacaaggacgggtccctccacatcgtgctgccgagcgagaacggcacgaaggaccagtgccagatcctgcacttcaccgtccccgaggtggaggaggagttcatgtactcctgcgacggcgacgagcggcccctcctggtcaaggggaccctgatcgccatcgaccccttcgacgaccgccgggaggccggcggggagagcaccgtggtgaacccgaagtccggcagctggaacttcttcgactggttctccgggctcatgagctggttcggcggccccctgaagacgatcctgctcatctgcctgtacgtcgccctgtccatcggcctcttcttcctgctgatctacctcgggcgcaccgggctgagcaagatgtggctggcggccaccaagaaggcctcc

SEQ ID NO: 13039 - RNA, 1521 nt, synthetic construct
  misc_feature 1..1521: note = derived and/or modified CDS sequence (opt1) from RVFV(Kenya 57 (Rintoul))__DQ380192.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacggtcgacctgggcgcgtccagctcccggttcaccaactgggggagcgtgtccctcagcctggacgccgagggcatctccgggagcaactccttcagcttcatcgagtcccccggcaagggctacgccatcgtggacgagcccttcagcgagatctcccgccaggggttcctgggcgagatccggtgcaacagcgagtccagcgtcctctccgcccacgagagctgcctgcgcgcgcccaacctgatctcctacaagccgatgatcgaccagctcgagtgcaccaccaacctgatcgaccccttcgtggtgttcgagcgggggagcctgccccagacgcgcaacgacaagaccttcgccgccagcaagggcaaccgcggggtccaggccttctccaagggcagcgtgcaggccgacctcaccctgatgttcgacaacttcgaggtggacttcgtcggcgcggccgtgtcctgcgacgccgccttcctgaacctcaccgggtgctacagctgcaacgccggcgcgcgggtgtgcctgtccatcacgagcaccgggaccggcaccctgtccgcccacaacaaggacgggagcctccacatcgtcctgccctccgagaacggcacgaaggaccagtgccagatcctgcacttcaccgtgccggaggtcgaggaggagttcatgtacagctgcgacggcgacgagcggcccctcctggtgaaggggaccctgatcgccatcgaccccttcgacgaccgccgggaggccggcggggagtccaccgtggtcaaccccaagagcggctcctggaacttcttcgactggttcagcgggctcatgtcctggttcggcggcccgctgaagacgatcctgctcatctgcctgtacgtggccctgagcatcggcctcttcttcctgctgatctacctcgggcgcaccgggctgtccaagatgtggctggcggccaccaagaaggccagc

SEQ ID NO: 13040 - RNA, 1521 nt, synthetic construct
  misc_feature 1..1521: note = derived and/or modified CDS sequence (opt1) from RVFV(Beijing-01)__KX611606.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgttcgagggcgtgaaggaggaccagaccaagttcctcaagatcaagacggtgagctccgagctgagctgccgggaggggcagtcctactggaccggcagcttctcccccaagtgcctgagctcccgccggtgccacctcgtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctgttcgtgcacacctacctccagtccgtgcggaaggaggccctgcgcgtcttcaactgcatcgactgggtgcacaagctgaccctcgagatcaccgacttcgacggcagcgtgagcacgatcgacctgggcgcgtccagctcccggttcaccaactgggggagcgtctccctgagcctcgacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctgagcgcccacgagtcctgcctccgcgcgccgaacctgatcagctacaagcccatgatcgaccagctggagtgcaccaccaacctcatcgaccccttcgtcgtgttcgagcgggggtccctgccccagacgcgcaacgacaagaccttcgccgccagcaagggcaaccgcggggtgcaggccttcagcaagggctccgtccaggccgacctgaccctcatgttcgacaacttcgaggtggacttcgtgggcgcggccgtcagctgcgacgccgccttcctgaacctgaccgggtgctactcctgcaacgccggcgcgcgggtgtgcctcagcatcacgtccaccgggaccggcaccctgagcgcccacaacaaggacgggtccctgcacatcgtgctcccgagcgagaacggcacgaaggaccagtgccagatcctgcacttcaccgtccccgaggtggaggaggagttcatgtactcctgcgacggcgacgagcggcccctgctcgtcaaggggaccctgatcgccatcgaccccttcgacgaccgccgggaggccggcggggagagcaccgtggtgaacccgaagtccggcagctggaacttcttcgactggttctccgggctgatgagctggttcggcggccccctcaagacgatcctgctgatctgcctctacgtcgccctgtccatcgggctgttcttcctcctgatctacctgggccgcaccgggctcagcaagatgtggctggcggccaccaagaaggcctcc

SEQ ID NO: 13041 - RNA, 1521 nt, synthetic construct
  misc_feature 1..1521: note = derived and/or modified CDS sequence (opt1) from RVFV(ANK-6087)__DQ380216.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagatcaagacggtgagctccgagctgagctgccgggaggggcagtcctactggaccggcagcttctcccccaagtgcctcagctcccgccggtgccacctggtcggcgagtgccacgtgaaccgctgcctgagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctcttcgtgcacacctacctgcagtccgtgcggaaggaggccctgcgcgtcttcaactgcatcgactgggtgcacaagctcaccctggagatcaccgacttcgacggcagcgtgagcacgatcgacctgggcgcgtccagctcccggttcaccaactgggggagcgtctccctcagcctggacgccgagggcatctccgggagcaactccttcagcttcatcgagtcccccggcaagggctacgccatcgtggacgagcccttcagcgagatcccccgccaggggttcctgggcgagatccggtgcaactccgagagctccgtgctcagcgcccacgagtcctgcctgcgcgcgccgaacctgatcagctacaagcccatgatcgaccagctcgagtgctccaccaacctgatcgaccccttcgtcgtgttcaagcgggggagcctgccccagacccgcaacgacaagacgttcgccgccagcaagggcaaccgcggggtgcaggccttctccaagggcagcgtccaggccgacctcaccctgatgttcgacaacttcgaggtggacttcgtgggcgcggccgtctcctgcgacgccgccttcctgaacctcaccgggtgctacagctgcaacgccggcgcgcgggtgtgcctgtccatcaccagcacggggaccggcaccctgtccgcccacaacaaggacgggagcctccacatcgtgctgccgtccgagaacggcaccaaggaccagtgccagatcctgcacttcacggtccccgaggtggaggaggagttcatgtacagctgcgacggcgacgagcggcccctcctggtccgcgggaccctgatcgccatcgaccccttcgacgaccggcgcgaggccggcggggagtccaccgtggtgaaccccaagagcggctcctggaacttcttcgactggttcagcgggctcatgtcctggttcggcggcccgctgaagaccatcctgctcatctgcctgtacgtcgccctgagcatcggcctcttcttcctgctgatctacctcgggcgcacggggctgtccaagatgtggctggcggccaccaagaaggccagc

SEQ ID NO: 13042 - RNA, 1521 nt, synthetic construct
  misc_feature 1..1521: note = derived and/or modified CDS sequence (opt1) from RVFV(MP12)__Z30318.1__Gc
  source 1..1521: mol_type = other RNA
tgcagcgagctgatccaggcctccagccgcatcacgacctgctccaccgagggcgtgaacaccaagtgccggctcagcgggaccgccctgatccgcgcgggctccgtcggggccgaggcctgcctgatgctcaagggcgtgaaggaggaccagaccaagttcctgaagctgaagacggtgagctccgagctcagctgccgggaggggcagtcctactggaccggcagcttctcccccaagtgcctgagctcccgccggtgccacctggtcggcgagtgccacgtgaaccgctgcctcagctggcgggacaacgagacctccgccgagttcagcttcgtgggggagtccaccacgatgcgcgagaacaagtgcttcgagcagtgcggcgggtggggctgcgggtgcttcaacgtcaacccgagctgcctgttcgtgcacacctacctgcagtccgtgcggaaggaggccctccgcgtcttcaactgcatcgactgggtgcacaagctgaccctggagatcaccgacttcgacggcagcgtgagcacgatcgacctcggcgcgtccagctcccggttcaccaactgggggagcgtctccctgagcctggacgccgagggcatctccgggagcaactccttcagcttcatcgagtcccccggcaagggctacgccatcgtggacgagcccttcagcgagatcccccgccaggggttcctcggcgagatccggtgcaactccgagagctccgtgctgagcgcccacgagtcctgcctgcgcgcgccgaacctcatcagctacaagcccatgatcgaccagctggagtgcaccaccaacctgatcgaccccttcgtcgtgttcgagcgggggtccctcccccagacgcgcaacgacaagaccttcgccgccagcaagggcaaccgcggggtgcaggccttcagcaagggctccgtccaggccgacctgaccctgatgttcgacaacttcgaggtggacttcgtgggcgcggccgtcagctgcgacgccgccttcctcaacctgaccgggtgctactcctgcaacgccggcgcgcgggtgtgcctgagcatcacgtccaccgggaccggcagcctctccgcccacaacaaggacgggagcctgcacatcgtgctgccgtccgagaacggcaccaaggaccagtgccagatcctccacttcacggtccccgaggtggaggaggagttcatgtacagctgcgacggcgacgagcggcccctgctggtcaaggggaccctcatcgccatcgaccccttcgacgaccgccgggaggccggcggggagtccaccgtggtgaaccccaagagcggctcctggaacttcttcgactggttcagcgggctgatgtcctggttcggcggcccgctgaagaccatcctcctgatctgcctgtacgtcgccctcagcatcgggctgttcttcctgctcatctacctgggcgggacgggcctgtccaagatgtggctcgcggccaccaagaaggccagc

SEQ ID NO: 13043 - RNA, 1521 nt, synthetic construct
  misc_feature 1..1521: note = derived and/or modified CDS sequence (opt1) from RVFV(KEN/Bar-032/07)__HM586968.1__Gc
  source 1..1521: mol_type = other RNA
tgcagcgagctgatccaggcctccagccgcatcacgacctgctccaccgagggcgtgaacaccaagtgccggctcagccacaccgccctgatccgcgcggggtccgtcggcgccgaggcctgcctgatgctcaagggggtgaaggaggaccagaccaagttcctgaagatcaagacggtgagctccgagctgagctgccgggagggccagtcctactggaccgggagcttctcccccaagtgcctcagctcccgccggtgccacctggtcggcgagtgccacgtgaaccgctgcctgagctggcgggacaacgagacctccgccgagttcagcttcgtgggcgagtccaccacgatgcgcgagaacaagtgcttcgagcagtgcgggggctgggggtgcggctgcttcaacgtcaacccgagctgcctcttcgtgcacacctacctgcagtccgtgcggaaggaggccctgcgcgtcttcaactgcatcgactgggtgcacaagctcaccctggagatcaccgacttcgacgggagcgtgagcacgatcgacctgggcgcgtccagctcccggttcaccaactggggcagcgtctccctcagcctggacgccgaggggatctccggcagcaactccttcagcttcatcgagtcccccgggaagggctacgccatcgtggacgagcccttcagcgagatcccccgccagggcttcctgggggagatccggtgcaactccgagagctccgtgctcagcgcccacgagtcctgcctgcgcgcgccgaacctggtcagctacaagcccatgatcgaccagctcgagtgcaccaccaacctgatcgaccccttcgtggtgttcgagcggggctccctgccccagacgcgcaacgacaagaccttcgccgccagcaaggggaaccggggcgtccaggccttcagcaaggggtccgtgcaggccgacctcaccctgcgcttcgacaacttcgaggtggacttcgtcggcgcggccgtgagctgcgacgccgccttcctgaacctcaccggctgctactcctgcaacgccggggcgcgggtgtgcctgagcatcacgtccaccggcaccgggaccctgagcgcccacaacaaggacggctccctccacatcgtcctgccgagcgagaacgggacgaaggaccagtgccagatcctgcacttcaccgtgcccgaggtcgaggaggagttcatgtactcctgcgacggcgacgagcgccccctcctggtgaagggcaccctgatcgccatcgaccccttcgacgaccggcgcgaggccgggggcgagagcaccgtggtcaacccgaagtccgggagctggaacttcttcgactggttctccggcctcatgagctggttcgggggccccctgaagacgatcctgctcatctgcctgtacgtggccctgtccatcggcctcttcttcctgctgatctacctcgggcgcaccggcctgagcaagatgtggctggcggccaccaagaaggcctcc

SEQ ID NO: 13044 - RNA, 4020 nt, synthetic construct
  misc_feature 1..4020: note = derived and/or modified CDS sequence (opt1) from SFNV(Toscana)__NC_006320.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgactgcaagcgggacatcatgagcaactacgtggccgaggtgcactccaacctccacggcctgggcgccatgatgcacaactacggggacgacaagcgcgtcgaggtgctgaacgacgtgatccccgacgagctcaacccgggccggcacaactgcagcgacctggaccgcaagcccttctggaccgagttcatcaacgtcgccaagcccgccaacaagatcgcgcccatctccgtgatcccgccgcccatcgtgaagcccatcccgatcgccgagagcaccatcaagaagaccatccccttcgacaagctgctctccgaggccgagaaggagctgaaccagacgaagatccggctggagaccgagcgccggagcaacgccgaggaggcggcccgcgagcgggcccgcatgcgggagatcgaggacaagctccgcaagaactgggagctggagcgggagcgcaaggacgccgtcgccgacgacctggcgaaggagatcgcccggcgccgggagatcgagcgcaaggcccacgagctcgacaagatgctgaagaagaaggagcgggaggaccaggtggccatcgagcgcgtgtccgaggacatgcgcaaccacgtccggcgccccaacaccaccatcgcccccgcgccgacgatcatcaccaccctgctcatggccagcgccgtgatggccgggcccctggagaaccgggagaccaaccacctcctgaaccgccccggcaacggggcctacacgctgtccgacttcgcggagagcacgtgcaccctggcctacggcagcaagtgcaagtcctgggagcaccagctcgacgagctgagcttccccttcttccactccaacctggacaagtacagcatgctcgaggccgccaccgagaccatcccgatcctgaacaagtccagcgccgtgtgcaccatctcccccagcacccactccagcaacgcgtgcggccgggaggcctccctgatcaagaagaagtgcgggaacaacatgagcgccttcttctacgtcaacctcgccggccagatcaccgtggtgaagtgcgacacgaaccacgtcctgtccaacgactgcgggaactgcatcagcaagaccctgtccggccagaagatctacacccccgtgcaggacatgttctgccagcgcggctggaccgagagcatcccctccacgcggtacagcaaggacctctgctccatcgggctgcacaccgtgaaggagtgcaagaccggcaccacgaacttcgagcgcgtcgggttcatcgtggtcaagagccggaagatgtacatcgagcagatgaagatgcgcagccggcaggagttctccgaggaccagttcctgtgctacaagagcgagtccagctccggcagctccgtgaagctcaagaaggtgaaggtcgagagctgcaagggggtgaccacctccagcgcgtccaagtgcagcggcgacgagtacttctgctcccgctacccgtgcgagaccgccaacgtggaggcccactgcatcctgcggcgccacagcgccgtcatcgaggtgaacgtgaacggcgtctgggtggtgccccggtgcatcgggtacgaggaggtcctggtgcgccggacgtccctcaagatggaggacaccagctcccgcgagtgcgacacgtgcctgtgggagtgcggcaagaacaagctgatcgtgaagacccacgggcccaagatcgtctacgccaccgcgtgcagccacggcagctgcaagtccgtgatgcagaagcccgccaccttcgtgtacctcccgtaccccgggaacagcgagatcgtcggcggcgacatcggggtgcacatgaccgaggagtccagcccctccaacatccacatggtggcccactgccccgccaaggacagctgcgaggtctccagctgcctgttctgcgtgcacggcctgctgaactaccagtgccacaccctcttctccgccctgctgatcagcaccacggtgatgtccatcctcaccctgctgctcctgctggtcaagggggcgaaggacctcgtgaagaagctgttctactggctgatcaccccgctctgctggctgagcgtgttctgcggctggatgatcaagtcctggaagaagaaggtcgggagcgccatctcccggaccaacgacacgatcggctggcgcgacaaccgccggtacggccgcgacgtggagcgggcccagtacaccgggggcgcccccggggccaagtacagcttctacggcgtgatgatcctgggcctcctggggaacgtccactcctgcagcgagtccgtgatcgcggacagcaaggtgatgcagtgcaccaccagcggctccagcacgctgtgcaaggcctccgggaccgtcatcatgaagctcggccccatcgggagcgagtcctgcctgatcctgaagggcctcaaggacaacgagaagcagttcatcagcatcaagaccatctccagcgagctgacctgccgcgagggcgagtccttctggacgaccctgtacaccccggtgtgcctcagctcccggcgctgccacctgatgggggagtgctgcagcgaccggtgcctgaagtggaagaccaacgagacgtccgccgagttcaccggcaaggcccacggggaggtgatgcacgagaaccgctgcttcgagcagagcggcgggatcggctacggctgcttcaacgtcaacccctcctgcctctacgtgcacagcatcctgaagtccgtgtacaagaacgggttcaagatcttccggtgcgtcgcgtggaaccaccgcatccggctggaggtgaccacccacagccgcaagttccccatggtgctcatggccatgtccacgcagcccaccgactggggcagcatcgggctgatcctggacagcgagggcatcaccgggaccaacgcctactccttcatgaagcacggcagcggctccctcgccatcatcgacgacccgtacagccccgagccccggaaggggttcctgggcgaggtccgctgccccacggaggagaccgccatccgggcgtccccgagctgcaagatggcccccaacctgatcgagtaccagcccgagatggacaccgccgagtgcaccacgaacatgatcgaccccatggccatcttcaaccgcgggtccctcccccaggtgcgggacggcatgaccttcacccagagcatcgagaagaacaccgtgcaggccctgacgaccggggaggtccgcgcgtccatccggctgaccctcgacgactacgacgtggtgtaccacaacagccagtccgactgcagcgccaccttcaagaacctgaccggctgctactcctgcgacgagggcagccgcatgtgctaccaggtcaaggccgagggggagacgatcttccacttcgtgaacgaggacgagtccatcaacgtgatcaacaaggtcagccccgacgtgtccgactactgcaccgtgctgcacttcagccggcccgtcatctccatcgagggccgctacgactgcgggctcagcaagagccccatggtgatcaagggcaccctgatcgccaccgccccgcacgacgaccgcaagcacgagggcgggtccagcctggtcgtgaaccccaagggcgggacggtggacttcttcggctgggtctccgggctcaccagctggctgggcggccccctgaagaccttcctcaccatcctggggttcctggcgctcggcctgctgctcgtggtgatcatcatcacgatcgcccggaccggggtcgagcaggccctgaagaagaagaacaagtga

SEQ ID NO: 13045 - RNA, 3972 nt, synthetic construct
  misc_feature 1..3972: note = derived and/or modified CDS sequence (opt1) from SFNV__HM566171.1__GP
  source 1..3972: mol_type = other RNA
atgctgaacaccaagagcatcatcctcatcacgtgcctggtgcagcaggtccacctgaagtacacgatcatctccgaggtgaccaagggcgcccgcgaggtgagctgctactccagcaccacccggctcgaccagctgctggaggcctgggagaacaagtccgcgctcatggggctgcgcaagggcaactgcaagctgggggccatggagcaggtcgactgcaacctcgacctgatgagcaactacgtgtccaacgtgtacgacaacccccacggcctgggggccatgatgtacaacgacaagcggatcgaggtcctcaacgaccagatcccggacagcatgatccccggcggccacaactgctccctgctggagcgcaagcccttctgggccgacctcatccccagcaagaaggagaacccgcggccctccctgatcagcctggtgcccacgccccgctccgacttcaagcggaagttcgaggaggccgaggaggagatgaagaagatccgcaaggagctccaggacgagcggcaggcgcagctgagcgtgatcgaggaggggcgcaagcggatgcgcgacctggaggacaagctcatgcggcagtggaacgaggagaagcagaagaagggcctgctggaggagaccctcgagaagaagcgccagctgaagaacaaggccctgctcgacgcccacaacctggacaagcagctgaaggagaaggaccgggagttcaagaccgccatggaggagcaccagaacgagcgccaccggatcaactccaacatgatccgcccgcccatcaccacgcccgcggccgtcatcctcaccagcctgctgtccgccagcgtggtgctcgggttcgagctggagaaccggaacaccaaccacgccctgaaccgccccggcaacgggggctactccatcagcgacaacaacctcatcgaggccaagtgcatgatcacctacggcaacaagtgcccgagctgggagatgcagctggaccccgtctcctaccccttcttcagctccaacttcgagaagtacagcctgctcgagtccatcagcgagacgtcccccatcatcgggaagttcagcgaggtgtgcgtgctgtccaacctgccgggcgcgcagaagacctgcgccaaggaggccagcctcatcaagaagcagtgctccgacgacatgcgggcctacttctacatcaacagcctggggaagctggccatcgtgacctgccccgagaacaacgtcctctcccaggactgcaacttctgcctgcgcaaggcgaagggcgagcagtacgtgtacaagcccatccaggacggcttctgccagaacgggggcgtcagctccgtgcccagcatccgctactccaaggacatctgcagcatcgggccgaccaaggtgaagaactgccacaagggcacgtcccggtacgagcgcaccgccttcatcagcaccggggacaagaaggtctacctggaggagatcaagatccggagccgccaggagtacgagcccgaccagttcctctgctacaaggtgaaggactccagctccagccccctggcctacgagaaggtgcaggtctccaagtgcaagggcatcgagaccaacagccccaagaagtgcacgggcgacgagtacttctgctccaagtacccgtgcgagagcacctcccccgaggccaactgcttcctgcggaagcacagcgccatcctggaggtgaacatcgggggcatgtggatcaagcccaagtgcatcgggtacgagatggcgctcgtcaagcgcgtgggcctgcggtccgaggacgtgagctccaaggagtgcgcgacctgcctgtgggagtgcagctccgggtacatcagcatcaccacgcacggccccaagatctcctacgccaccgcctgcagccacggcagctgcaagtccatcgtccagaacccgagcacctccatccgcatcagctaccccgggaactccgagatcgtgggcggggacatcggcatccacctcaccgaggacagctcccccatcaacctgcacctgaagatccactgcagcccgaaggactcctgcgaggtgagcgactgcatcttctgcgtccacgggctcctgaactaccagtgccactccgtggccagcgccctgctcctgtccacgatcaccgccagcctgatcgtgctcatgatctacatgctgtccaagaccaagttcgtcatgaagaagctgatccccatcatgctcacgcccctgtgctggtgcttcgtgctgctcgcctggctgaccaagagctggaagggcaagatgcggaacgccatccagtccgcgaacagcaccatcggctggaccgagcgcgaggagcggatcgtggccgagcgcccccggtcccgcaacaccgtccggtacagcttctacggggtggtgatcctggccatgctcgagagcgccttcggctgctccgagagcctgatcgccgagtccaaggtcatgcagtgcaacatcgcgaacgggaagaccagctgccgcgcctccggcaccatcatcatgaagctgggcccgatcgggagcgaggcctgcctcatcctgaagggcctgcgggactccgacaagcagtacatcagcgtgaagaccgagtccagcgagctcatctgccgcgagggggagtccttctggaccagcctgtacacccccgtgtgcctgtccagccggcgctgccacctcatgggcgagtgcacgggggacctgtgcctgaagtggaagtccaacaagaccagcctcgagttcgccggcaagacccgctccgacgtcatcaacgagaacaagtgcttcgagcagagcggcgggctgggctacgggtgcttcaacgtgaacccctcctgcctgtacacccacgcctacctcaagagcgtgtaccggaacggcttccgcgtcttcaagtgcgcgagctggacgcaccgggtgaagctgaccatcaccacccactcccgcacgttccccatgaccctggccgccatgagcacccagccgaccgactgggggtccatcggcctcatcctggacagcgagggcatctccgggacgaacagcttctccttcatgaagcacggcctggggagcttcgccatcatcgacgagccctactccatggagccccggaagggcttcatcggggaggtgcgctgccccaccgaggaggccgcgatcaaggccagcaccctctgcaagaccgccccgcagctgatcgagtaccagcccgagatggactccgccgagtgcacgaccaacatgatcgaccccatgagcgtcttcaaccggggctccctgccccaggtgcgcgagggcatgaccttcacccagagcatggagaagaacacggtgcaggcgatgaccaccggggaggtccacgcctccatccggatcgtgctcgacgactacgaggtggagtacctgagctcccaggtcgactgcgacgccaccttcaagaacctgacgggctgctacagctgcgacgagggggcccgcgtgtgcatgcagatcatcgcccacggcgacaccatcttccacttccggaacccggacgtgtccatcaacatcctccagaaggtcaacaccaacaccctgatctactgcagcgtggtgcacttcagcaagcccgtcatcaaggaggaggggacgtacgactgcggcgcgggcgagaagcccatgatcctgaaggggaccctcgtggccgtgagcccccacaacgaccgcctggagcagggcgggtcctccatcgtcatcaacccgaagggcggcggggtggacttcctgggctggctcagcgggttctccagctggttcggcgggcccctgaaggccatcctgatggtgatcggcttcctcctgctgggcctcatcctgttcgtcaccatcgccatcgggctgaagttcgccctccggcagatgatcgtgaagcgcatgaagtga

SEQ ID NO: 13046 - RNA, 3873 nt, synthetic construct; identical to SEQ ID NO: 12729
  misc_feature 1..3873: note = derived and/or modified CDS sequence (opt1) from SFNV(Namru)__HM566169.1__GP
  source 1..3873: mol_type = other RNA

SEQ ID NO: 13047 - RNA, 3990 nt, synthetic construct
  misc_feature 1..3990: note = derived and/or modified CDS sequence (opt1) from SFNV/SFNV-like(Poona)__HM566177.1__GP
  source 1..3990: mol_type = other RNA
atgctgaacgtcaagagcgtcatcctcatcacgtgcctggtgcagcaggcccacctgaagtacaccatcatctccgaggtggccaagggcgcgcgcgaggtcagctgctactccagcaccacccggctcgaccagctgctggaggcctgggagaacaagtccgccctcatcgggctgaagcgcggcaactgcaagctgggggccatggagcagatcaactgcaacctcgacctgatgagcaactacgtgtccaacgtgtacgacaacccccacggcctgggggccatgatgtacaacaccgacagcgacaagcggatcgaggtcctcaacgaccagatcccggactccatgatccccggcggccacaactgcagcctgctggagcgcaagcccttctgggcggacctcatcccgccgaagaaggagaaggagctggaccccaagccctccctgatcagcctcgtgcccaccccgcgggacgacttcaagaagaagttcgaggaggccgaggaggagatgaagaagatccgcaaggagctgcagaacgagcggcaggcccagctgtccgtgatggaggacagccgcaagaagatgcgggacctcgaggaccgcctgatgcggcagtgggaggaggagaagcagaagaaggggctgctcgaggagacgctggagaaggagcgccagctgaagaacaaggccctcctggacgcgcacgacctggacaagcagctcaaggagcgggaccgcgagttcaagaccgccatggaggagcaccagaacgagcggcgccggatcaactccaacatgatccgcccctacgtcaccacccccgccgccatcatcctgacgagcctgctctccgccagcgtggtggtcggcttcgagctggagaaccggaacaccaaccacgtgctgaaccgccccgggaacggcgggtactccatcagcgacaacaacctcatcgaggcgaagtgcatgatcacctacggcaccaagtgcctgagctgggagatgcagctgaacccggtgtcctaccccttcttcagctccaacttcgagaagtacagcctcctggagtccgtcagcgagacgacccccatcatcggcaagttctccgaggtgtgcgtgctgagcaacctctccggggcccagaagacctgcgccaaggaggccagcctgatcaagaagcagtgccccgacgacatccgggcctacttctacatcaactccctgggcaagctcgcgatcgtgacctgcccggagaacaacgtgctgagccaggactgcaacttctgcgtgcccaaggccaagggggagcgctacatctacaagcccatccaggacggcttctgccagaacggcggggtctccacggtgcccagcgtgcgctactccaaggacatctgcagcatcggcccgctgaaggtcaagaactgccacaaggggacctcccggtacgagcgcaccgccttcatcagcaccggcgacaagaaggtgtacctcgaggaggtcaagatccggtcccgccaggagtacgagcccgaccagttcctgtgctacaaggtgaaggacgggagcagcagccccctggtgtacgagaaggtccaggtgagcaagtgcaagggcatcgagacgaactcccccaagaagtgcaccggcgacgagtacttctgcagcaagtacccgtgcgagtccaccagccccgaggccaactgctacctgcggaagcactccgccatcatcgaggtgaacatcgggggcatgtgggtcaagcccaagtgcgtggggtacgagatggcgctcgtgaagcgcgtcggcctgcggagcgaggacgtgtccctgaaggagtgcgcgacctgcctctgggagtgcagctccagctacatctccatcacgacccacgggcccaagatcagctacgccaccgcctgctcccacggcagctgcaagtccgtggtccagagcccgagcacctccatcaagatcagctaccccggcaactccgagatcgtcgggggcgacatcgggatccacctgacggaggacagctcccccgtgaacctgcacctcaagatccactgcccgcccaaggacagctgcgaggtgtccgactgcatcctgtgcgtgcacggcctgctcaactaccagtgccacagcgtggcctccgccctgctgctcagcaccatcatcgcctccctgatcgccctggtcgtgtacatgctcagcaagacccgcttcgtgatgcggaagatcgtccccatcatgttcatccccttctgctggtgcttcgtgctgctggcctggctcacccgctcctggaaggggaaggtgcggaacgcgatccagagcgccaacaacacgatcggctggaccgagcgcgaggagcgggtcatcgccgagcgcccgggcgggcggaacaccatccgctactccttctacggcgtggtgatcctggccatcctggagagcgccttcgggtgctccgagagcctcatcgcggagtccaagatcatgcagtgcaacatcgccaacggcaagaccagctgccgggccagcggcacgatcatcatgaagctggggcccatcggctccgaggcctgcctgatcctcaaggggctgcgcgacagcgacaagcagtacatctccgtcaagaccgagagctccgagctgatctgccgggagggcgagagcttctggacctccctctacacccccgtgtgcctgagctcccgccgctgccacctgatgggggagtgcaccggcgacctctgcctgaagtggaagtccaacaagacgtccctggagttcgccggcaagacccacagcgaggtgatgaacgagaaccggtgcttcgagcagtccgggggcctcgggtacggctgcttcaacatcaaccccagctgcctgtacacccacgcgtacctgaagtccgtctaccgcaacgggttccgggtgttcaagtgcgccagctggacccaccgcgtgcggctcacgatcaccacccactcccgcaccttcccgatgacgctggccgccatgagcacccagcccaccgactggggctccatcggcctgatcctcgacagcgaggggatcagcggcaccaactccttcagcttcatgaagcacgggctgggctccttcgccatcatcgacgagccctacagcatggagccccggaaggggttcatcggcgaggtccgctgcccgacggaggaggcggccatcaaggcctccaccctgtgcaagaccgcgccccagctcatcgagtaccagcccgagatggacagcgtggagtgcaccacgaacatgatcgaccccatgtccatcttcaaccggggcagcctgccccaggtgcgcgaggggatgaccttcacccagtccatggagaagaacaccgtccaggccatgacgaccggcgaggtgcacgccagcatccggctggtgctcgacgactacgaggtcgagtacctgtccaaccaggtggactgcgacgccaccttcaagaacctgaccgggtgctacagctgcgacgagggcgcccgcgtgtgcatgcagatcaaggcccacggggacacgatcttccacttcaagaactccgacatgagcatgaacatcctccagaaggtctccaccaacaccctgatctactgcagcgtggtgcacttctccaagcccgtcatcaaggaggagggcgtgtacgactgcggcgcgggggagaagcccatgatcctgaagggcaccctcgtggccgtcagcccccacaacgaccggctggagcagggcgggtccagcatcgtgatcaacccgaagggcagcggggtggacttcctgggctggctctccgggttcagctcctggttcggcgggcccctgaaggccatcctgacggtcatcggcttcctcctgctgggcttcctcctgttcatgctggtgaccatcgggctccgctacgccctgagccaggtcgtgaccaagaagatgaagtga

SEQ ID NO: 13048 - RNA, 4002 nt, synthetic construct
  misc_feature 1..4002: note = derived and/or modified CDS sequence (opt1) from Arrabida virus(PoSFPhlebV/126/2008)__KP863800.1__GP
  source 1..4002: mol_type = other RNA
atgttctacgccaagttcatcctgctcctgtgcttcgtgcagggcgccctgctcaagtacaccatcatcagcaaggtcgggtccagcacctacaagcgcgtgtgcctgtcccacacgaccgacctggacaccctcctggacatgaccagccgggagatgtccaacatcaagctgacgggcgggagctgctccctcggcgacctgaccaagcccgactgcagcccggacttcttctccaactacgtggcgaacatccagagctccaacaccaagatcaccgggaagttccaggacatcatcggcgagcgcgagatggaggtcacgaacgacgtggtgcccgacagcttcggccccgggccccacgactgcgtctccttcgacaagaagccgttctggagcgacctgctccccacctccgtgagcaaggaggagcccaagcccatcatctccaccctgagcgtgctgccggccgccccgcccatcaaggacttctcccacaaggtcgtggaggccgaggagatggtgaaggagatcgagggcgagctcatgaaggagaaggagcggaacagcgccaaggaggaggaggcgcgccagcggatgcgcgagctggaggacgacctgcggaagcagtgggccgccgagcgcatggccaagcagaacatgagctccgtcctcgagcgggagcgccaggagaagcagagcctggagcggcgcatgcacgaggtggacaagaagctgcgggcgtccgaggaccgcgcccagaagtaccaggagcgggccgagcaggccgagaagtcccactccaagctcctgagccgctccggggccgcgaccacgatggccaccgtggtcttcaccagcctgctcgcctccggcctggccgtggtgaccgagctggagaagcgggacacgaaccacctcctgaaccgccccgggaacggcgtctacatggccaacgcggacagcctgatccagaccgagtgcaccctcaactacggccagcggtgcctggcctgggagctgcagatcacccccgtgcgctaccccttcttcacgtccaacgtggacaagtacagcctcctggagtccatcaccgagacccccagcatcctggagaagaacaacgagtcctgccagctcgccaccacgagcgggtccctgaagacctgcgccaaggaggccagcaccatcaagaagcactgcaccgacgacgtccgggcgttcttcttcatcaactccgtgggcaagctgacgatcgtgcgctgcgccgacaaccacatcctcagcgaggactgcaacttctgcatcagcaaggcccgcaactccaaccagaacatgttcatgcccgtccaggacgccttctgccagcggcaggggagcgacaccgccccggcgatccgctactccaaggacatctgcagcatcggcgccatcaagatcaagcagtgccacaaggccacctccaagttcgagcggatgggcttcatcagcgtggggcagaagaagctgtacatcgaggagctgaagctccgctaccggcaggagtacgaccccgaccagttcatgtgctacaagatcaagtccagcagccccctgaagtacgagaaggtcagctccaagaagtgcaaggaggtggacaccggcgggaaccagaagtgcagcggcgacgagcacttctgcaaccgctacccctgcgacacggccaacccggaggcgcactgcctgacccggaagcactccgccatcgccgaggtgaacatcgggggcgtctggatccgccccaagtgcgtgggctacgagatggtgctcgtcaagcggagcgggctgaagtccgaggacctgagcatccgcgactgcccctcctgcctctgggagtgcaagaagtcccggatcaccatcaagacccacggccccaagatcgtgagcgccacggcctgcagccacgggagctgcaagtccgtgatgcagaagccgagcaccttcgtcgagatcccctaccccggcaactccgagatcatcgggggcgacatcggcgtgcacatgaccgagcgcgggagcccctccaacatccacgtgcggacccactgcccgccccgcgacagctgcgacgtctccgactgcatgttctgcgtgcacggcatcctgaactaccagtgccacaccctggcgagcgccctgacgatcgccaccatcgtgtccgccgtcctcgtggtggtctacttcctgctggcccggagcaagcgcgcggtgaagttcatcacctccctcctgatcgtgcccttcaagtggctgaccctcctgagcatctgggtcgtgaagaactggaagcggaagatgtccaagctggcccgcgccacgaacaacgccatcgggtgggaccaggacgtggagcggggccgcccgcgcgccgcggccgggcaccagaaccaggtcgcccggtacaccttctacggcgccaccatcctcagcctgatgacctccggcctgtgctgcacggagagcgtgatcgcggagtccaacatcatgcagtgcaccaccagcgacagcaccacgacctgcaaggcctccgggaccatcatcctccgcctgggccccatcgggagcgagtcctgcctgatcctcaagggcctgcgggacagcgagaagcagttcatctccatccgcaccgtgagctccgagctgacgtgccgggagggcgacagcttctggacctccctctacacccccatctgcctgagctcccgccggtgccacctgatgggggagtgcaccggcgacaactgcctcaagtggcaggacaacaagacgagctccgagttcaccgggcgcacccacagcgaggtcctgcacgagaacaagtgcttcgagcagtccggcgggatcggctacggctgcttcaacgtgaaccccagctgcctgatggtgcactcctacctcaagccgatctacaagaacgccttcaaggtcttccggtgcgtggcctggaaccaccgcgtgaagctggccatcaccacgcacaagaagtccttcgacgtcaccctgatggcgatgagcacccagcccaccgactgggggagcatcggcctcatcctggacagcgaggggatcacgggcaccaactcctacagcttcatgaagtacggggtgggctccttcgccatcatcgacgagcccttcagcatcgagccccggaagggcttcctgggggaggtgcgctgcccgaccgaggagaccgccgtcaaggcctcccccagctgcaaggccgcgccccagatcatcgagtaccaccccgagatggacacggtggagtgcatcaccaacatgatggacccgatggccatcttcaaccggggctccctcccccaggtgcgcgacggggtcaccttcgcccagagcatcgagaagaactccgtgcaggccctgaccacgggcgagatcaaggccagcgtgcggctggtcctcgacgactacgaggtggagtacaaggtgtccgagaacgactgcgacagcaccttcatcaacatcaccgggtgctactcctgcgacgagggcgcgcgcctgtgcgtccggatccgcaccctgggcgacagcatctaccacttcaccgactccgaggacatgatgaacgtgatgttcaaggtgaacagctccgtcacggagtactgcaccgtgctccacttcagcaagcccgtggtcaacttcgaggggaagtacgactgcggcaagtcccggaagcccatgatcatcaaggggaccctgatcgccatggccccgcacgacgaccgcgtgcacagcggcgggagctccatcgtcgtgaaccccaagagcaagggcgtggacttcctgggctggctctccgggctgagctcctggctgggcgggcccctcaagaccgtcctgacggtgctgggcttcctcatcctgggcctggtgttcgtcatcgtggtgatcttcctcgtccgggtggggatccgccaggccctgctgaagaagatgaagtga

SEQ ID NO: 13049 - RNA, 4005 nt, synthetic construct
  misc_feature 1..4005: note = derived and/or modified CDS sequence (opt1) from Massilia virus(127)__KT906100.1__GP
  source 1..4005: mol_type = other RNA
atgttctacgccaagttcgtgatcagcctgtgcctcgagcccggcttctccctgaagtacaccatcatcagcaagtccgggagcggcaccatccgccagatctgcctgtcccacagcacggacatcgacaaggtcctcgagctgtccagcggggagatgaacaccatcggcatcctcgggggcctgtgcaccttcggcgagctgaagcgggaggactgctccccggacgtgttcagcaactacgtggccaacatgtacgggaccgcgcacccctccagctgcaagttcgtcgacatcacgggcgaccgctccatcgaggtgctgaacgacgccgtgcccgacagcttcacccccggggcccacaactgctccagcttcgagaagaagccgttctggaccgacctcatccccgccaagaactccagcggcgccatcccctccgtcgtgagcgtgctgcccagcgtcgcggagcacgacttcaacctgaaggtgaaggaggccaacgacaagctcgaggtgatccagcgggagctggccgccgagaaggcgcgctccgggcggctggaggacgaggcccgcgccaagatgaaggccctcgaggacgagctgcggaacggctggctggccgagcgcgaggcgaaggagctcgccaagagcgccctggagaaggagcggatcaacaagctggaggtcgagcgcaagctccacgacctgggcaagaagctgcggcagtccgaggacgacgtggagaagatgcgcgtgcaccacaagaaggggcggaaggagagcgacgaggagatgaagatcgcccgcaccacggccccgtccgtcagcaccaccctcgcgaccgtggtgttcacgtccctgctggccaccggcctcgccgccatcgagcccatcgaggaccggaacgtcaaccacatcctgaaccgccccgggagcggcgtgtacatggcctcccccaccctgacccagaacgagtgcagcctcgactacggcaaggagtgcaaggcgtgggagctccaggtgtccccgctgcactaccccttcttcacgagcaacgtcgacaagtacaccttcctggagtccatcaccctgctgccgcccatcctcctgatcaacaacgagttctgcgagctgaccacgagctccgggcccctcaagcagtgccagaaggagagctccctgatcaagaagtgctgcaccgaggacgcccgggcctacttcttcatcgacctggagggcaagctcagcatcgtgcactgctccaacaaccaggtgctgagcgaggactgcaacttctgcgtcaccaagagcgggggcgtgtcccacaagatcttcatgcccatccaggacgccttctgccagaagggcgggagcgagtccatccccgtcgtgcgctacagcaaggacatctgctccatcggcctgagcaaggtgaagtcctgccacaagagcacctcccggtacgagcgcatggggttcatcgtcgccggcaagaagaagctctacatcgaggacctgaagatgcggtaccgccaggagtacgacgaggaccagttcttctgctacaaggtgaacaagacgagccccctggagtacgggaaggagtccccgagcaagtgcaagggcgtggggtccaacgagcagaagtgcaacggcgacgagtacttctgcaaccgctacccctgcgagaccaacagccccgaggcgcactgctccctccggcgccacgccgccgtcgtggaggtgtacgtcggcggggcctggatcaagcccaagtgcgtgggctacgagaaggtgctggtcaagcgcgggggcctgaagaccgaggacctgagcgtgcgggagtgcacctcctgcctctgggagtgcgagaagaacaagatcgtgatcaagacgcacgggccgaagatcgtcagcgcgaccgcctgcggcggccggagctggaagtccgtgatgcagaagcccagcaccttcctggacctgccctaccccgggaactccgagatcatcggcggggaccgcggcaaccacctcagcgagcggggctccccgtacaacatccacagcaccatccactccccgcccgaggacagccgcgacgcctccgactgcatctactgccggcacgggctgctgaactaccagagccactccgtggagagcgccatcctcctgtccacggtcgtggccaccatcctggcgctcaccggcgtggtcctgagccgctccaagagcgccgtgcggttcctggcctccgccgtggccgtccccttccgctgggtgagcctcctggtggtctgggtgatgaagaagtggaaggcgcgggtggccaccgccatccgcgccacgaacaacgccatcgggtgggacaacggcctggagcaggcgcgggtcgagaacgccgcccgccggcagcagaccgccgggcgctggcggtccctcgacgcgagcaccatcctgagcgtgctgtccaccggcctctgctgcaccgagagcctgatcgccgagtccagcatcatgcagtgcacgaccggcgaggggtccacgacctgcaaggccaccggcaccgtggtcctgaagctcgggcccatcggcagcgagtcctgcctgatcctgaaggggctccgcgacaacgagcgccagttcatcagcatcaagaccatctccagcgagctgacctgccgggagggcgagtccttctggacgcccctgtacacccccgtgtgcctcagctcccgccggtgccacctgatgggcgagtgcaccggggacatgtgcctgaagtggaagtccaacaagaccagcagcgagttcacgggcaagacccactccgaggtgatccacgagaacaagtgcttcgagcagagcgggggcatcgggtacatgtgcttcaacgtcaacccgtcctgcctcatggtgcacagctacctgaagcccatctacaagaacgccttcaaggtgttccgctgcatcgcctggaaccaccgggtccgcctgggcatcaccacccacaagcggaagttcgaggtgacgctcatggcgatgagcacccagcaggccgactggggctccatcgggctgatcctggacagcgagggcatctccgggaccaacagctactccttcatgaagcacggcctcgggagctacgccatcatcgacgagccctactccgtggagccccgcaagggctacctgggcgaggtccggtgcccgaccgaggagacggccatcaaggccagcccctcctgcaaggtggcgcccgggctggtggagtaccagcccgagatggacaccctcgagtgcaccaccaacatgatggacccgatggccatcttcaaccgcggcagcctgccccaggtccgcgggggctggacgttctcccagagcatcgagaagaactcccggcaggccctgaacaccggcgccatcaacgccagcgtgcggcacgtgctcgacgagtacgagttcgactacaaggtcaagaccaacgactgcgactccaccttcgtgaacatcacggggtgctacagctgcgacgagggcgcgcgcctgtgcgtgaaggtccggacctccagcgaggccatctaccacttcaccgactccgggtacaacatcaacgtgctgttcaaggtcgagagcggcgtgcacgaccactgcaccatcctccacttcagcaagcccgtgatctccatcgaggggaagtacgactgcggcaagaacaagaagcccatgctgatcaagggcacgctgatcgccatggccccgcacgacgaccgcgtcgtgagcgggggctccagcaccgtggtcaaccccaaggggcagggcgtggacttcctcgggtggctgtcccggctgagctcctggttcggcggcgggcccctcaagaccttcctgatggtgaccggcttcctgatgacgggggtcatcggcgggatcgtgaccatcatcctcatccgcatcgtgctgcagcaggcgctggccaagaaggtcaagtga

SEQ ID NO: 13050 - RNA, 4005 nt, synthetic construct
  misc_feature 1..4005: note = derived and/or modified CDS sequence (opt1) from Massilia virus(130)__KT906101.1__GP
  source 1..4005: mol_type = other RNA
atgttctacgccaagttcgtgatcagcctgtgcctcgagcccggcttctccctgaagtacaccatcatcagcaagtccgggagcggcaccatccgccagatctgcctgtcccacagcacggacatcgacaaggtcctcgagctgtcccgcggggagatggacaccatcagcatcctgggcgggctctgcaccttcggcgagctgaagcgggaggactgctccccggacgtgttcagcaactacgtggccaacatgtacggcaccacgcacccctccagctgcaagttcgtcgacatcatcggggaccggtccatcgaggtgctgaacgacgcggtgcccgacagcttcacccccggcgcccacaactgctccagcttcgagaagaagccgttctggaccgacctcatccccgccaagaactccagcggggccatcccctccgtcgtgagcgtgctgcccagcgtcgccgagcacgacttcaacctgaaggtgaaggaggcgaacgagaagctcgaggtgatccagcgcgagctggccgccgagaaggcccggtccggccgcctggaggacgaggcgcgggccaagatgaaggccctcgaggacgagctgcgcaacgggtggctggccgagcgggaggccaaggagctcgccaagagcgccctggagaaggagcgcatcaacaagctggaggtcgagcggaagctccacgacctgggcaagaagctgcgccagtccgaggacgacgtggagaagatgcgggtgcaccacaagaagcgccggaaggagagcgacgaggagatgaagatcgccaagaccacggccccgtccgtcagcaccaccctcgccaccgtggtgttcacgtccctgctggcgaccggcctcgccgccatcgagcccatcgaggaccgcaacgtcaaccacatcctgaaccggcccgggagcggcgtgtacatggcctcccccaccctgacccagaacgagtgcagcctcgactacgggaaggagtgcaaggcctgggagctccaggtgtccccgctgcactaccccttcttcacgagcaacgtcgacaagtactccatcctggagagcatcacccagtccagccccatcctgctgaagaacaacaactcctgcgagctcaccaccagccccggcacgcagaagcagtgccagaaggagtccagcaccatcaagaagtactgcaccgacgacgcgcgcgcctacttcttcatcgacctggagggcaagctgagcatcgtgcactgcaccaacaactacatcctctccgaggactgcaacttctgcgtgagcaagctgggggaggtcggccacaagatcttcatgccgatccaggacgccttctgccagaagggcgggtccgagagcatccccatcgtgcggtactccaaggacatctgcagcatcgggctgttcaagatcaagaactgccacaagtccacgagccgctacgagcggatgggcttcatcgtcgccggcaagaagaagctctacatcgaggagctgaagatgcgctaccgccaggagtacgacgaggaccagttcttctgctacaaggtgaagaagaccagccccctggagtacgccaaggtgagcccctccaagtgcaagggggtcggcagcaacgagcagaagtgcaacggggacgagtacttctgcaaccggtacccgtgcgagaccaactcccccgaggcgcactgcagcctccgccggcacgccgccgtggtggaggtctacgtgggcggggcctggatcaagcccaagtgcgtgggctacgagaaggtcctggtgaagcgcggcgggctgaagaccgaggacctctccgtgcgggagtgcacgagctgcctgtgggagtgcgagaagaacaagatcgtcatcaagacccacggccccaagatcgtgtccgcgaccgcctgcgggcacggcagctgcaagagcgtgatgcagaagccgtccaccttcctggacctgccctaccccgggaacagcgagatcatcggcggcgaccgcgggaaccacctctccgagcggggcagcccctacaacatccactccacgatccactgcccgcccgaggacagccgcgacgcctccgactgcatctactgccggcacgggctgctgaactaccagagccactccgtcgccagcgccatcctcctgtccaccgtggtggcgaccatcctggccctcaccggcgtcgtgctgagccgctccaagagcgccgtgcggttcctggcctccgccgtcgcggtgcccttccgctgggtgagcctcctggtcgtgtgggtgatgaagaagtggaaggcccgggtcacgaccgccatccgcgccaccaacaacgccatcggctgggacaacgggctggagcaggtccgggtggagaacgcggcccgccggcagcagccggccgtgcgctggcggtccctcgacgccagcaccatcctgtccatcctgggcaccgggctctgctgcacggagagcctgatcgcggagagctccatcatgcagtgcaccaccgaggagggcagcaccacgtgcaaggccaccgggaccgtggtgctgaagctcggccccatcggctccgagagctgcctgatcctgaaggggctccgcgacaacgagaagcagttcatctccatcaagaccatcagctccgagctgacgtgccgcgagggcgagagcttctggacctccctgtacacccccgtctgcctcagctcccggcgctgccacctgatgggggagtgcaccggcgacatctgcctgaagtggaagtccaacaagacgtccagcgagttcaccgggaagacccactccgaggtgatccacgagaacaagtgcttcgagcagagcggcggcatcgggtacatgtgcttcaacgtgaacccctcctgcctcatggtccacagctacctgaagccgatctacaagaacgccttcaaggtgttccggtgcatcgcctggaaccaccgcgtgcggctgggcatcaccacgcacaagcgcaagttcgagatcaccctcatggccatgtccacccagcagaccgactgggggagcatcggcctgatcctggacagcgagggggtcgcgggcacgaacgcctactccttcatgaagcacggcctcgggagcttcgccatcatcgacgagccctactccgtggagccccggaagggctacctgggggaggtgaagggcccccgcgaggagaccgccatcaaggccagcccgtcctgccaggtcgcgcccgggctggtggagtaccagcccgtgatggacaccgtcgagtgcaccacgaacatgatggaccccctcgccatcttcaaccggggcagcctgccccaggtgcgcggcgggtggaccttctcccagagcatcgagaagaactccctgcaggccctcaacaccggcgccatccacgccagcgtgcggcacgtcctggacgagtacgagttcgagtacaaggtgaagtccaacgactgcgacagcaccttcgtgaacatcacggggtgctactcctgcgacgagggcgcgcgcctgtgcgtcaaggtgcggaccagctccgaggccatctaccacttcaccgacagcggctacaacatcaacgtcctcttcaaggtggactccggggtgcacgaccactgcaccatcctgcacttcagcaagccggtcatctccatcgagggcaagtacgactgcgggaagaacaagaagcccatgctgatcaagggcacgctcatcgccatggcgccccacgacgaccgcgtggtgagcgggggcagctccaccgtcgtgaacccgaagggccagggggtggacttcctgggctggctgagcgggctctccagctggttcggcgggggccccctgaagaccttcctgatggtcaccggcttcctcatgacgggggtgatctccggcatcgtgaccatcatcctgatccggatcgtcctgcagcaggcgctcgccaagaaggtgaagtga

SEQ ID NO: 13051 - RNA, 3999 nt, synthetic construct
  misc_feature 1..3999: note = derived and/or modified CDS sequence (opt1) from Massilia virus(W)__EU725772.1__GP
  source 1..3999: mol_type = other RNA
atgttctacgccaagttcgtgatcatcctgtgcctcgtccagggcttcagcctgaagtacaccatcatctccaagagcgggtccggcaccatccgccagatctgcctgagccactccacggacatcgacaaggtgctcgagctgagctccggggagatggacaccatcaacatccagggcgggctgtgcaccttcggcgagctcaagcgggaggactgcagccccgacgtgttctccaactacatcgccaacatgtacggcaccacgcacccgagctcctgccgcttcctggacatcatcggggaccggagcatcgaggtcatgaacgacgcgtcccccgacagcttcacccccggcgcccacaactgctccagcttcgagaaggcccccttctggtccgacctgatcccggccaagaacgggagcggcccctcccccagcgtggtgagcgtcctcccctccgccaccgagagcgacttctccctgaaggtgaagaaggcgaacgagcgcctggaggtgatccagcgggagctcgccgccgagaaggcccgcagcgggcggctggaggacgaggcgcgcaccaagatgcgggccctggaggacgagctccgcaacggctggctggccgagcgggaggccaaggagctggccaagtccgacctcgagaaggagcgcgtcaacaagctggaggtggagcggaagctgcacgacctcaacaagaagctgcgccagagcgaggacgaggcggagcggctgcgcgagtaccacaacaagcggcgcaaggagtccgacgagaagatgaagatgacgaagaccgtggccccgaacgtcagcaccaccctcgccacggtggtgctgacctccctgctcgccaccggcctggccgcgatcgagcccatcgaggaccggaacaccaaccacatcctgaaccgccccgggacgggcgtctacatggccagccccaccctcaccgagaacgactgctccctggactacgggaaggagtgcaaggcctgggagctccaggtgagcccgctccactaccccttcttcacctccaacgtggacaagtacagcctgctggagtccatcacgcaggccagccccatcctcatcaagaacaacaactcctgcgagctgaccaccagccccggctcccagaagcagtgccagaaggagagcagcaccatcaagaagtactgcacggacgacgcccgggcgtacttcttcgtcgacctggagggcaacctctccatcgtgcactgcagcaacaacaacatcctgtccgaggactgcaacttctgcatcagcaagtccggggtgaccggccagaagatcttcatgccgatccaggacgccttctgccagcgcgggggcagcgagtccctgcccgtcatccgctacagcaaggacatctgctccatcgggctgttcaagatcaagagctgccacaagtccaccagccggtacgagcgcatgggcttcatcgtggtgggccggaagaagctgtacctggaggagctcaagatgcgctaccggcaggagtacgacgaggaccagttctactgctacaaggccaagaccacgtcccagctgcagtaccagaaggtcagcccctccaagtgcaagggggtgggcagcaaggaccagaagtgcaacggggacgagtacttctgcaaccgcttcccctgcgagaccaacaacccggacgcccactgctccctgcggcgccacgccgcggtcgtggaggtgaacgtcggcggggcctgggtgaagcccaagtgcgtgggctacgagaaggtcctcgtgaagcggggcgggctgaagaccgaggacctgagcgtgcgcgagtgcaccagctgcctgtgggagtgcgagaagaacaagatcgtcatcaagacgcacggccccaagatcgtgtccgccaccgcctgcagccacgggtcctgcaagagcgtgatgcagaagccctccaccttcctcgacctgccgtaccccggcaacagcgagatcatcgggggcgacatcggcatccacatgtccgagcgggggagcccctccaacatccacatcaccatccactgcccgccgaaggacagctgcgacgtctccgactgcatcttctgccgccacggcatcctgaactaccagtgccacagcgtggcgtccgccatcctcctgagcacggtggtcgccaccatcctggccctcaccggggtgatcatctcccggagcaagttcgccgtgcgcttcctggcgtccgccgtcgccatccccttccggtgggtgagcctgctcgtggtctgggtgatgaagaagtggaagtcccgcatcgccaccgccatccgggcgaccaacaacgccatcggctgggacaacggcctggagcaggtccgcgtggagaacgccgcccggcgcccccagccggccgtgcgctacgcgttctacgccacgaccatcctgagcatcctcgggagcggcctgtgctgcaccgagtccctgatcgccgagagctccatcatgcagtgcaccacggaggacagctccacgacctgcaaggccaccgggaccgtggtcctcaagctgggccccatcgggagcgagtcctgcctgatcctcaagggcctgcgggacaacgagaagcagttcatcagcatcaagaccatctccagcgagctgacctgccgcgagggcgagtccttctggaccagcctctacacgcccgtgtgcctgtccagccggcgctgccacctgatgggggagtgcaccggcgacatctgcctcaagtggaagtccaacaagaccagctccgagttcaccgggaaggcgcacagcgaggtgatccacgagaacaagtgcttcgagcagtccggcgggatcggctacggctgcttcaacgtcaaccccagctgcctgatggtgcacagctacctgaagccgatctacaagaacgccttccgggtgttccgctgcatcgcctggaaccaccgggtccgcctcggggtgacgacccacaagcggaagttcgagatcaccctgatggccatgtccacccagcagacggactggggcagcatcgggctgatcctcgactccgagggcatcgaggggaccaacgcctacagcttcatgaagcacggcctgggctccttcgcgatcgtggacgagccctacagcgtcgagccccgcaaggggtacctgggcgaggtgcggtgccccaccgaggagaccgccatcaaggcctccccgagctgcaaggtggcccccgggctcatcgagtaccagcccgagatggacacggtcgagtgcaccaccaacatgatggaccccatggccatcttcaaccgcggctccctgccccaggtgcgggaggggaagaccttcacgcagagcatcgagaagaactccgtgcaggcgctgaccaccggcgagatccacgccagcgtccgcctcgtgctggacgagtacgagatcgagtacaaggtgacctccaacgactgcgacagcacgttcgtcaacatcaccggctgctactcctgcgacgagggggcccggctgtgcgtgaaggtcaagagctccagcgaggccatctaccacttcaccgactccagcttcagcgtgaacgtcctcttcaaggtgaccccctccgtgcacgactactgcacgatcctgcacttcagccgccccgtgatctccatcgagggcaagtacgactgcgggaagaacaagaagcccatgctgatcaagggcaccctcatcgccatggcgccgcacgacgaccgggtcatcaacggcgggagctccaccgtggtgaaccccaagggccacggggtcgacttcctgggctggctgagcgggctctccagctggttcggcggccccctgaagaccttcctgatggtgatggggttcctcatgatcggcgtgatcatcgtcatcgtgaccatcatcctgatccgcatcgggctgcagcaggccctcgccaagaagttcaagtga

SEQ ID NO: 13052 - RNA, 3996 nt, synthetic construct
  misc_feature 1..3996: note = derived and/or modified CDS sequence (opt1) from Punique virus(PI-B4-2008)__JF920134.1__GP
  source 1..3996: mol_type = other RNA
atgttctacgccaagttcgtgatcatcctgtgcctcgtccagggcttcagcctgaagtacaccatcatctccaagctggggagcggcaccacgcgccaggtgtgcctctcccacagcaccgacctggacaaggtgctggagatctccaacatggagatggacgccatcaacctcctcgggggcttctgcaccctgggggagctgcggcgcgaggactgcagccccaacgtcttctccaactacgtggtgaacgtccacggcaccatccacagctccaactgcaagttcgtggacatcgtgggcgaccggagcatcgaggtcctgaacgacgcgacgccggactccttcacccccggggcccacaactgcagctccttcgagaagccgcccttctggaccgacctggtgcccaagaagaacgacaccgaccccagcccctccctcctgagcgtgctgcccgccgccgccgagctcgacttcaacctgaagctgaaggaggcgaacgacaaggtcgaggccatccagcgcgagctcgtggccgagaaggcccggtccggccgcatcgaggacgaggcgcggacgaagatgcgcgagctggaggacgagctgcggcgcgggtggatcgccgagcgggaggccaaggagctcgcccacaagaacctggaggaggagcgcgtgagcaagctggagatcgagcggcgcatgcacgacctcgacaagaagctgcggcagtccgagaacgacgccgaccgcctgcgggagcagtacaacaagaagcgcaagagcgaggaggaggtcaagaccccgaaggcgagcaccctcaacgccaccacgaccctggccaccgtggtgctgacctccctcctggccacgggcctggccgcgatcgagcagatcgaggagcggaacaccaaccacatcctcaaccgccccgggaccggcgtctacatggccagccccaccctgacgcagaccgagtgctccctgggctacgggaaggagtgcaagagctgggagctccaggtgagccccctgcactacccgttcttcaccagcaacgtggacaagtactccatcctggagagcatcacccaggagcccacgctcctgatcaagaacaacaactcctgcgagctgaccaccagccccggctcccagaagcagtgccagaaggagagctccaccatcaagaagtactgcacggacgacgcccgggcctacttcttcatcgacctcgggggcaacctgagcatcgtccactgctccaacaacttcgtgctgagcgaggactgcaacttctgcatctccaagagcggcggggtgggccagaagatcttcatgcccatccaggacgccttctgccagcgcgggggctccgagagcccgcccgtcgtgcgctacagcaaggacctctgctccatcgggctgttcaagatcaagagctgccacaagtccaccagccggtacgagcgcatgggcttcatcgtcgcgggccagaagaagctgtacctcgaggagctgaagatgcggtaccgccaggagtacgacgaggaccagttcttctgctacaaggtgaagtccaacagccccctgcagtacgagaaggtgtcccccagcaagtgcaagggggtcggctcccaggaccagaagtgcaacggggacgagtacttctgcaaccggtacccgtgcgacaccaacaaccccgacgcccactgcagcctgcgccggcacgccgccgtggtggaggtcaacgtgggcggggtgtggatcaagcccaagtgcgtcggctacgagaaggtgctcgtgaagcgcggcgggctgaagaccgaggacctgtccgtccgggagtgcacgagctgcctctgggagtgcgagcgcaacaaggtggtggtcaagacccacggccccaagatcgtgtccgccaccgcgtgcagccacgggtcctgcaagagcgtgatgcagaagccgtccaccttcctggagatcccctaccccggcaacagcgagatcatcgggggcgacatcggcatccacatgagcgagcgggggtcccccagcaacatccacgtcgtggtgcactgcaagccgaaggactcctgcgacatcagcgactgcatcttctgcaagcacggcatcctgaactaccagtgccactccgtcgccagcgccgtgctcctgtccacgatgatcgccgcgtgcctggccctcgtgggggtcatcgtgagccgctccaagcacgccgtgaagttcctggccagcgtcgtggccatccccttcaagtgggtgtccctgctcaccgtctgggtggtgaagaactggaagctgcggatcacccgcgtcatccgggcgaccaacgacgccatcggctgggagaacaacctggagcaggtccgcgtggagaacgccgcccggcgcccccagccggccgtgcggtacgcgttctacggcaccacgatcctcagcatcctgtccaccgggctgtgctgcagcgagtccctcatcgccgagagctccatcatgcagtgcaccaccgaggacagctccacggtgtgcaaggccaccggcaccgtggtcctgaagctggggcccatcggcagcgagagctgcctcatcctgaaggggctgcgcgacaacgagaagcagttcatctccatcaagaccatcagctccgagctcacgtgccgcgagggcgagagcttctggacctccctgtacacccccgtgtgcctgagctcccggcgctgccacctcatgggcgagtgcaccggggacatctgcctgaagtggaagacgaacaagaccagcgccgagttcaccggcaagacccactccgaggtgatccacgagaacaagtgcttcgagcagagcgggggcatggggtacggctgcttcaacgtcaacccctcctgcctgatggtgcacagctacctcaagccgatctacaagaacgccttcaaggtgttccggtgcgtcgcgtggaaccaccgcgtgcggctgggcatcacgacccacaagcgcaacttcgagatcaccctgatggccatgtccacccagcagacggactgggggagcatcggcctcatcctggactccgaggggatcaccggcaccaacagctactccttcatgaagcacgggctgggcagcttcgccatcatcgacgagccctacgtgaccgagccccggaagggctacctcggggaggtccgctgccccacggaggagaccgccgtgaaggcgtccccgagctgcaaggtggcccccggcctgatcgagtaccagcccgagatggacgtcgtggagtgcaccaccaacatgatggaccccatggccatcttcaaccgggggagcctgccgcaggtccgcgacggcaagacgttcacccagtccatcgagaagtcctccgtgcaggccctcaccaccggggagatccacgccagcgtgcggctggtcctggacgagtacgaggtggagtacaaggtggtcaacaacgactgcgactccacgttcgtgaacatcaccggctgctacagctgcgacgagggcgcgcgcctctgcgtgaaggtcaaggcctccagcgacgtgatctaccacttcaccgactccgacaacagcatgaacgtgctgttcaaggtctccagcaacatccaggactactgcatcgtgctgcacttctccaagcccgtggtcaacgtggaggggaagtacgactgcggccggagcaagaagcccatgctcatcaaggggaccctgatcgccatggcgccccacgacgaccgcgtgacgaacggcggctccagcatcatcatcaacccgaagggcggcggggtcgacttcctggggtggctctccgggctgagctcctggttcggcggccccctgaagaccttcctcatcatcgccgggttcctgatcgtgggcatcatcatcgtgatcatcatcatcatcctggcccggctcgggatccagcaggccctggccaagaagctgaagtga

SEQ ID NO: 13053 - RNA, 4020 nt, synthetic construct
  misc_feature 1..4020: note = derived and/or modified CDS sequence (opt1) from TOSV(9028)__KU904264.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacgtcaccgagtccatcgggctgaccagcggcacgtgcaaggtggggtccctggagaaccgcgactgccggaaggacatcatgagcaactacgtggccgaggtccactccgacctccacggcctgggcgccatgatgcacaactacggggacgacaagcgcgtggagatcctgaacgacgtgatccccgacgagctcaacccgggccaccacaactgcagcgacctggaccggaagcccttctggaccgagttcatcaacgtcgccaagcccctgtccgagatcgtgcccatgagcgtgatcccgccgcccgtcgtgaagctccagccgcccgccgagccctccagcaagaagcacgtgcccttcgacgtcctgctgtccgaggcggagaaggagctcaaccagaccaagatccgcctggaggacgagcgcaagagcaacgccgaggagaccgccaaggagcgggcccggatgaaggagatcgaggacgagctgcgccgggagtgggagctcgagcgcaagcggaaggacgcgatggccgacgacctggccaaggagacggcccgccggcgcgagatcgagcggaaggcccacgagctggacaagatgctcaagaagaaggagcgcgagtccctgatcgcgaaggagaaggccgacgaggacatgcggagccacgtgcacaagcccaacaccacccgcgcccccgcccccaccatcatcacgaccctgctcatggccagcgcggccctggccgggcccctggagaaccgggagaccaaccacctcctgaaccgccccggcaacggggcctacaccctgtccgacttcgccgagagcacgtgcaccctcgcgtacggctccgagtgcaagagctgggagcacctcctgaacgaggagctgttcccgttcttccactccaacctggacaagtacagcatgctggaggccgccaccgagaccgtgcccatcctcaacaagtccagcgccgtctgcacgatctcccccagcacccactccagcaacgcctgcggccgcgaggcgtccgtgatccggaagaagtgctacagcaacatgtccgccttcttctacatcaacctggccgggcagatcaccgtgatcaagtgcgagaccaaccacgtcctgagctccgactgcggcaactgcatcagcaagtccctcagcgggcagaaggtgtacacgcccgtgcaggacgtcttctgccagaagggctggacccagagcatcccgtccacccgctacagcaaggacatctgctccatcggcctgcacaccgtgaaggagtgcaagatcgggacgaccagcttcgagcgggtgggcttcatcgtcgtgaaggggcgcaagatgtacatcgagcagatgaagatgcggtcccgccaggagtacagcgaggaccagttcctgtgctacaagtccgagagcggctccgggagctccgtcaagctcaagaagttcaaggtggagagctgcaagggcgtgaccacctccagcgcctccaagtgcagcggcgacgagtacttctgctcccggtacccctgcgagacggcgaacgtcgaggcccactgcatcctgcgccggcacagcgccatcgtggaggtgaacgtcaacggggtgtgggtggtcccccgctgcatcggctacgaggaggtgctggtgaagcggaccagcctcaaggtcgaggacaccaccgggcgcgagtgcgactcctgcctgtgggagtgcggcaagaacaagctgatcgtgaagacgcacgggcccaaggtggtctacgccaccgcctgcagccacggctcctgcaagagcgtgatgcagaagccggcgaccttcgtgtacctgccctaccccggcaactccgagatcgtcgggggcgacatcgggatccacatgaccgaggagagctcccccagcaacatccacctcgtggcccactgcccggcccgggactcctgcgacgtgagcgactgcctgttctgcgtccacggcctgctcaactaccagtgccacaccctgttctccgccctgctcatcagcacgaccgtgatgtccatcctgaccctgctcctgctgctcgtgaagggggccaaggacctggtcaagaagctgttccactggctcatcacgcccctgtgctggctgagcgtgttctgctgctgggtggtcaagtcctggaagcgccgggtgggcagcgcgatctcccgcaccaacgacaccatcggctggcgggagaaccgccggcacgcccaggacatcgagcgcgcccagtacaccgggggcgcccccggggccaagtacagcttctacggcgtgatgatcctcggcctgctgtccagcgcgcagagctgctccgagagcgtcatcgccgactccaagatcatgcagtgcaccacgagcgggtccagcaccctctgcaaggcctccggcaccgtgatcatgcgcctggggccgatcggcagcgagtcctgcctgatcctcaaggggctgaaggacagcgagaagcagttcatctccatcaagaccatcagctccgagctgacgtgccgggagggcgagagcttctggaccaccctctacacccccatctgcctgtccagccgccggtgccacctgatgggcgagtgcgtgtccgaccgctgcctcaagtggaagacgaaccagaccagcgccgagctgaccgggaaggcgcacggcgacgtcatgcacgagaaccggtgcttcgagcagtccgggggcatcgggtacggctgcttcaacgtgaaccccagctgcctgtacgtgcacagctacctcaagtccgtctaccgcaacggcttcaaggtgttccggtgcgtggcctggaaccaccgcatccggctggaggtcaccacgcacagccgcaagttccccatggtgctgatggccatgtccacccagccgaccgactgggggagcatcggcctcatcctggactccgaggggatcaccggcacgaacagctactccttcatgaagcacgggagcggctccttcgccatcatcgacgacccctacagccccgagccccggaagggcttcctgggggaggtgcgctgcccgaccgaggagaccgccatgcgggcgtcccccagctgcaagatggcccccaacctcatcgagtaccagcccgagatggacaccgccgagtgcacgaccaacatgatcgacccgatggccatcttcaaccgcggctccctgccccaggtccgggacgggatgaccttcacccagagcatcgagaagaacacggtgcaggccctgaccaccggcgaggtgaaggcgtccatccgcctcatcctggacgactacgacgtcgtgtaccagaacagccagtccgactgcagcgccaccttcaagaacctgacggggtgctactcctgcgacgagggcagccggctctgctaccaggtgaaggccgagggcgagaccatcttccacttcatcaacgaggaggagagcatcaacgtcatcaacaaggtgtcccccggggtgagcgactactgcaccgtcctgcacttctcccgccccgtgatcagcatcgagggcacctacgactgcgggctgtccaagcggccgatggtcatcaagggcaccctcatcgccacggcgccccacgacgaccgcaagcacgagggcgggagctccctggtggtgaaccccaagggcgggagcgtcgacttcttcggctggctgtccgggctcaccagctggctgggcggccccctgaagaccttcctcaccatcctggggttcctggccgtgggcctcctgctggtggtcatcatcatcatcatcatccggacggggatgcagcaggccctcaagaagaagatcaagtga

SEQ ID NO: 13054 - RNA, 4020 nt, synthetic construct
  misc_feature 1..4020: note = derived and/or modified CDS sequence (opt1) from TOSV(A189)__KP694241.1__GP
  source 1..4020: mol_type = other RNA
atgttcatcgccaagctgctcctgatcagctgcctggtgcagcaggcctacctcaagtacaccatcatctccgagatcggcaacgggacccgcacgagctcctgctacagctcccggaccagcctgggctccctgctcgaggcgtgggacaacatcaccgagagcatcgggctgacctccggcacgtgcaaggtcgggagcctggagaaccgcgactgcaagcgggacatcatgtccaactacgtggccgaggtgcacagcaacctccacggcctgggcgccatgatgcacaactacggggacgacaagcgcgtcgaggtgctgaacgacgtgatccccgacgagctcaacccgggccggcacaactgctccgacctggaccgcaagcccttctggaccgagttcatcaacgtcgcccggcccaccaacaagatggcccccatgagcgtgatcccgccgcccatcgtgaagcccatccccgtcgcggagcccaccatcgagaagacgatccccttcgacaagctgctctccgaggccgagaaggagctgaaccagaccaagatccgcctggaggccgagcggcgcagcaacgccgaggaggcggccaaggagcgggcccgcatgcgggagatcgaggacaagctccgcaaggactgggagctggagcgggagcgcaaggacgccgtggccgacgacctggcgaaggagatcgcccggcgccgggagatcgagcgcaaggcccacgagctcgacaagatgctgaagaagaaggagcgggaggacctggtggcccgcgagcgcgtctccgaggacatgcggaaccacgtgcgccggcccaacaccaccatcgccccggcgcccacgatcatcaccaccctcctgatggccagcgccgtgatggccgggcccctggagaaccgcgagaccaaccacctcctgaaccggcccggcaacggggcctacacgctgtccgacttcgcggagagcacgtgcaccctcgcctacggcagcgagtgcaagtcctgggagcaccagctggacgagctgagcttcccgttcttccactccaacctcgacaagtacagcatgctggaggccgccaccgagacggtccccatcctgaacaagtccagcgccgtgtgcaccatctaccacccccgcatccaccggatggcgtgcggccgcgaggcctccctcatcaagaagaagtgcgggagcaacatgtccgccttcttctacgtgaacctggccggccagatcaccgtcgtgaagtgcgacaccaaccacgtgctgagcaacgactgcgggaactgcatctccaagacgctcagcggccagaagatctacacccccgtccaggacatgttctgccagaagggctggaccgagtccatcccgaacacccggtacagcaaggacctgtgctccatcgggctgcacacggtgaaggagtgcaagaccggcaccaccaacttcgagcgcgtggggttcatcgtcgtgaagggccggaagatgtacatcgagcagatgaagatgcgcagccggcaggagttctccgaggaccagttcctctgctacaagagcgagtccagcagcgggtccagcgtcaagctgaagaaggtgaaggtggagtcctgcaagggcgtcacgaccagctccgcgagcaagtgctccggcgacgagtacttctgcagccgctacccctgcgagaccgccaacgtggaggcccactgcatcctgcggcgccactccgccgtgatcgaggtcaacgtgaacggggtgtgggtcgtgccccggtgcatcggctacgaggaggtgctcgtccgccggaccagcctgaaggtggaggacacgtccagccgcgagtgcgacacgtgcctgtgggagtgcgggaagaacaagctcatcgtgaagacccacggccccaagatcgtctacgccaccgcgtgctcccacgggagctgcaagtccgtgatgcagaagccggccaccttcgtgtacctgccctaccccggcaacagcgagatcgtcggcggggacatcggcgtgcacatgaccgaggagtccagccccagcaacatccacatggtggcccactgcccggccaaggactcctgcgaggtcagctcctgcctgttctgcgtgcacgggctgctcaactaccagtgccacaccctgttcagcgccctgctcatctccaccaccgtgatgagcatcctgacgctgctcctgctgctcatgcgcggcgcgaaggacctggtcaagcggctgttctactggctcatcacgcccctgtgctggctgtccgtgttctgcagctggatgatcaagtcctggaagaagcgcgtggggagcgccatctcccggaccaacgacaccatcggctggcgcgacaaccggcgctacggccaggacgtcgagcgggcccagtacaccgggggcgcccccggggccaagtacagcttctacggcgtgatgatcctcggcctgctggggaacgtgcactcctgcagcgagtccgtcctcgcggacagcaagatcatgcagtgcaccacctccggcagctccaccctgtgcaaggccagcgggaccgtgatcatgaagctgggcccgatcgggagcgagtcctgcctcatcctgaagggcctgaaggacagcgagaagcagttcatctccatcaagaccatcagctccgagctgacctgccgcgagggcgagagcttctggaccacgctctacacccccgtgtgcctgtccagccggcgctgccacctcatgggggagtgcgtctccgaccggtgcctgaagtggaagaccaacgagaccagcgccgagttcacgggcaaggcccacggggaggtgatgcacgagaaccgctgcttcgagcagtccggcgggatcggctacggctgcttcaacgtgaaccccagctgcctgtacgtccactcctacctcaagagcgtgtacaagaacgggttcaagatcttccggtgcgtggcgtggaaccaccgcatccggctggaggtcaccacccactcccgcaagttccccatggtgctgatggccatgagcacccagccgacggactggggctccatcgggctcatcctggacagcgagggcatcaccgggaccaacgcctactccttcatgaagcacggcagcggcagcttcgccatcatcgacgacccctactcccccgagccccggaaggggttcctgggcgaggtgcgctgcccgaccgaggagacggccatccgggcgagcccctcctgcaagatggcccccaacctcatcgagtaccagcccgagatggacaccgccgagtgcaccaccaacatgatcgacccgatggccatcttcaaccgcgggagcctgccccaggtccgggacggcatgacgttcacccagtccatcgagaagaacaccgtgcaggccctgaccacgggggaggtgcgcgcgagcatccgcctcaccctggacgactacgacgtcgtgtaccagaactcccagagcgactgctccgccaccttcaagaacctgaccggctgctacagctgcgacgagggctcccggatgtgctaccaggtgaaggccgagggggagaccatcttccacttcgtcaacgaggacgagagcatcaacgtgatcaacaaggtgtcccccgacgtcagcgactactgcacggtgctccacttctcccgccccgtcatcagcatcgagggccggtacgactgcgggctgtccaagcgcccgatggtgatcaagggcaccctgatcgccaccgcgccccacgacgaccggaagcacgagggcgggagctccctcgtggtcaaccccaagggcgggaccgtggacttcttcggctgggtgagcgggctgacgagctggctgggcggccccctcaagaccttcctgaccatcctggggttcctcgccctgggcctgctcctggtcgtgatcatcatcatcatcgcccgcaccggggtgcagcaggccctgaagaagaagaacaagtga

SEQ ID NO: 13055 - RNA, 4020 nt, synthetic construct
  misc_feature 1..4020: note = derived and/or modified CDS sequence (opt1) from TOSV(AR)__EF656362.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacgtcaccgagtccatcgggctgaccagcggcacgtgcaaggtggggtccctggagaaccgcgactgccggaaggacatcatgagcaactacgtggccgaggtccactccaacctccacggcctgggcgccatgatgcacaactacggggacgacaagcgcgtggagatcctgaacgacgtgatccccgacgagctcaacccgggccaccacaactgcagcgacctggaccggaagcccttctggaccgagttcatcaacgtcgccaagccctccagcgagatcgtgcccatgtccgtgatcccgccgcccgtcgtgaagctgcagccgcccgccgagcccagctccaagaagcacgtgcccttcgacgtcctcctgagcgaggcggagaaggagctgaaccagaccaagatccgcctcgaggacgagcggaagtccaacgccgaggagaccgccaaggagcgcgcccggatgaaggagatcgaggacgagctgcgccgggagtgggagctggagcgcaagcggaaggacgcgatggccgacgacctcgccaaggagacggcccgccggcgcgagatcgagcggaaggcccacgagctggaccgcatgctgaagaagaaggagcgggagagcctcatcgcgaaggagaaggccgacgaggacatgcgcagccacgtgcacaagcccaacaccacccgggcccccgcccccaccatcatcacgaccctgctgatggcctccgcggccctcgccgggcccctggagaaccgcgagaccaaccacctcctgaaccgccccggcaacggggcctacaccctgagcgacttcgccgagtccacgtgcaccctggcgtacggcagcgagtgcaagtcctgggagcacctcctgaacgaggagctgttcccgttcttccacagcaacctcgacaagtactccatgctggaggccgccaccgagaccgtgcccatcctgaacaagagctccgccgtctgcacgatcagcccctccacccacagctccaacgcctgcggccgggaggcgagcgtgatccgcaagaagtgctactccaacatgagcgccttcttctacatcaacctcgccgggcagatcaccgtggtcaagtgcgagaccaaccacgtgctgtccagcgactgcggcaactgcatctccaagagcctgagcgggcagaaggtgtacacgcccgtccaggacgtgttctgccagaagggctggacccagtccatcccgagcacccggtactccaaggacatctgcagcatcggcctccacaccgtgaaggagtgcaagatcgggacgacctccttcgagcgcgtcggcttcatcgtggtcaaggggcggaagatgtacatcgagcagatgaagatgcgcagccggcaggagtactccgaggaccagttcctgtgctacaagagcgagtccggcagcgggtccagcgtgaagctgaagaagttcaaggtggagtcctgcaagggcgtcaccaccagctccgccagcaagtgctccggcgacgagtacttctgcaaccgctacccctgcgagacggcgaacgtggaggcccactgcatcctccggcgccacagcgccatcgtggaggtcaacgtgaacggggtgtgggtcgtgccccggtgcatcggctacgaggaggtgctggtcaagcgcaccagcctgaaggtggaggacaccaccgggcgggagtgcgactcctgcctctgggagtgcggcaaggacaagctgatcgtgaagacgcacgggcccaaggtcgtgtacgccaccgcctgcagccacggctcctgcaagagcgtgatgcagaagccggcgaccttcgtctacctgccctaccccggcaactccgagatcgtcgggggcgacatcgggatccacatgaccgaggagagctcccccagcaacatccacctggtggcccactgcccggccaaggactcctgcgacgtgagcgactgcctcttctgcgtgcacggcctgctgaactaccagtgccacaccctcttctccgccctgctgatcagcacgaccgtgatgtccatcctcaccctgctgctcctgctggtcaagggggccaaggacctcgtgaagaagctgttctactggctgatcacgcccctctgctggctgagcgtgttctgctgctgggtcgtgaagtcctggaagcgccgggtgggcagcgcgatctcccgcaccaacgacaccatcggctggcgggagaaccgccggcacgcccaggacatcgagcgcgcccagtacaccgggggcgcccccggggccaagtacagcttctacggcgtcatgatcctgggcctcctgtccagcgcgcagagctgctccgagagcgtgatcgccgactccaagatcatgcagtgcaccacgagcgggtccagcaccctgtgcaaggcctccggcaccgtgatcatgcgcctcgggccgatcggcagcgagtcctgcctgatcctgaaggggctcaaggacagcgagaagcagttcatctccatcaagaccatcagctccgagctgacgtgccgggagggcgagagcttctggaccaccctgtacacccccatctgcctctccagccgccggtgccacctgatgggcgagtgcgtctccgaccgctgcctgaagtggaagacgaaccagaccagcgccgagttcaccgggaaggcgcacggcgacgtgatgcacgagaaccggtgcttcgagcagtccgggggcatcgggtacggctgcttcaacgtgaaccccagctgcctctacgtccacagctacctgaagtccgtgtaccgcaacggcttcaaggtgttccggtgcgtcgcctggatccaccgcatccggctggaggtgaccacgcacagccgcaagttccccatggtgctcatggccatgtccacccagccgaccgactgggggagcatcggcctgatcctggactccgaggggatcaccggcacgaacagctactccttcatgaagcacgggagcggctccttcgccatcatcgacgacccctacagccccgagccccggaagggcttcctcggggaggtccgctgcccgaccgaggagaccgccatgcgggcgtcccccagctgcaagatggcccccaacctgatcgagtaccagcccgagatggacaccgccgagtgcacgaccaacatgatcgacccgatggccatcttcaaccgcggctccctgccccaggtgcgggacgggatgaccttcacccagagcatcgagaagaacacggtgcaggccctcaccaccggcgaggtcaaggcgtccatccgcctgaccctggacgactacgacgtggtgtaccagaacagccagtccgactgcagcgccacgttcaagaacctcaccgggtgctactcctgcgacgagggcagccggctgtgctaccaggtcaaggccgagggcgagaccgtgttccacttcatcaacgaggaggagagcatcaacgtgatcaacaaggtctcccccggggtgagcgactactgcaccgtcctgcacttctcccgccccgtgatcagcatcgagggcacctacgactgcgggctctccaagcggccgatggtgatcaagggcacgctgatcgccaccgcgccccacgacgaccgcaagcacgagggcgggagctccctggtcgtgaaccccaagggcgggagcgtggacttcttcggctgggtctccgggctcaccagctggctgggcggccccctgaagaccttcctcacgatcctggggttcctggccgtgggcctcctgctggtggtcatcatcatcatcatcatccggaccgggatgcagcaggccctcaagaagaagatcaagtga

SEQ ID NO: 13056 - RNA, 4020 nt, synthetic construct
  misc_feature 1..4020: note = derived and/or modified CDS sequence (opt1) from TOSV(EsPhGR40)__FJ153283.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcctgggacaacgtcaccgagtccatcgggctgaccagcggcacgtgcaaggtggggtccctggagaaccgcgactgcggcaaggacatcatgagcaactacgtggccgaggtccactccaacctccacggcctgggggccatgatgcacaactacggcgacgacaagcgggtggagatcctgaacgacgtgatccccgacgagctcaacccggggcaccacaactgcagcgacctggaccgcaagcccttctggaccgagttcatcaacgtcgccaagcccctgtccgagatcgcccccatgagcgtgatcccgccgcccgtggtcaagctccagccgcccgcggagccctccagcaagaagcacgtgcccttcgacgtgctgctgtccgaggccgagaaggagctcaaccagaccaagatccggctggaggacgagcgcaagagcaacgccgaggagaccgcccgggagcgcgcgcggatgcgcgacatcgaggaggagctgcggaaggagtgggagctcgagcgcaagcggaaggacgccatggccgacgacctggccaaggagacggccaagcgccgggagatcgagcgcaaggcgcacgagctggaccggatgctcaagaagaaggagcgcgagtccctgatcgccaaggagaaggaggacgagaacatgcggagccgcgtccacaagcccagcaccacccgggcccccgcccccaccatcatcacgaccctgctcatggcctccaccgcgctggccggccccctggagaaccgcgagaccaaccacctcctgaaccgccccgggaacggcgcctacacgctgagcgacttcgccgagtccacgtgcaccctcgcctacggcagcgagtgcaagtcctgggagcacctcctgaacgaggagctgttcccgttcttccacagcaacctggacaagtactccatgctggaggcggccaccgagacggtgcccatcctcaacaagagctccgccgtgtgcaccatcagcccctccacccacagctccaacgcctgcgggcgggaggccagcgtcatccgcaagaagtgctactccaacatgagcgcgctgttctacatcaacctggccggccagatcaccgtggtgaagtgcgagacgaaccacgtcctctccagcgactgcgggaactgcatctccaagagcctgagcggccagaaggtgtacacccccgtgcaggacgtcttctgccagaagggctggaccgagtccatcccgagcacccggtactccaaggacatctgcagcatcgggctgcacacggtgaaggagtgcaagatcggcaccacctccttcgagcgcgtggggttcatcgtcgtgaagggccggaagatgtacatcgagcagatgaagatgcgcagccggcaggagtactccgaggaccagttcctctgctacaagagcgagtccgggagcggctccagcgtcaagctgaagaagttcaaggtggagtcctgcaagggcgtgaccacgagctccgccagcaagtgctccggggacgagtacttctgcagccgctacccctgcgagaccgccaacgtcgaggcgcactgcatcctgcggcgccacagcgccatcgtggaggtgaacgtcaacggcgtgtgggtggtcccccggtgcatcgggtacgaggaggtgctcgtgaagcgcacctccctgaaggtcgaggacaccacggagcgggagtgcgacagctgcctgtgggagtgcggcaagaacaagctgatcgtgaagacccacgggcccaaggtggtctacgccaccgcctgctcccacggcagctgcaagtccgtgatgcagaagccgaccaccttcgtgtacctcccctaccccggcaacagcgagatcgtcgggggcgacatcgggatccacatgacggaggagtccagcccctccaacatccacctggtggcccactgcccggcgcgcgacagctgcgacgtgtccgactgcctgttctgcgtccacggcctcctgaactaccagtgccacaccctgttcagcgccctcctgatctccaccaccgtgatgagcatcctgacgctcctgctgctcctggtgaagggggccaaggacctggtcaagaagctgttctactggctgatcacgcccctgtgctggctctccgtgttctgctgctgggtggtcaagagctggaagcggcgcgtgggctccgccatcagccggaccaacgacaccatcggctggcgcgagaaccggcgctacgcccaggacatcgagcgcgcgcagtacaccgggggcgcccccggggccaagtactccttctacggcgtgatgatcctgggcctgctcagcagcgcccagtcctgcagcgagtccgtcatcgccgacagcaagatcatgcagtgcaccacctccgggagctccaccctgtgcaaggcgagcggcaccgtgatcatgcggctggggccgatcggctccgagagctgcctcatcctgaaggggctgaaggactccgagaagcagttcatcagcatcaagaccatctccagcgagctgacctgccgcgagggcgagtccttctggaccacgctctacacccccatctgcctgagctcccggcgctgccacctcatgggcgagtgcgtgagcgaccggtgcctgaagtggaagaccaacgagacctccgccgagttcacggggaaggcccacggcgacgtcatgcacgagaacaagtgcttcgagcagagcgggggcatcgggtacggctgcttcaacgtgaaccccagctgcctgtacgtgcactcctacctcaagagcgtctaccgcaacggcttcaagatcttccggtgcgtggcctggaaccaccgcatccggctggaggtgaccacccagtcccgcaagttccccatggtcctgatggcgatgagcacccagccgacggactgggggtccatcggcctcatcctggacagcgaggggatcaccggcaccaactcctacagcttcatgaagcacgggtccggcagcttcgccatcatcgacgacccctactcccccgagccccggaagggcttcctgggggaggtgcgctgcccgaccgaggagacggccatgcgggccagcccctcctgcaagatggcccccaacctcatcgagtaccagcccgagatggacaccgcggagtgcaccaccaacatgatcgacccgatggccatcttcaaccgcggcagcctgccccaggtgcgggacgggatgacgttcacccagtccatcgagaagaacaccgtccaggccctgaccacgggcgaggtgaaggccagcatccgcctcaccctggacgactacgacgtggtctaccagaactcccagagcgactgctccgccaccttcaagaacctgaccgggtgctacagctgcgacgagggcagccggctctgctaccaggtgaaggcggagggcgagaccgtgttccacttcatcaacgaggaggagtccatcaacgtcatcaacaaggtgagccccgacgtgtccgactactgcacggtcctgcacttcagccgccccatcatctccatcgaggggacctacgactgcggcctgagcaagcggccgatggtgatcaaggggaccctcatcgccaccgcgccccacgacgaccgcaagcacgagggcggctccagcctggtcgtgaaccccaagggcgggtccgtggacttcttcgggtggctgagcggcctcacgtcctggctcgggggccccctgaagaccttcctcaccatcctgggcttcctggccgtcgggctcctgctggtggtgatcatcatcatcatcatccggaccggcatgcagcaggccctcaagaagaagatcaagtga

SEQ ID NO: 13057 - RNA, 4014 nt, synthetic construct
  misc_feature 1..4014: note = derived and/or modified CDS sequence (opt1) from TOSV(SI-121283)__JF330279.1__GP
  source 1..4014: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgagtgcaagcgggacatcatgagcaactacgtggccgaggtgcactccaacctccacggcctgggcgccatgatgcacaactacggggacgacaagcgcatcgaggtcctgaacgacgtgatccccgacgagctcaacccgggccggcacaactgcagcgacctggaccgcaagcccttctggaccgagttcatcaacgtggccaagcccgccaacgagatggcgcccatgtccgtcatcccgccgcccatcgtgaagcccatccccgtggccgagagcaccaccaagaagacgatccccttcgacaagctgctctccgaggccgagaaggagctgaaccagaccaagatccggctggagaccgagcgccggagcaacgccgaggaggcggccaaggagcgcgcccggatgcgcgagatcgaggacaagctccggaaggactgggagctggagcgcgagcggaaggacgccgtcgccgaggacctggcgaaggagatcgcccgccggcgcgagatcgagcggaaggcccacgagctcgacaagatgctgaagaagaaggagcgcgaggacctggtggcccgggagcgcgtggacgaggacatgcgcaaccacgtccggcgccccaacaccacgatcgcccccaccatcatcaccaccctcctgatggggtccgcggtgatggccggcccgctggagaaccgggagcccacgcacctcctgaaccgccccgggaacggcgcctaccccctgagcgacttcgccgagccgacctgcaccctcgcctacggctccgagtgcaagagctgggagcaccagctggacgagctgagcttccccttcttccactccaacctcgacaagtacagcatgctggaggcggccaccgagacgatccccatcctgaacaagtccagcgccgtgtgcaccatctcccccagcacccactccagcaacgcctgcgggcgggaggcctccctcatcaagaagaagtgcggcagcgacatgtccgcgttcttctacgtcaacctggccgggcagatcaccgtggtgaagtgcgacacgaaccacgtcctgagcaacgactgcggcaactgcatctccaagaccctcagcggccagaagatctacaccccggtgcaggacatgttctgccagaaggggtggtccgagagcatcccctccacccgctacagcaaggacctgtgctccatcggcctgcacacggtgaaggagtgcaagatcgggaccaccaacttcgagcgggtcggcttcatcgtggtgaaggggcgcaagatgtacatcgagcagatgaagatgcggagccgccaggagttcagcgaggaccagttcctctgctacaagtccgagggcagctccggcagctccgtcaagctgaagaaggtgaaggtcgagagctgcaagggggtgaccacgtccagcgcctccaagtgcagcggcgacgagtacttctgctcccggtacccctgcgagaccgccaacgtggaggcgcactgcatcctgcgccggcacagcgccgtcatcgaggtgaacgtgaacggggtctgggtggtgccccgctgcatcggctacgaggaggtcctcgtgcggcgcacctccctgaaggtggaggacaccagctcccgggagtgcgacacgtgcctgtgggagtgcgggaagaacaagctcatcgtcaagacccacggcccgaagatcgtgtacgccaccgcctgcagccacggctcctgcaagagcgtgatgcagaagcccgccaccttcgtctacctgccctaccccgggaacagcgagatcgtgggcggggacatcggcgtgcacatgaccgaggagtccagcccgtccaacatccacatggtcgcgcactgccccgccaaggacagctgcgaggtgtccagctgcctgttctgcgtgcacgggctgctcaactaccagtgccacacgctgttctccgccctgctcatcagcaccaccgtcatgtccatcctgaccctgctcctgctgctcgtgaagggcgccaaggacctggtgaagcgcctgttctactggctcatcacgcccctgtgctggctgagcgtcttctgcggctggatgatccggtcctggaagaagcgcgtggggagcgccatctcccgcaccaacgacaccatcggctggcgggacaacagccgccgggggcaggacatcgagcgcgcgcagtacaccggcggcgccccgggggccaagtactccttctacggcgtgatgatcctcgggctgctgggcaacgtccacagctgctccgagagcatcatcgccgactccaagatcatgcagtgcacgaccagcgggagctccaccctctgcaaggccagcggcaccgtgatcatgaagctgggccccatcgggtccgagagctgcctgatcctcaagggcctgaaggactccgagaagcagttcatcagcatcaagacgatctccagcgagctgacctgccgggagggggagtccttctggaccaccctctacacgcccgtgtgcctgagctcccgccggtgccacctgatgggcgagtgcgtcagcgaccgctgcctccggtggaagaccaacgagacctccgcggagttcaccgggaaggcccacggcgaggtgatgcacgagaaccgctgcttcgagcagagcggcgggatcggctacgggtgcttcaacgtgaacccctcctgcctgtacgtccacagctacctgaagtccgtgtacaagaacggcttcaagatcttccggtgcgtggcctggaaccaccgcatccggctcgaggtcacgacccacagccgcaagttcccgatggtgctgatggccatgtccacccagcccaccgactgggggagcatcggcctgatcctcgacagcgagggcatcacggggaccaacgcgtactccttcatgaagcacggcctggggagcttcgccatcatcgacgacccctactcccccgagccgcggaagggcttcctgggggaggtgcgctgccccaccgaggagaccgccatccgggccagcccctcctgcaagatggcccccaacctcatcgagtaccagccggagatggacacggcggagtgcaccaccaacatgatcgaccccatggccatcttcaaccgcggcagcctgccccaggtccgggacggcatgaccttcacgcagtccatcgagaagaacaccgtgcaggccctgaccaccggggaggtgcgcgccagcatccggctcacgctggacgactacgacgtcgtgtaccagaactcccagttcgactgcagcgccaccttcaagaacctgaccggctgctactcctgcgacgaggggagccgcatgtgctaccaggtgaaggcggagggcgagaccatcttccacttcgtcaacgaggacgagtccatcaacgtgatcaacaaggtgagccccgacgtctccgactactgcaccgtgctccacttcagccgcccggtgatctccatcgagggccggtacgactgcgggctgagcaagcgccccatggtcatcaagggcacgctgatcgccaccgcgccccacgacgaccggaagcacgagggcgggtccagcctcgtggtcaaccccaagggcgggaccgtggacttcttcggctgggtgagcgggctgacctcctggctgggcgggccgctcaagacgttcctgaccatcctgggcttcctcgccctggggctgctcctggtcgtgatcatcatcatcatcgcccgcaccggcgtggagcaggccctgaagaagaagaacaagtga

SEQ ID NO: 13058 - RNA, 4014 nt, synthetic construct
  misc_feature 1..4014: note = derived and/or modified CDS sequence (opt1) from TOSV(SI-121487)__JF330280.1__GP
  source 1..4014: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgagtgcaagcgggacatcatgagcaactacgtggccgaggtgcactccaacctccacggcctgggcgccatgatgcacaactacggggacgacaagcgcatcgaggtcctgaacgacgtgatccccgacgagctcaacccgggccggcacaactgcagcgacctggaccgcaagcccttctggaccgagttcatcaacgtggccaagcccgccaacgagatggcgcccatgtccgtcatcccgccgcccatcgtgaagcccatccccgtggccgagagcaccaccaagaagacgatccccttcgacaagctgctctccgaggccgagaaggagctgaaccagaccaagatcatgctggagaccgagcggcgcagcaacgccgaggaggcggccaaggagcgggcccgcatgcgggagatcgaggacaagctccgcaaggactgggagctggagcgggagcgcaaggacgccgtcgccgaggacctggcgaaggagatcgcccggcgccgggagatcgagcgcaaggcccacgagctcgacaagatgctgaagaagaaggagcgggaggacctggtggcccgcgagcgggtggacgaggacatgcgcaaccacgtccgccggcccaacaccacgatcgcccccaccatcatcaccaccctcctgatggcgtccgccgtgatggccgggccgctggagaaccgcgagatcaaccacctcctgaactggcccggcaacggggcctacacgctgagcgacttcgccgagtccacgtgcaccctcgcgtacggcagcgagtgcaagagctgggagcaccagctggacgagctgtccttccccttcttccacagcaacctcgacaagtactccatgctggaggccgccaccgagaccatccccatcctgaacaagagctccgccgtgtgcaccatcagcccgtccacccacagctccaacgcctgcggccgggaggcgagcctcatcaagaagaagtgcgggtccgacatgagcgccttcttctacgtcaacctggccggccagatcaccgtggtgaagtgcgacacgaaccacgtcctgtccaacgactgcgggaactgcatcagcaagaccctctccggccagaagatctacacccccgtgcaggacatgttctgccagaagggctggagcgagtccatccccagcacccgctactccaaggacctgtgcagcatcgggctgcacacggtgaaggagtgcaagatcggcaccaccaacttcgagcgggtcgggttcatcgtggtgaagggccgcaagatgtacatcgagcagatgaagatgcggagccgccaggagttctccgaggaccagttcctctgctacaagagcgaggggtccagcggctccagcgtcaagctgaagaaggtgaaggtcgagtcctgcaagggcgtgaccacgagctccgccagcaagtgctccggggacgagtacttctgcagccggtacccctgcgagaccgcgaacgtggaggcccactgcatcctgcgccggcactccgccgtcatcgaggtgaacgtgaacggcgtctgggtggtgccgcgctgcatcgggtacgaggaggtcctcgtgcggcgcaccagcctgaaggtggaggacacctccagccgggagtgcgacacgtgcctgtgggagtgcggcaagaacaagctcatcgtcaagacccacgggcccaagatcgtgtacgccaccgcctgctcccacggcagctgcaagagcgtgatgcagaagcccgcgaccttcgtctacctgccctacccgggcaactccgagatcgtcgggggcgacatcggggtgcacatgaccgaggagagctcccccagcaacatccacatggtggcccactgccccgccaaggactcctgcgaggtgagctcctgcctgttctgcgtgcacggcctgctcaactaccagtgccacacgctgttcagcgccctgctcatctccaccaccgtcatgagcatcctgaccctgctcctgctgctcgtgaagggggccaaggacctggtgaagcgcctgttctactggctcatcacgcccctgtgctggctgtccgtcttctgcggctggatgatccggagctggaagaagcgcgtgggctccgcgatcagccggaccaacgacaccatcgggtggcgcgacaactcccgccggggccaggacatcgagcgcgcccagtacaccgggggcgccccgggcgccaagtacagcttctacggggtgatgatcctcggcctgctggggaacgtccactcctgcagcgagtccatcatcgccgacagcaagatcatgcagtgcacgaccagcggctccagcaccctctgcaaggcgtccgggaccgtgatcatgaagctgggccccatcggcagcgagtcctgcctgatcctcaaggggctgaaggacagcgagaagcagttcatctccatcaagacgatcagctccgagctgacctgccgggagggcgagagcttctggaccaccctctacacgcccgtgtgcctgtccagccgccggtgccacctgatgggggagtgcgtctccgaccgctgcctccggtggaagaccaacgagaccagcgccgagttcaccggcaaggcccacggggaggtgatgcacgagaaccgctgcttcgagcagtccggcggcatcgggtacggctgcttcaacgtgaacccgagctgcctgtacgtccactcctacctcaagagcgtgtacaagaacgggttcaagatcttccggtgcgtggcctggaaccaccgcatccggctggaggtcacgacccactcccgcaagttccccatggtgctgatggcgatgagcacccagcccaccgactggggcagcatcgggctgatcctcgactccgagggcatcacgggcaccaacgcctacagcttcatgaagcacgggtccggcagcttcgccatcatcgacgacccctactccccggagccccggaaggggttcctgggcgaggtgcgctgccccaccgaggagaccgccatccgggccagcccctcctgcaagatggcgccgaacctgatcgagtaccagcccgagatggacacggccgagtgcaccaccaacatgatcgaccccatggccatcttcaaccgcgggagcctcccccaggtccgggacggcatgaccttcacgcagtccatcgagaagaacaccgtgcaggccctgaccaccggcgaggtgcgcgccagcatccggctgacgctcgacgactacgacgtcgtgtaccagaactcccagttcgactgcagcgcgaccttcaagaacctgaccgggtgctactcctgcgacgagggcagccgcatgtgctaccaggtgaaggccgagggggagaccatcttccacttcgtcaacgaggacgagtccatcaacgtgatcaacaaggtgagcccggacgtctccgactactgcaccgtgctgcacttcagccggcccgtgatctccatcgagggccgctacgactgcggcctcagcaagcgccccatggtcatcaagagcacgctgatcgccaccgcgccccacgacgaccggaagcacgagggcgggtccagcctggtggtcaacccgaagggcgggaccgtggacttcttcgggtgggtgtccggcctcaccagctggctgggcgggcccctgaagacgttcctcaccatcctgggcttcctggccctcgggctgctgctcgtcgtgatcatcatcatcatcgcccgcaccggcgtgcagcaggccctgaagaagaagaacaagtga

SEQ ID NO: 13059 - RNA, 4014 nt, synthetic construct
  misc_feature 1..4014: note = derived and/or modified CDS sequence (opt1) from TOSV(SI-21137)__EU003173.1__GP
  source 1..4014: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgagtgcaagcgggacatcatgagcaactacgtggccgaggtgcactccaacctccacggcctgggcgccatgatgcacaactacggggacgacaagcgcatcgaggtcctgaacgacgtgatccccgacgagctcaacccgcggcgccacaactgcagcgacctggaccggaagcccttctggaccgagttcatcaacgtggccaagcccgccaacgagatcgcgcccatgtccgtcatcccgccgcccatcgtgaagcccatccccgtggccgagagcaccaccaagaagacgatccccttcgacaagctgctctccgaggccgagaaggagctgaaccagaccaagatccgcctggagaccgagcggcgcagcaacgccgaggaggcggccaaggagcgggcccgcatgcgggagatcgaggacaagctccgcaaggactgggagctggagcgggagcgcaaggacgccgtcgccgaggacctggcgaaggagatcgcccggcgccgggagatcgagcgcaaggcccacgagctcgacaagatgctgaagaagaaggagcgggaggacctggtggcccgcgagcgcgtggacgaggacatgcggaaccacgtccgccggcccaacaccacgatcgcccccaccatcatcaccaccctcctgatggcgtccgccgtgatggccggcccgctggagaaccgcgagacgaaccacctcctgaaccggcccgggaacggcgcctacaccctgagcgacttcgccgagtccacgtgcaccctcgcgtacgggagcgagtgcaagagctgggagcaccagctggacgagctgtccttccccttcttccacagcaacctcgacaagtactccatgctggaggccgccaccgagaccatccccatcctgaacaagagctccgccgtgtgcaccatcagcccgtccacccacagctccaacgcctgcggccgcgaggcgagcctcatcaagaagaagtgcggctccaacatgagcgccttcttctacgtcaacctggccgggcagatcacggtggtgaagtgcgacaccaaccacgtcctgtccaacgactgcggcaactgcatcagcaagaccctctccgggcagaagatctacacccccgtgcaggacatgttctgccagaagggctggagcgagacgaacccctccacccggtacagcaaggacctgtgctccatcggcctgcacaccgtgaaggagtgcaagatcgggaccacgaacttcgagcgcgagggcttcatcgtcgtgaaggggcggaagatgtacatcgagcagatgaagatgcgcagccggcaggagttcagcgaggaccagttcctctgctacaagtccgagggcagctccgggagctccgtgaagctgaagaaggtcaaggtggagagctgcaagggcgtcaccacctccagcgcctccaagtgcagcggcgacgagtacttctgctcccgctacccctgcgagaccgcgaacgtggaggcccactgcatcctgcggcgccacagcgccgtgatcgaggtcaacgtgaacggggtgtgggtcgtgccgcggtgcatcggctacgaggaggtgctcgtccgccggacgtccctgaaggtggaggacaccagctcccgcgagtgcgacacgtgcctgtgggagtgcgggaagaacaagctcatcgtgaagacccacggccccaagatcgtctacgccaccgcctgcagccacgggtcctgcaagagcgtgatgcagaagcccgcgaccttcgtgtacctgccctacccgggcaacagcgagatcgtcggcggggacatcggcgtgcacatgaccgaggagtccagcccctccaacatccacatggtggcccactgccccgccaaggacagctgcgaggtctccagctgcctgttctgcgtgcacgggctgctcaactaccagtgccacaccctgttctccgccctgctcatcagcaccacggtgatgtccatcctgaccctgctcctgctgctcgtcaagggcgccaaggacctggtgaagcggctgttctactggctcatcacgcccctgtgctggctgagcgtgttctgcgggtggatgatccgctcctggaagaagcgcgtcggcagcgcgatctcccggaccaacgacaccatcggctggcgcgacaacagccggcgcgggcaggacatcgagcgggcccagtacaccggcggggccccgggcgccaagtactccttctacggcgtgatgatcctcgggctgctgggcaacgtgcacagctgctccgagagcatcatcgccgactccaagatcatgcagtgcaccaccagcgggagctccacgctctgcaaggcgagcggcaccgtcatcatgaagctggggcccatcggctccgagagctgcctgatcctcaagggcctgaaggactccgagaagcagttcatcagcatcaagaccatctccagcgagctgacctgccgcgagggggagtccttctggacgaccctctacacccccgtgtgcctgagctcccggcgctgccacctgatgggcgagtgcgtgagcgaccggtgcctccgctggaagaccaacgagacgtccgccgagttcaccgggaaggcccacggcgaggtcatgcacgagaaccggtgcttcgagcagagcgggggcatcggctacgggtgcttcaacgtgaacccgtcctgcctgtacgtgcacagctacctgaagtccgtctacaagaacggcttcaagatcttccgctgcgtggcctggaaccaccggatccgcctcgaggtgaccacccacagccggaagttccccatggtcctgatggcgatgtccacgcagcccaccgactgggggagcatcggcctgatcctcgacagcgggggcatcaccggcaccaacgcctactccttcatgaagcacgggctgggcagcttcgccatcatcgacgacccctactccccggagccccgcaaggggttcctgggcgaggtgcggtgccccacggaggagaccgccatccgcgccagcccctcctgcaagatggcgccgaacctcatcgagtaccagcccgagatggacaccgccgagtgcaccacgaacatgatcgaccccatggccatcttcaaccgggggagcctgccccaggtgcgcgacggcatgaccttcacccagtccatcgagaagaacaccgtccaggccctgacgaccggcgaggtgcgggccagcatccgcctcaccctggacgactacgacgtggtctaccagaactcccagttcgactgcagcgcgaccttcaagaacctgaccgggtgctactcctgcgacgagggcagccgcatgtgctaccaggtgaaggccgagggggagacgatcttccacttcgtgaacgaggacgagtccatcaacgtcatcaacaaggtgagcccggacgtgtccgactactgcaccgtcctccacttcagccggcccgtgatctccatcgagggccgctacgactgcggcctgagcaagcggcccatggtgatcaaggggaccctgatcgccaccgcgccccacgacgaccgcaagcacgagggcgggtccagcctcgtcgtgaacccgaagggcgggacggtcgacttcttcggctgggtgagcggcctgacctcctggctcgggggccccctgaagaccttcctgaccatcctggggttcctcgccctgggcctgctcctggtggtcatcatcatcatcatcgcccggacgggggtggagcaggccctgaagaagaagaacaagtga

SEQ ID NO: 13060 - RNA, 4014 nt, synthetic construct
  misc_feature 1..4014: note = derived and/or modified CDS sequence (opt1) from TOSV(SI-31051)__EU003174.1__GP
  source 1..4014: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgagtgcaagcgggacatcatgagcaactacgtggccgaggtgcactccaacctccacggcctgggcgccatgatgcacaactacggggacgacaagcgcatcgaggtcctgaacgacgtgatccccgacgagctcaacccgggccggcacaactgcagcgacctggaccgcaagcccttctgcaccgagttcatcaacgtggccaagcccgccaacgagatggcgcccatgtccgtcatcccgccgcccatcgtgaagcccatccccgtggccgagcccaccaccaagaagacgatccccttcgacaagctgctcagcgaggccgagaaggagctgaaccagaccaagatccggctggagaccgagcgccggtccaacgccgaggaggcggccaaggagcgcgcccggatgcgcgagatcgaggacaagctccggaaggactgggagctggagcgcgagcggaaggacgccgtcgccgaggacctggcgaaggagatcgcccgccggcgcgagatcgagcggaaggcccacgagctcgacaagatgctgaagaagaaggagcgcgaggacctggtggcccgggagcgcgtggacgaggacatgcgcaaccacgtccggcgccccaacaccacgatcgccccgaccatcatcaccaccctcctgatggcgagcgccgtgatggccgggcccctggagaaccgggagacgaaccacctcctgaaccgccccggcaacggggcctacaccctgtccgacttcgccgagagcacgtgcaccctcgcgtacggctccgagtgcaagagctgggagcaccagctggacgagctgagcttccccttcttccactccaacctcgacaagtacagcatgctggaggccgccacggagaccatcccgatcctgaacaagtccagcgccgtgtgcaccatctcccccagcacccactccagcaacgcctgcggccgggaggcgtccctcatcaagaagaagtgcgggagcgacatgtccgccttcttctacgtcaacctggccggccagatcacggtggtgaagtgcgacaccaaccacgtcctgagcaacgactgcgggaactgcatctccaagaccctcagcggccagaagatctacacccccgtgcaggacatgttctgccagaagggctggtccgagagcatcccctccacgcgctacagcaaggacctgtgctccatcgggctgcacaccgtgaaggagtgcaagatcggcaccaccaacttcgagcgggtcgggttcatcgtggtgaagggccgcaagatgtacatcgagcagatgaagatgcggagccgccaggagttcagcgaggaccagttcctctgctacaagtccgaggggagctccggcagctccgtcaagctgaagaaggtgaaggtcgagagctgcaagggcgtgacgacctccagcgcctccaagtgcagcggggacgagtacttctgctcccggtacccgtgcgagaccgcgaacgtggaggcccactgcatcctgcgccggcacagcgccgtcatcgaggtgaacgtgaacggcgtctgggtggtgccccgctgcatcgggtacgaggaggtcctcgtgcggcgcacctccctgaaggtggaggacacgagctcccgggagtgcgacacgtgcctgtgggagtgcggcaagaacaagctcatcgtcaagacccacgggcccaagatcgtgtacgccaccgcctgcagccacggctcctgcaagagcgtgatgcagaagcccgcgaccttcgtctacctgccgtaccccggcaacagcgagatcgtcgggggcgacatcggggtgcacatgaccgaggagtccagcccctccaacatccacatggtggcccactgccccgccaaggacagctgcgaggtgtccagctgcctgttctgcgtgcacggcctgctcaactaccagtgccacaccctgttctccgccctgctcatcagcaccaccgtcatgtccatcctgacgctgctcctgctgctcgtgaagggggccaaggacctggtgaagcgcctgttctactggctcatcaccccgctgtgctggctgagcgtcttctgcggctggatgatccggtcctggaagaagcgcgtgggcagcgcgatctcccgcaccaacgacaccatcgggtggcgggacaacagccgccggggccaggacatcgagcgcgcccagtacaccgggggcgcccccggcgccaagtactccttctacggggtgatgatcctcggcctgctggggaacgtccacagctgctccgagagcatcatcgccgactccaagatcatgcagtgcaccaccagcggcagctccaccctctgcaaggcgagcgggacggtgatcatgaagctgggccccatcggctccgagagctgcctgatcctcaaggggctgaaggactccgagaagcagttcatcagcatcaagaccatctccagcgagctgacctgccgggagggcgagtccttctggaccacgctctacaccccggtgtgcctgagctcccgccggtgccacctgatgggggagtgcgtcagcgaccgctgcctccggtggaagaccaacgagacctccgccgagttcacgggcaaggcccacggggaggtgatgcacgagaaccgctgcttcgagcagagcggcggcatcgggtacggctgcttcaacgtgaacccctcctgcctgtacgtccacagctacctgaagtccgtgtacaagaacgggttcaagatcttccggtgcgtggcctggaaccaccgcatccggctcgaggtcaccacccacagccgcaagttccccatggtgctgatggcgatgtccacccagcccacggactggggcagcatcgggctgatcctcgacagcggcggcatcaccgggaccaacgcctactccttcatgaagcacggcctggggagcttcgccatcatcgacgacccgtactcccccgagccccggaagggcttcctgggggaggtgcgctgccccaccgaggagacggccatccgggccagcccgtcctgcaagatggcgcccaacctcatcgagtaccagcccgagatggacaccgccgagtgcaccaccaacatgatcgaccccatggccatcttcaaccgcggcagcctgccgcaggtccgggacggcatgacgttcacccagtccatcgagaagaacaccgtgcaggccctgaccacgggggaggtgcgcgccagcatccggctcaccctggacgactacgacgtcgtgtaccagaactcccagttcgactgcagcgcgaccttcaagaacctgaccggctgctactcctgcgacgaggggagccgcatgtgctaccaggtgaaggccgagggcgagaccatcttccacttcgtcaacgaggacgagtccatcaacgtgatcaacaaggtgagccccgacgtctccgactactgcacggtgctccacttcagccgccccgtgatctccatcgagggccggtacgactgcgggctgagcaagcgccccatggtcatcaagggcaccctgatcgccaccgccccgcacgacgaccggaagcacgagggcgggtccagcctcgtggtcaaccccaagggcgggaccgtggacttcttcggctgggtgagcgggctgacgtcctggctgggcgggcccctcaagaccttcctgaccatcctgggcttcctcgccctggggctgctcctggtcgtgatcatcatcatcatcgcgcgcaccggcgtggagcaggccctgaagaagaagaacaagtga

SEQ ID NO: 13061 - RNA, 4014 nt, synthetic construct
  misc_feature 1..4014: note = derived and/or modified CDS sequence (opt1) from TOSV(SI-39538)__EU003175.1__GP
  source 1..4014: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgagtgcaagcgggacatcatgagcaactacgtggccgaggtgcactccaacctccacggcctgggcgccatgatgcacaactacggggacgacaagcgcatcgaggtcctgaacgacgtgatccccgacgagctcaacccgggccggcacaactgcagcgacctggaccgcaagcccttctggaccgagttcatcaacgtggccaagcccgccaacgagatggcgcccatgtccgtcatcccgccgcccatcgtgaagcccatccccgtggccgagagcaccaccaagaagacgatccccttcgacaagctgctctccgaggccgagaaggagctgaaccagaccaagatccggctggagaccgagcgccggagcaacgccgaggaggcggccaaggagcgcgcccggatgcgcgagatcgaggacaagctccggaaggactgggagctggagcgcgagcggaaggacgccgtcgccgaggacctggcgaaggagatcgcccgccggcgcgagatcgagcggaaggcccacgagctcgacaagatgctgaagaagaaggagcgcgaggacctggtggcccgggagcgcgtggacgaggacatgcgcaaccacgtccggcgccccaacaccacgatcgcccccaccatcatcaccaccctcctgatggcgtccgccgtgatggccgggccgctggagaaccgggagacgaaccacctcctgaaccgccccggcaacggggcctacaccctgagcgacttcgccgagtccacgtgcaccctcgcgtacggcagcgagtgcaagagctgggagcaccagctggacgagctgtccttccccttcttccacagcaacctcgacaagtactccatgctggaggccgccacggagaccatccccatcctgaacaagagctccgccgtgtgcaccatcagcccgtccacccacagctccaacgcctgcggccgggaggcgagcctcatcaagaagaagtgcgggtccgacatgagcgccttcttctacgtcaacctggccggccagatcacggtggtgaagtgcgacaccaaccacgtcctgtccaacgactgcgggaactgcatcagcaagaccctctccggccagaagatctacacccccgtgcaggacatgttctgccagaagggctggagcgagtccatccccagcacgcgctactccaaggacctgtgcagcatcgggctgcacaccgtgaaggagtgcaagatcggcaccaccaacttcgagcgggtcgggttcatcgtggtgaagggccgcaagatgtacatcgagcagatgaagatgcggagccgccaggagttctccgaggaccagttcctctgctacaagagcgaggggtccagcggctccagcgtcaagctgaagaaggtgaaggtcgagtcctgcaagggcgtgacgaccagctccgccagcaagtgctccggggacgagtacttctgcagccggtacccctgcgagaccgcgaacgtggaggcccactgcatcctgcgccggcactccgccgtcatcgaggtgaacgtgaacggcgtctgggtggtgccgcgctgcatcgggtacgaggaggtcctcgtgcggcgcaccagcctgaaggtggaggacacgtccagccgggagtgcgacacgtgcctgtgggagtgcggcaagaacaagctcatcgtcaagacccacgggcccaagatcgtgtacgccaccgcctgctcccacggcagctgcaagagcgtgatgcagaagcccgcgaccttcgtctacctgccctacccgggcaactccgagatcgtcgggggcgacatcggggtgcacatgaccgaggagagctcccccagcaacatccacatggtggcccactgccccgccaaggactcctgcgaggtgagctcctgcctgttctgcgtgcacggcctgctcaactaccagtgccacaccctgttcagcgccctgctcatctccaccaccgtcatgagcatcctgacgctgctcctgctgctcgtgaagggggccaaggacctggtgaagcgcctgttctactggctcatcacgcccctgtgctggctgtccgtcttctgcggctggatgatccggagctggaagaagcgcgtgggctccgcgatcagccgcaccaacgacaccatcgggtggcgggacaactcccgccggggccaggacatcgagcgcgcccagtacaccgggggcgccccgggcgccaagtacagcttctacggggtgatgatcctcggcctgctggggaacgtccactcctgcagcgagtccatcatcgccgacagcaagatcatgcagtgcaccaccagcggctccagcaccctctgcaaggcgtccgggaccgtgatcatgaagctgggccccatcggcagcgagtcctgcctgatcctcaaggggctgaaggacagcgagaagcagttcatctccatcaagaccatcagctccgagctgacctgccgggagggcgagagcttctggaccacgctctacacccccgtgtgcctgtccagccgccggtgccacctgatgggggagtgcgtctccgaccgctgcctccggtggaagaccaacgagaccagcgccgagttcacgggcaaggcccacggggaggtgatgcacgagaaccgctgcttcgagcagtccggcggcatcgggtacggctgcttcaacgtgaacccgagctgcctgtacgtccactcctacctcaagagcgtgtacaagaacgggttcaagatcttccggtgcgtggcctggaaccaccgcatccggcacgaggtcaccacccactcccgcaagttccccatggtgctgatggcgatgagcacccagcccacggactggggcagcatcgggctgatcctggactccggcggcatcaccgggaccaacgcctacagcttcatgaagcacggcctcgggtccttcgccatcatcgacgacccctacagcccggagccccggaagggcttcctgggggaggtgcgctgccccaccgaggagacggccatccgggcctcccccagctgcaagatggcgccgaacctgatcgagtaccagcccgagatggacaccgccgagtgcaccaccaacatgatcgaccccatggccatcttcaaccgcggctccctcccccaggtccgggacggcatgacgttcacccagagcatcgagaagaacaccgtgcaggccctgaccacgggggaggtgcgcgcctccatccggctgaccctcgacgactacgacgtcgtgtaccagaacagccagttcgactgctccgcgaccttcaagaacctgaccggctgctacagctgcgacgaggggtcccgcatgtgctaccaggtgaaggccgagggcgagaccatcttccacttcgtcaacgaggacgagagcatcaacgtgatcaacaaggtgtccccggacgtcagcgactactgcacggtgctgcacttctcccgccccgtgatcagcatcgagggccggtacgactgcgggctctccaagcgccccatggtcatcaagggcaccctgatcgccaccgcgccccacgacgaccggaagcacgagggcgggagcagcctggtggtcaacccgaagggcgggaccgtggacttcttcggctgggtgtccgggctcacgagctggctgggcgggcccctgaagaccttcctcaccatcctgggcttcctggccctcgggctgctgctcgtcgtgatcatcatcatcatcgcccgcaccggcgtggagcaggccctgaagaagaagaacaagtga

SEQ ID NO: 13062 - RNA, 4014 nt, synthetic construct
  misc_feature 1..4014: note = derived and/or modified CDS sequence (opt1) from TOSV(SI-40463)__EU003176.1__GP
  source 1..4014: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgagtgcaagcgggacatcatgagcaactacgtggccgaggtgcactccaacctccacggcctgggcgccatgatgcacaactacggggacgacaagcgcgtcgaggtgctgaacgacgtgatccccgacgagctcaacccgggccggcacaactgcagcgacctggaccgcaagcccttctggaccgagttcatcaacgtcgccaagcccgtgaacgagatggcccccatgtccgtgatcccgccgcccatcgtcaagcccatccccgtggcggagagcaccaccaagaagacgatccccttcgacaagctgctctccgaggccgagaaggagctgaaccagaccaagatccggctggagaccgagcgccggagcaacgccgaggaggccgcgaaggagcgcgcccggatgcgcgagatcgaggacaagctccggaaggactgggagctggagcgcgagcggaaggacgccgtggccgaggacctggccaaggagatcgcgcgccggcgcgagatcgagcggaaggcccacgagctcgacaagatgctgaagaagaaggagcgcgaggacctggtcgcccgggagcgcgtggacgaggacatgcgcaaccacgtgcggcgccccaacaccacgatcgcccccaccatcatcaccaccctcctgatggcctccgcggtcatggccgggccgctggagaaccgggagacgaaccacctcctgaaccgccccggcaacggggcctacaccctgagcgacttcgccgagtccacgtgcaccctcgcctacggcagcgagtgcaagagctgggagcaccagctggacgagctgtccttccccttcttccacagcaacctcgacaagtactccatgctggaggcggccacggagaccatccccatcctgaacaagagctccgccgtgtgcaccatcagcccgtccacccacagctccaacgcctgcggccgggaggccagcctcatcaagaagaagtgcgggtccgacatgagcgcgttcttctacgtgaacctggccggccagatcacggtcgtgaagtgcgacaccaaccacgtgctgtccaacgactgcgggaactgcatcagcaagaccctctccggccagaagatctacacccccgtccaggacatgttctgccagaagggctggagcgagtccatccccagcacgcgctactccaaggacctgtgcagcatcgggctgcacaccgtgaaggagtgcaagatcggcaccaccaacttcgagcgggtggggttcatcgtcgtgaagggccgcaagatgtacatcgagcagatgaagatgcggagccgccaggagttctccgaggaccagttcctctgctacaagagcgaggggtccagcggctccagcgtcaagctgaagaaggtgaaggtggagtcctgcaagggcgtcacgaccagctccgccagcaagtgctccggggacgagtacttctgcagccggtacccctgcgagaccgccaacgtggaggcgcactgcatcctgcgccggcactccgccgtgatcgaggtcaacgtgaacggcgtgtgggtcgtgccgcgctgcatcgggtacgaggaggtgctcgtccggcgcaccagcctgaaggtggaggacacgtccagccgggagtgcgacacgtgcctgtgggagtgcggcaagaacaagctcatcgtgaagacccacgggcccaagatcgtctacgccaccgcctgctcccacggcagctgcaagagcgtgatgcagaagcccgccaccttcgtgtacctgccctacccgggcaactccgagatcgtcgggggcgacatcggggtgcacatgaccgaggagagctcccccagcaacatccacatggtggcgcactgccccgccaaggactcctgcgaggtcagctcctgcctgttctgcgtgcacggcctgctcaactaccagtgccacaccctgttcagcgccctgctcatctccaccaccgtgatgagcatcctgacgctgctcctgctgctcgtcaagggggccaaggacctggtgaagcgcctgttctactggctcatcacgcccctgtgctggctgtccgtgttctgcggctggatgatccggagctggaagaagcgcgtcggctccgccatcagccgcaccaacgacaccatcgggtggcgggacaactcccgccggggccaggacatcgagcgcgcgcagtacaccgggggcgccccgggcgccaagtacagcttctacggggtgatgatcctcggcctgctggggaacgtgcactcctgcagcgagtccatcatcgccgacagcaagatcatgcagtgcaccaccagcggctccagcaccctctgcaaggcctccgggaccgtcatcatgaagctgggccccatcggcagcgagtcctgcctgatcctcaaggggctgaaggacagcgagaagcagttcatctccatcaagaccatcagctccgagctgacctgccgggagggcgagagcttctggaccacgctctacacccccgtgtgcctgtccagccgccggtgccacctgatgggggagtgcgtgtccgaccgctgcctccggtggaagaccaacgagaccagcgcggagttcacgggcaaggcccacggggaggtcatgcacgagaaccgctgcttcgagcagtccggcggcatcgggtacggctgcttcaacgtgaacccgagctgcctgtacgtgcactcctacctcaagagcgtctacaagaacgggttcaagatcttccggtgcgtggcctggaaccaccgcatccggctggaggtgaccacccactcccgcaagttccccatggtcctgatggccatgagcacccagcccacggactggggcagcatcgggctgatcctcgactccggcggcatcaccgggaccaacgcgtacagcttcatgaagcacggcctggggtccttcgccatcatcgacgacccctacagcccggagccccggaagggcttcctgggggaggtgcgctgccccaccgaggagacggccatccgggcctcccccagctgcaagatggccccgaacctcatcgagtaccagcccgagatggacaccgcggagtgcaccaccaacatgatcgaccccatggccatcttcaaccgcggctccctgccccaggtgcgggacggcatgacgttcacccagagcatcgagaagaacaccgtccaggccctgaccacgggggaggtgcgcgcctccatccggctcaccctggacgactacgacgtggtctaccagaacagccagttcgactgctccgccaccttcaagaacctgaccggctgctacagctgcgacgaggggtcccgcatgtgctaccaggtgaaggcggagggcgagaccatcttccacttcgtgaacgaggacgagagcatcaacgtcatcaacaaggtgtccccggacgtgagcgactactgcacggtcctccacttctcccgccccgtgatcagcatcgagggccggtacgactgcgggctgtccaagcgccccatggtcatcaagggcaccctgatcgccaccgcgccccacgacgaccggaagcacgagggcgggagcagcctcgtggtgaacccgaagggcgggaccgtcgacttcttcggctgggtgtccgggctgacgagctggctgggcgggcccctcaagaccttcctgaccatcctgggcttcctcgccctggggctgctcctggtggtcatcatcatcatcatcgcccgcaccggcgtggagcaggccctgaagaagaagaacaagtga

SEQ ID NO: 13063 - RNA, 4020 nt, synthetic construct
  misc_feature 1..4020: note = derived and/or modified CDS sequence (opt1) from TOSV(SI-40614)__EU003177.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgactgcaagcgggacatcatgagcaactacgtggccgaggtgcactccaacctccacggcctgggcgccatgatgcacaactacggggacgacaagcgcgtcgaggtgctgaacgacgtgatccccgacgagctcaacccgggccggcacaactgcagcgacctggaccgcaagcccttctggaccgagttcatcaacgtcgccaagcccgccaacaagatcgcgcccatctccgtgatcccgccgcccatcgtgaagcccatccccatcgccgagagcaccatcaagaagaccatccccttcgacaagctgctctccgaggccgagaaggagctgaaccagacgaagatccggctggagaccgagcgccggagcaacgccggggaggcggcccgcgagcgggcccgcatgcgggagatcgaggacaagctccgcaagaactgggagctggagcgggagcgcaaggacgccgtcgccgacgacctggcgaaggagatcgcccggcgccgggagatcgagcgcaaggcccacgagctcgacaagatgctgaagaagaaggagcgggaggaccaggtggccatcgagcgcgtgtccgaggacatgcgcaaccacgtccggcgccccaacaccaccatcgcccccgcgccgacgatcatcaccaccctgctcatggccagcgccgtgatggccggccccctggagaaccgggagaccaaccacctcctgaaccgccccgggaacggcgcctacacgctgtccgacttcgcggagagcacgtgcaccctggcctacggcagcgagtgcaagtcctgggagcaccagctcgacgagctgagcttccccttcttccactccaacctggacaagtacagcatgctcgaggccgccaccgagaccatcccgatcctgaacaagtccagcgccgtgtgcaccatctcccccagcacccactccagcaacgcgtgcgggcgggaggcctccctgatcaagaagaagtgcggcaacaacatgagcgccttcttctacgtcaacctcgccgggcagatcaccgtggtgaagtgcgacacgaaccacgtcctgtccaacgactgcggcaactgcatcagcaagaccctgtccggccagaagatctacacccccgtgcaggacatgttctgccagcgcgggtggaccgagagcatcccctccacgcggtacagcaaggacctctgctccatcggcctgcacaccgtgaaggagtgcaagaccggggcgaccaacttcgagcgcgtcggcttcatcgtggtcaagagccggaagatgtacatcgagcagatgaagatgcgcagccggcaggagttctccgaggaccagttcctgtgctacaagagcgagtccagctccgggagctccgtgaagctcaagaaggtgaaggtcgagagctgcaagggcgtgacgacctccagcgcctccaagtgcagcggcgacgagtacttctgctcccgctacccgtgcgagaccgccaacgtggaggcccactgcatcctgcggcgccacagcgccgtcatcgaggtgaacgtgaacggggtctgggtggtgccccggtgcatcggctacgaggaggtcctggtgcgccggacctccctcaagatggaggacacgagctcccgcgagtgcgacacgtgcctgtgggagtgcgggaagaacaagctgatcgtgaagacccacggccccaagatcgtctacgcgaccgcctgcagccacgggagctgcaagtccgtgatgcagaagcccgccaccttcgtgtacctcccgtaccccggcaacagcgagatcgtcggcggggacatcggcgtgcacatgaccgaggagtccagcccctccaacatccacatggtggcccactgccccgccaaggacagctgcgaggtctccagctgcctgttctgcgtgcacgggctgctgaactaccagtgccacaccctcttctccgcgctgctgatcagcaccaccgtgatgtccatcctcacgctgctgctcctgctggtcaagggcgccaaggacctcgtgaagaagctgttctactggctgatcaccccgctctgctggctgagcgtgttctgcgggtggatgatcaagtcctggaagaagcgggtcggcagcgccatctcccgcaccaacgacaccatcggctggcgcgacaaccggcgctacgggcgggacgtggagcgcgcccagtacacgggcggggtgcccggcgccatctacagcttctacggcgtcatgatcctggggctcctgggcaacgtgcactcctgcagcgagtccgtgatcgcggacagcaaggtcatgcagtgcaccaccagcgggtccagcaccctgtgcaaggcctccggcacggtgatcatgaagctcgggcccatcggcagcgagtcctgcctgatcctgaagggcctcaaggacaacgagaagcagttcatcagcatcaagaccatctccagcgagctgacctgccgggagggggagtccttctggaccacgctgtacaccccggtgtgcctcagctcccgccggtgccacctgatgggcgagtgcgtcagcgaccgctgcctgaagtggaagaccaacgagacctcccccgagttcacggggaaggcccacggcgaggtgatgcacgagaaccggtgcttcgagcagagcgggggcatcggctacgggtgcttcaacgtgaacccctcctgcctctacgtccacagcatcctgaagtccgtgtacaagaacggcttcaagatcttccgctgcgtggcctggaaccaccggatccgcctggaggtcaccacccacagccggaagttccccatggtgctcatggcgatgtccacccagccgacggactgggggagcatcggcctgatcctggacagcgaggggatcaccggcaccaacgcctactccttcatgaagcacggcagcgggtccttcgccatcatcgacgacccctacagccccgagccccgcaagggcttcctcggggaggtgcggtgcccgaccgaggagacggccatccgcgcctcccccagctgcaagatggcgcccaacctgatcgagtaccagcccgagatggacaccgccgagtgcaccaccaacatgatcgacccgatggccatcttcaaccggggctccctgccccaggtccgcgacgggatgacgttcacccagagcatcgagaagaacaccgtgcaggccctcaccacgggcgaggtgcgggcctccatccgcctgaccctggacgactacgacgtcgtgtaccagaacagccagtccgactgcagcgcgaccttcaagaacctcaccggctgctactcctgcgacgaggggagccggatgtgctaccaggtgaaggccgagggcgagaccatcttccacttcgtcaacgaggacgagtccatcaacgtgatcaacaaggtgagccccgacgtctccgactactgcacggtgctgcacttcagccgccccgtcatctccatcgaggggcgctacgactgcggcctgagcaagcggccgatggtgatcaagggcaccctcatcgccaccgcgccccacgacgaccgcaagcacgagggcgggagctccctggtggtcaaccccaagggcgggaccgtggacttcttcgggtgggtgagcggcctgacgtcctggctcggcgggcccctgaagaccttcctgaccatcctcggcttcctggccctggggctcctgctggtcgtgatcatcatcatcatcgcccggaccggcgtggagcaggccctcaagaagaagaacaagtga

SEQ ID NO: 13064 - RNA, 4014 nt, synthetic construct
  misc_feature 1..4014: note = derived and/or modified CDS sequence (opt1) from TOSV(SI-51903)__EU003178.1__GP
  source 1..4014: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgagtgcaagcgggacatcatgagcaactacgtggccgaggtgcactccaacctccacggcctgggcgccatgatgcacaactacggggacgacaagcgcatcgaggtcctgaacgacgtgatccccgacgagctcaacccgggccggcacaactgcagcgacctggaccgcaagcccttctggaccgagttcatcaacgtggccaagcccgccaacgagatcgcgcccatgtccgtcatcccgccgcccatcgtgaagcccatccccgtggccgagagcaccaccaagaagacgatccccttcgacaagctgctctccgaggccgagaaggagctgaaccagaccaagatccggctggagaccgagcgccggagcaacgccgaggaggcggccaaggagcgcgcccggatgcgcgagatcgaggacaagctccggaaggactgggagctggagcgcgagaagaaggacgccgtcgccgaggacctggcgaaggagatcgcccggcgccgggagatcgagcgcaaggcccacgagctcgacaagatgctgaagaagaaggagcgggaggacctggtggcccgcgagcgggtggacgaggacatgcgcaaccacgtccgccggcccaacgccaccatcgcgcccacgatcatcaccaccctcctgatggcctccgccgtgatggccgggccgctggagaaccgcgagaccaaccacctcctgaaccggcccggcaacggggcctacacgctgagcgacttcgcggagtccacgtgcaccctcgcctacggcagcgagtgcaagagctgggagcaccagctggacgagctgtccttccccttcttccacagcaacctcgacaagtactccatgctggaggccgccaccgagaccatccccatcctgaacaagagctccgccgtgtgcaccatcagcccgtccacccacagctccaacgcgtgcggccgcgaggccagcctcatcaagaagaagtgcgggtccgacatgagcgccttcttctacgtcaacctggccggccagatcaccgtggtgaagtgcgacacgaaccacgtcctgtccaacgactgcgggaactgcatcagcaagaccctctccggccagaagatctacacccccgtgcaggacatgttctgccagaagggctggagcgagtccatccccagcacccggtactccaaggacctgtgcagcatcgggctgcacacggtgaaggagtgcaagatcggcaccaccaacttcgagcgcgtcgggttcatcgtggtgaagggccggaagatgtacatcgagcagatgaagatgcgcagccggcaggagttctccgaggacgagttcctctgctacaagagcgaggggtccagcggctccagcgtcaagctgaagaaggtgaaggtcgagtcctgcaagggcgtgaccacgagctccgcgagcaagtgctccggggacgagtacttctgcagccgctacccctgcgagaccgccaacgtggaggcccactgcatcctgcggcgccactccgccgtcatcgaggtgaacgtgaacggcgtctgggtggtgccgcggtgcatcgggtacgaggaggtcctcgtgcgccggaccagcctgaaggtggaggacacctccagccgcgagtgcgacacgtgcctgtgggagtgcggcaagaacaagctcatcgtcaagacccacgggcccaagatcgtgtacgccaccgcgtgctcccacggcagctgcaagagcgtgatgcagaagcccgccaccttcgtctacctgccctacccgggcaactccgagatcgtcgggggcgacatcggggtgcacatgaccgaggagagctcccccagcaacatccacatggtggcccactgccccgccaaggactcctgcgaggtgagctcctgcctgttctgcgtgcacggcctgctcaactaccagtgccacacgctgttcagcgccctgctcatctccaccaccgtcatgagcatcctgaccctgctcctgctgctcgtgaagggggcgaaggacctggtgaagcggctgttctactggctcatcacgcccctgtgctggctgtccgtcttctgcggctggatgatccgcagctggaagaagcgggtgggctccgccatcagccgcaccaacgacaccatcgggtggcgcgacaactcccggcgcggccaggacgtggagcgggcccagtacaccgggggcgccccgggcgccaagtacagcttctacggggtcatgatcctcggcctgctggggaacgtgcactcctgcagcgagtccatcatcgcggacagcaagatcatgcagtgcacgaccagcggctccagcaccctctgcaaggcctccgggaccgtgatcatgaagctgggccccatcggcagcgagtcctgcctgatcctcaaggggctgaaggacagcgagaagcagttcatctccatcaagacgatcagctccgagctgacctgccgcgagggcgagagcttctggaccaccctctacacgcccgtctgcctgtccagccggcgctgccacctgatgggggagtgcgtgtccgaccggtgcctccgctggaagaccaacgagaccagcgccgagttcaccggcaaggcccacggggaggtgatgcacgagaaccggtgcttcgagcagtccggcggcatcgggtacggctgcttcaacgtcaacccgagctgcctgtacgtgcactcctacctcaagagcgtgtacaagaacgggttcaagatcttccgctgcgtcgcgtggaaccaccggatccgcctggaggtgacgacccactcccggaagttccccatggtgctgatggccatgagcacccagcccaccgactggggcagcatcgggctgatcctcgactccggcggcatcacggggaccaacgcctacagcttcatgaagcacggcctggggtccttcgccatcatcgacgacccctacagcccggagccccgcaagggcttcctgggggaggtccggtgccccaccgaggagaccgccatccgcgcgtcccccagctgcaagatggccccgaacctcatcgagtaccagcccgagatggacacggccgagtgcaccaccaacatgatcgaccccatggccatcttcaaccggggctccctgccccaggtgcgcgacggcatgaccttcacgcagagcatcgagaagaacaccgtgcaggccctgaccaccggggaggtccgggcgtccatccgcctcacgctggacgactacgacgtggtgtaccagaacagccagttcgactgctccgccaccttcaagaacctgaccggctgctacagctgcgacgaggggccgcggatgtgctaccaggtcaaggccgagggcgagaccatcttccacttcgtgaacgaggacgagtccatcaacgtgatcaacaaggtcagccccgacgtgtccgactactgcaccgtgctccacttcagccgccccgtcatctccatcgagggccgctacgactgcgggctgagcaagcggcccatggtgatcaagggcacgctgatcgccaccgccccgcacgacgaccgcaagcacgagggcgggtccagcctcgtcgtgaaccccaagggcgggaccgtggacttcttcggctgggtcagcgggctgacctcctggctgggcgggcccctcaagacgttcctgaccatcctgggcttcctcgcgctggggctgctcctggtggtgatcatcatcatcatcgcccggaccggcgtcgagcaggccctgaagaagaagaacaagtga

SEQ ID NO: 13065 - RNA, 4014 nt, synthetic construct
  misc_feature 1..4014: note = derived and/or modified CDS sequence (opt1) from TOSV(SI-68809)__EU003179.1__GP
  source 1..4014: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgagtgcaagcgggacatcatgagcaactacgtggccgaggtgcactccaacctccacggcctgggcgccatgatgcacaactacggggacgacaagcgcatcgaggtcctgaacgacgtgatccccgacgagctcaacccgggccggcacaactgcagcgacctggaccgcaagcccttctggaccgagttcatcgacgtggccaagcccgccaacgagatcgcgcccatgtccgtcatcccgccgcccatcgtgaagcccatccccgtggccgagagcaccatcaagaagaccatccccttcgacaagctgctctccgaggccgaggaggagctgaaccagacgaagatccggctggagaccgagcgccggagcaacgccgaggaggcggccaaggagcgcgcccggatgcgcgagatcgaggacaagctccggaaggactgggagctggagcgcgagcggaaggacgccgtcgccgaggacctggcgaaggagatcgcccgccggcgcgagatcgagcggaaggcccacgagctcgacaagatgctgaagaagaaggagcgcgaggacctggtggcccgggagcgcgtgaacgaggacatgcgcaaccacgtccggcgccccaacaccaccatcgcccccacgatcatcaccaccctcctgatggcgtccgccgtgatggccgggccgctggagaaccgggagaccaaccacctcctgaaccgccccggcaacggggcctacacgctgagcgacttcgccgagtccacgtgcaccctcgcgtacggcagcgagtgcaagagctgggagcaccagctggacgagctgtccttccccttcttccacagcaacctcgacaagtactccatgctggaggccgccaccgagacgatccccatcctgaacaagagctccgccgtgtgcaccatcagcccgtccacccacagctccaacgcctgcggccgggaggcgagcctcatcaagaagaagtgcgggtccaacatgagcgccttcttctacgtcaacctggccggccagatcaccgtggtgaagtgcgacacgaaccacgtcctgtccaacgactgcgggaactgcatcagcaagaccctctccggccagaagatctacacccccgtgcaggacatgttctgccagaagggctggagcgagtccatccccagcacccgctactccaaggacctgtgcagcatcgggctgcacacggtgaaggagtgcaagaccggcaccaccaacttcgagcgggtcgggttcatcgtggtgaagggccgcaagatgtacatcgagcagatgaagatgcggagccgccaggagttctccgaggaccagttcctctgctacaagagcgaggggtccagcggctccagcgtcaagctgaagaaggtgaaggtcgagtcctgcaagggcgtgacgaccagctccgccagcaagtgctccggggacgagtacttctgcagccggtacccctgcgagaccgcgaacgtggaggcccactgcatcctgcgccggcactccgccgtcatcgaggtgaacgtgaacggcgtctgggtggtgccgcgctgcatcgggtacgaggaggtcctcgtgcggcgcaccagcctgaaggtggaggacacgtccagccgggagtgcgacacgtgcctgtgggagtgcggcaagaacaagctcatcgtcaagacccacgggcccaagatcgtgtacgccaccgcctgctcccacggcagctgcaagagcgtgatgcagaagcccgcgaccttcgtctacctgccctacccgggcaactccgagatcgtcgggggcgacatcggggtgcacatgaccgaggagagctcccccagcaacatccacatggtggcccactgccccgccaaggactcctgcgaggtgagctcctgcctgttctgcgtgcacggcctgctcaactaccagtgccacaccctgttcagcgccctgctcatctccaccaccgtcatgagcatcctgacgctgctcctgctgctcgtgaagggggccaaggacctggtgaagcgcctgttctactggctcatcacgcccctgtgctggctgtccgtcttctgcggctggatgatccggagctggaagcgccgcgtgggctccgcgatcagccggaccaacgacaccatcgggtggcgcgacaactcccggcgcggccaggacgtggagcgggcccagtacaccgggggcgccccgggcgccaagtacagcttctacggggtcatgatcctcggcctgctgggggaggtgcactcctgcagcgagtccatcatcgccgacagcaagatcatgcagtgcaccaccagcggctccagcaccctctgcaaggcgtccgggaccgtgatcatgaagctgggccccatcggcagcgagtcctgcctgatcctcaaggggctgaaggacagcgagaagcagttcatctccatcaagaccatcagctccgagctgacctgccgcgagggcgagagcttctggaccacgctctacacccccgtctgcctgtccagccggcgctgccacctgatgggggagtgcgtgtccgaccggtgcctcaagtggaagaccaacgagaccagcgccgagttcacgggcaaggcccacggggaggtgatgcacgagaaccgctgcttcgagcagtccggcggcatcgggtacggctgcttcaacgtcaacccgagctgcctgtacgtgcactcctacctcaagagcgtgtacaagaacgggttcaagatcttccggtgcgtcgcctggaaccaccgcatccggctggaggtgaccacccactcccgcaagttccccatggtgctgatggcgatgagcacccagcccacggactggggcagcatcgggctgatcctcgactccggcggcatcaccgggaccaacgcctacagcttcatgaagcacggcctggggtccttcgccatcatcgacgacccctacagcccggagccccggaagggcttcctgggggaggtccgctgccccaccgaggagacggccatccgggcctcccccagctgcaagatggcgccgaacctcatcgagtaccagcccgagatggacaccgccgagtgcaccaccaacatgatcgaccccatggccatcttcaaccgcggctccctgccccaggtgcgggacggcatgacgttcacccagagcatcgagaagaacaccgtgcaggccctgaccacgggggaggtccgcgcctccatccggctcaccctggacgactacgacgtggtgtaccagaacagccagttcgactgctccgcgaccttcaagaacctgaccggctgctacagctgcgacgaggggtcccgcatgtgctaccaggtcaaggccgagggcgagaccatcttccacttcgtgaacgaggacgagagcatcaacgtgatcaacaaggtctccccggacgtgagcgactactgcacggtgctccacttctcccgccccgtcatcagcatcgagggccggtacgactgcgggctgtccaagcgccccatggtgatcaagggcaccctgatcgccaccgcgccccacgacgaccggaagcacgagggcgggagcagcctcgtcgtgaacccgaagggcgggaccgtggacttcttcggctgggtctccgggctgacgagctggctgggcgggcccctcaagaccttcctgaccatcctgggcttcctcgccctggggctgctcctggtggtgatcatcatcatcatcgcccgcaccggcgtcgagcaggccctgaagaagaagaacaagtga

SEQ ID NO: 13066 - RNA, 4014 nt, synthetic construct
  misc_feature 1..4014: note = derived and/or modified CDS sequence (opt1) from TOSV(SI-76082)__EU003180.1__GP
  source 1..4014: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgagtgcaagcgggacatcatgagcaactacgtggccgaggtgcactccaacctccacggcctgggcgccatgatgcacaactacggggacgacaagcgcatcgaggtcctgaacgacgtgatccccgacgagctcaacccgggccggcacaactgcagcgacctggaccgcaagcccttctggaccgagttcatcaacgtggccaagcccgccaacgagatggcgcccatgtccgtcatcccgccgcccatcgtgaagcccatccccgtggccgagagcaccaccaagaagacgatccccttcgacgagctgctctccgaggccgagaaggagctgaaccagaccaagatccggctggagaccgagcgccggagcaacgccgaggaggcggccaaggagcgcgcccggatgcgcgagatcgaggacaagctccggaaggactgggagctggagcgcgagcggaaggacgccgtcgccgaggacctggcgaaggagatcgcccgccggcgcgagatcgagcggaaggcccacgagctcgacaagatgctgaagaagaaggagcgcgaggacctggtggcccgggagcgcgtggacgaggacatgcgcaaccacgtccggcgccccaacaccacgatcgcccccaccatcatcaccaccctcctgatggcgtccgccgtgatggccgggccgctggagaaccgggagacgaaccacctcctgaaccgccccggcaacggggcctacaccctgagcgacttcgccgagtccacgtgcaccctcgcgtacggcagcgagtgcaagagctgggagcaccagctggacgagctgtccttccccttcttccacagcaacctcgacaagtactccatgctggaggccgccacggagaccatccccatcctgaacaagagctccgccgtgtgcaccatcagcccgtccacccacagctccaacgcctgcggccgggaggcgagcctcatcaagaagaagtgcgggtccgacatgagcgccttcttctacgtcaacctggccggccagatcacggtggtgaagtgcgacaccaaccacgtcctgtccaacgactgcgggaactgcatcagcaagaccctctccggccagaagatctacacccccgtgcaggacatgttctgccagaagggctggagcgagtccatccccagcacgcgctactccaaggacctgtgcagcatcgggctgcacaccgtgaaggagtgcaagatcggcaccaccaacttcgagcgggtcgggttcatcgtggtgaagggccgcaagatgtacatcgagcagatgaagatgcggagccgccaggagttctccgaggaccagttcctctgctacaagagcgaggggtccagcggctccagcgtcaagctgaagaaggtgaaggtcgagtcctgcaagggcgtgacgaccagctccgccagcaagtgctccggggacgagtacttctgcagccggtacccctgcgagaccgcgaacgtggaggcccactgcatcctgcgccggcactccgccgtcatcgaggtgaacgtgaacggcgtctgggtggtgccgcgctgcatcgggtacgaggaggtcctcgtgcggcgcaccagcctgaaggtggaggacacgtccagccgggagtgcgacacgtgcctgtgggagtgcggcaagaacaagctcatcgtcaagacccacgggcccaagatcgtgtacgccaccgcctgctcccacggcagctgcaagagcgtgatgcagaagcccgcgaccttcgtctacctgccctacccgggcaactccgagatcgtcgggggcgacatcggggtgcacatgaccgaggagagctcccccagcaacatccacatggtggcccactgccccgccaaggactcctgcgaggtgagctcctgcctgttctgcgtgcacggcctgctcaactaccagtgccacaccctgttcagcgccctgctcatctccaccaccgtcatgagcatcctgacgctgctcctgctgctcgtgaagggggccaaggacctggtgaagcgcctgttctactggctcatgacgcccctgtgctggctgtccgtcttctgcggctggatgatccggagctggaagaagcgcgtgggctccgcgatcagccgcaccaacgacaccatcgggtggcgggacaactcccgccggggccaggacgtggagcgcgcccagtacaccgggggcgccccgggcgccaagtacagcttctacggggtcatgatcctcggcctgctggggaacgtgcactcctgcagcgagtccatcatcgccgacagcaagatcatgcagtgcaccaccagcggctccagcaccctctgcaaggcgtccgggaccgtgatcatgaagctgggccccatcggcagcgagtcctgcctgatcctcaaggggctgaaggacagcgagaagcagttcatctccatcaagaccatcagctccgagctgacctgccgggagggcgagagcttctggaccacgctctacacccccgtctgcctgtccagccgccggtgccacctgatgggggagtgcgtgtccgaccgctgcctccggtggaagaccaacgagaccagcgccgagttcacgggcaaggcccacggggaggtgatgcacgagaaccgctgcttcgagcagtccggcggcatcgggtacggctgcttcaacgtcaacccgagctgcctgtacgtgcactcctacctcaagagcgtgtacaagaacgggttcaagatcttccggtgcgtcgcctggaaccaccgcatccggctggaggtgaccacccactcccgcaagttccccatggtgctgatggcgatgagcacccagcccacggactggggcagcatcgggctgatcctcgactccggcggcatcaccgggaccaacgcctacagcttcatgaagcacggcctggggtccttcgccatcatcgacgacccctacagcccggagccccggaagggcttcctgggggaggtccgctgccccaccgaggagacggccatccgggcctcccccagctgcaagatggcgccgaacctcatcgagtaccagcccgagatggacaccgccgagtgcaccaccaacatgatcgaccccatggccatcttcaaccgcggctccctgccccaggtgcgggacggcatgacgttcacccagagcatcgagaagaacaccgtgcaggccctgaccacgggggaggtccgcgcctccatccggctcaccctggacgactacgacgtggtgtaccagaacagccagttcgactgctccgcgaccttcaagaacctgaccggctgctacagctgcgacgaggggtcccgcatgtgctaccaggtcaaggccgagggcgagaccatcttccacttcgtgaacgaggacgagagcatcaacgtgatcaacaaggtctccccggacgtgagcgactactgcacggtgctccacttctcccgccccgtcatcagcatcgagggccggtacgactgcgggctgtccaagcgccccatggtgatcaagggcaccctgatcgccaccgcgccccacgacgaccggaagcacgagggcgggagcagcctcgtcgtgaacccgaagggcgggaccgtggacttcttcggctgggtctccgggctgacgagctggctgggcgggcccctcaagaccttcctgaccatcctgggcttcctcgccctggggctgctcctggtggtgatcatcatcatcatcgcccgcaccggcgtcgagcaggccctgaagaagaagaacaagtga

SEQ ID NO: 13067 - RNA, 4020 nt, synthetic construct
  misc_feature 1..4020: note = derived and/or modified CDS sequence (opt1) from TOSV(TOSV/Mantova.ITA/2013)__KM507329.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgactgcaagcgggacatcatgagcaactacgtggccgaggtgcactccaacctccacggcctgggcgccatgatgcacaactacggggacgacaagcgcgtcgaggtgctgaacgacgtgatccccgacgagctcaacccgggccggcacaactgcagcgacctggaccgcaagcccttctggaccgagttcatcaacgtcgccaagcccgccaacaagatcgcgcccatctccgtgatcccgccgcccatcgtgaagcccatccccatcgccgagagcaccatcaaggagaccatccccttcgagaagctgctctccgaggccgagaaggagctgaaccagacgaagatccggctggagaccgagcgccggagcaacgccgaggaggcggcccgcgagcgggcccgcgtccgggagatcgaggacaagctccgcaagaactgggagctggagcgggagcgcaaggacgccgtggccgacgacctggcgaaggagatcgcccggcgccgggagatcgagcgcaaggcccacgagctcgacaagatgctgaagaagaaggagcgggaggaccaggtggccatcgagcgcgtctccgaggacatgcgcaaccacgtgcggcgccccaacaccaccatcgcccccgcgccgacgatcatcaccaccctgctcatggccagcgccgtgatggccgggcccctggagaaccgggagaccaaccacctcctgaaccgccccggcaacggggcctacacgctgtccgacttcgcggagagcacgtgcaccctggcctacggcagcgagtgcaagtcctgggagcaccagctcgacgagctgagcttccccttcttccactccaacctggacaagtacagcatgctcgaggccgccaccgagaccatcccgatcctgaacaagtccagcgccgtctgcaccatctcccccagcacccactccagcaacgcgtgcggccgggaggcctccctgatcaagaagaagtgcgggaacaacatgagcgccttcttctacgtgaacctcgccggccagatcaccgtggtcaagtgcgacacgaaccacgtgctgtccaacgactgcgggaactgcttcagcaagaccctgtccggccagaagatctacacccccgtgcaggacatgttctgccagcgcggctggaccgagagcatcccctccacgcggtacagcaaggacctctgctccatcgggctgcacaccgtcaaggagtgcaagaccggcaccacgaacttcgagcgcgtggggttcatcgtggtcaagagccggaagatgtacatcgagcagatgaagatgcgcagccggcaggagttctccgaggaccagttcctgtgctacaagagcgagtccagctccggcagctccgtgaagctcaagaaggtcaaggtggagagctgcaagggggtgaccacctccagcgcgtccaagtgcagcggcgacgagtacttctgctcccgctacccgtgcgagaccgccaacgtcgaggcccactgcatcctgcggcgccacagcgccgtgatcgaggtgaacgtcaacggcgtgtgggtggtcccccggtgcatcgggtacgaggaggtgctggtgcgccggacgtccctcaagatggaggacaccagctcccgcgagtgcgacacgtgcctgtgggagtgcggcaagaacaagctgatcgtcaagacccacgggcccaagatcgtgtacgccaccgcgtgcagccacggcagctgcaagtccgtgatgcagaagcccgccaccttcgtctacctcccgtaccccgggaacagcgagatcgtgggcggcgacatcggggtgcacatgaccgaggagtccagcccctccaacatccacatggtcgcccactgccccgccaaggacagctgcgaggtgtccagctgcctgttctgcgtgcacggcctgctgaactaccagtgccacaccctcttctccgccctgctgatcagcaccacggtcatgtccatcctcaccctgctgctcctgctggtgaagggggcgaaggacctcgtgaagaagctgttctactggctgatcaccccgctctgctggctgagcgtcttctgcggctggatgatcaagtcctggaagaagcgggtggggagcgccatctcccgcaccaacgacacgatcggctggcgcgacaaccggcgctacggccgggacgtggagcgcgcccagtacaccgggggcgcccccggggccaagtacagcttctacggcgtcatgatcctgggcctcctggggaacgtgcactcctgcagcgagtccgtgatcgcggacagcaaggtcatgcagtgcaccaccagcggctccagcacgctgtgcaaggcctccgggaccgtgatcatgaagctcggccccatcgggagcgagtcctgcctgatcctgaagggcctcaaggacaacgagaagcagttcatcagcatcaagaccatctccagcgagctgacctgccgggagggcgagtccttctggacgaccctgtacaccccggtgtgcctcagctcccgccggtgccacctgatgggggagtgcgtcagcgaccgctgcctgaagtggaagaccaacgagacgtccgccgagttcaccggcaaggcccacggggaggtgatgcacgagaaccggtgcttcgagcagagcggcgggatcggctacggctgcttcaacgtgaacccctcctgcctctacgtccacagctacctgaagtccgtgtacaagaacgggttcaagatcttccgctgcgtggcgtggaaccaccggatccgcctggaggtcaccacccacagccggaagttccccatggtgctcatggccatgtccacgcagcccaccgactggggcagcatcgggctgatcctggacagcgagggcatcaccgggaccaacgcctactccttcatgaagcacggcagcggctccttcgccatcatcgacgacccgtacagccccgagccccgcaaggggttcctcggcgaggtgcggtgccccacggaggagaccgccatccgcgcgtccccgagctgcaagatggcccccaacctgatcgagtaccagcccgagatggacaccgccgagtgcaccacgaacatgatcgaccccatggccatcttcaaccgggggtccctgccgcaggtccgcgacggcatgaccttcacccagagcatcgagaagaacaccgtgcaggccctcacgaccggggaggtgcgggcgtccatccgcctgaccctggacgactacgacgtcgtgtaccagaacagccagtccgactgcagcgccaccttcaagaacctcaccggctgctactcctgcgacgagggcagccggatgtgctaccaggtgaaggccgagggggagacgatcttccacttcgtcaacgaggacgagtccatcaacgtgatcaacaaggtgagccccgacgtctccgactactgcaccgtgctgcacttcagccgccccgtcatctccatcgagggccgctacgactgcgggctgagcaagcggcccatggtgatcaagggcaccctcatcgccaccgccccgcacgacgaccgcaagcacgagggcgggagctccctggtggtcaaccccaagggcgggacggtggacttcttcggctgggtgagcgggctgacctcctggctcggcggccccctgaagaccttcctgaccatcctcgggttcctggcgctgggcctcctgctggtcgtgatcatcatcatcatcgcccggacgggggtgcagcaggccctcaagaagaagaacaagtga

SEQ ID NO: 13068 - RNA, 4020 nt, synthetic construct
  misc_feature 1..4020: note = derived and/or modified CDS sequence (opt1) from TOSV(TOSV/Phl.233/FR/2009)__HQ184337.1__GP
  source 1..4020: mol_type = other RNA
atgttcatcgccaagctgctcctgatcagctgcctggtgcagcaggcctacctcaagtacaccatcatctccgagaccggcaacgggacgcgcaccagcttctgctactccagccggacctccctgggcagcctgctcgaggcgtgggacaacgtcaccgagtccatcgggctgacgagcgggacctgcaaggtgggctccctggagaaccgcgactgccggaaggacatcatgagcaactacgtggccgaggtccactccaacctccacggcctgggcgccatgatgcacaactacggggacgacaagcgcgtggagatcctgaacgacgtgatccccgacgagctcaacccgggccaccacaactgcagcgacctggaccggaagcccttctggaccgagttcatcaacgtcgccaagcccctgtccgagatcgtgcccatgagcgtgatcccgccgcccgtcgtgaagccccagccgcccgccgagccctccagcaagaagcacgtgcccttcgacgtcctcctgtccgaggcggagaaggagctgaaccagaccaagatccgcctcgaggacgagcgcaagagcaacgccgaggagacggccaaggagcgggcccggatgaaggagatcgaggacgagctgcgccgggagtgggagctggagcgcaagcggaaggacgcgatggccgacgacctcgccaaggagaccgcccgccggcgcgagatcgagcggaaggcccacgagctggacaagatgctgaagaagaaggagcgcgagtccctcatcgcgaaggagaaggccgacgaggacatgcggagccacgtgcacaagcccaacaccacccgcgcccccgcccccacgatcatcaccaccctgctgatggccagcgcggccctcgccgggcccctggagaaccgggagaccaaccacctcctgaaccgcccgggcaacggggcctacacgctgtccgacttcgccgagagcacgtgcaccctggcgtacggctccgagtgcaagagctgggagcacctcctgaacgaggagctgttccccttcttccactccaacctcgacaagtacagcatgctggaggccgccaccgagacggtgcccatcctgaacaagtccagcgccgtctgcaccatctcccccagcacccactccagcaacgcctgcggccgcgaggcgtccgtgatccggaagaagtgctacagcaacatgtccgccttcttctacatcaacctcgccgggcagatcaccgtgatcaagtgcgagacgaaccacgtcctgagctccgactgcggcaactgcatcagcaagtccctgagcgggcagaaggtgtacaccccggtgcaggacgtcttctgccagaagggctggacccagagcatcccctccacccgctacagcaaggacatctgctccatcggcctccacacggtgaaggagtgcaagatcgggaccaccagcttcgagcgggtgggcttcatcgtcgtgaaggggcgcaagatgtacatcgagcagatgaagatgcggtcccgccaggagtacagcgaggaccagttcctgtgctacaagtccgagagcggctccgggagctccgtcaagctgaagaagttcaaggtgcagagctgcaagggcgtgaccacgtccagcgcctccaagtgcagcggcgacgagtacttctgctcccggtacccctgcgagaccgcgaacgtcgaggcccactgcatcctccgccggcacagcgccatcgtggaggtgaacgtcaacggggtgtgggtggtcccccgctgcatcggctacgaggaggtgctggtgaagcggaccagcctgaaggtcgaggacaccacggggcgcgagtgcgactcctgcctctgggagtgcggcaagaacaagctgatcgtgaagacccacgggccgaaggtggtctacgccaccgcctgcagccacggctcctgcaagagcgtgatgcagaagcccgcgaccttcgtgtacctgccctaccccggcaactccgagatcgtcgggggcgacatcgggatccacatgaccgaggagagctccccgagcaacatccacctggtggcccactgccccgcccgggactcctgcgacgtgagcgactgcctcttctgcgtccacggcctgctgaactaccagtgccacaccctcttctccgccctgctgatcagcaccaccgtgatgtccatcctcaccctgctgctcctgctggtgaagggggccaaggacctcgtcaagaagctgttccactggctgatcacgcccctctgctggctgagcgtgttctgctgctgggtggtcaagtcctggaagcgccgggtgggcagcgcgatctcccgcaccaacgacaccatcggctggcgggagaaccgccggcacgcccaggacatcgagcgcgcccagtacaccgggggcgccccgggggccaagtacagcttctacggcgtgatgatcctgggcctcctgtccagcgcgcagagctgctccgagagcgtcatcgccgactccaagatcatgcagtgcacgaccagcgggtccagcaccctgtgcaaggcctccggcaccgtgatcatgcgcctcgggcccatcggcagcgagtcctgcctgatcctgaaggggctcaaggacagcgagaagcagttcatctccatcaagacgatcagctccgagctgacctgccgggagggcgagagcttctggaccaccctgtacacgcccatctgcctctccagccgccggtgccacctgatgggcgagtgcgtgtccgaccgctgcctgaagtggaagaccaaccagaccagcgccgagttcaccgggaaggcgcacggcgacgtcatgcacgagaaccggtgcttcgagcagtccgggggcatcgggtacggctgcttcaacgtgaaccccagctgcctctacgtgcacagctacctgaagtccgtctaccgcaacggcttcaaggtgttccggtgcgtggcctggaaccaccgcatccggctggaggtcacgacccacagccgcaagttcccgatggtgctcatggccatgtccacccagcccaccgactgggggagcatcggcctgatcctggactccgaggggatcacgggcaccaacagctactccttcatgaagcacgggagcggctccttcgccatcatcgacgacccctacagccccgagccgcggaagggcttcctcggggaggtgcgctgccccaccgaggagaccgccatgcgggcgtcccccagctgcaagatggcccccaacctgatcgagtaccagccggagatggacacggccgagtgcaccaccaacatgatcgaccccatggccatcttcaaccgcggctccctgccccaggtccgggacgggatgaccttcacgcagagcatcgagaagaacaccgtgcaggccctcaccaccggcgaggtgaaggcgtccatccgcctgacgctggacgactacgacgtcgtgtaccagaacagccagtccgactgcagcgccaccttcaagaacctcaccgggtgctactcctgcgacgagggcagccggctgtgctaccaggtgaaggccgagggcgagaccatcttccacttcatcaacgaggaggagagcatcaacgtcatcaacaaggtgtcccccggggtgagcgactactgcaccgtcctgcacttctcccgcccggtgatcagcatcgagggcacgtacgactgcgggctctccaagcggcccatggtcatcaagggcaccctgatcgccaccgcgccccacgacgaccgcaagcacgagggcgggagctccctggtggtgaaccccaagggcgggagcgtcgacttcttcggctggctctccgggctgaccagctggctgggcggcccgctcaagacgttcctgaccatcctggggttcctcgccgtgggcctgctgctcgtggtcatcatcatcatcatcatccggaccgggatgcagcaggccctgaagaagaagatcaagtga

SEQ ID NO: 13069 - RNA, 4020 nt, synthetic construct
  misc_feature 1..4020: note = derived and/or modified CDS sequence (opt1) from TOSV(TOSV/Phl.51/FR/2009)__HQ184336.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacgtcaccgagtccatcgggctgaccagcggcacgtgcaaggtggggtccctggagaaccgcgactgccggaaggacatcatgagcaactacgtggccgaggtccactccaacctccacggcctgggcgccatgatgcacaactacggggacgacaagcgcgtggagatcctgaacgacgtgatccccgacgagctcaacccgggccaccacaactgcagcgacctggaccggaagcccttctggaccgagttcatcaacgtcgccaagcccctgtccgagatcgtgcccatgagcgtgatcccgccgcccgtcgtgaagctccagccgcccgccgagccctccagcaagaagcacgtgcccttcgacgtcctgctgtccgaggcggagaaggagctcaaccagaccaagatccgcctggaggacgagcgcaagagcaacgccgaggagaccgccaaggagcgggcccggatgaaggagatcgaggacgagctgcgccgggagtgggagctcgagcgcaagcggaaggacgcgatggccgacgacctggccaaggagacggcccgccggcgcgagatcgaccggaaggcccacgagctggaccgcatgctcaagaagaaggagcgggagtccctgatcgcgaaggagaaggccgacgagaacatgcgcagccacgtgcacgagcccaacaccacccgggcccccgcccccaccatcatcacgaccctgctcatggccagcgcggccctggccgggcccctggagaaccgcgagaccaaccacctcctgaaccgccccggcaacggggcctacaccctgtccgacttcgccgagagcacgtgcaccctcgcgtacggctccgagtgcaagagctgggagcacctcctgaacgaggagctgttcccgttcttccactccaacctggacaagtacagcatgctggaggccgccaccgagaccgtgcccatcctcaacaagtccagcgccgtctgcacgatctcccccagcacccactccagcaacgcctgcggccgggaggcgtccgtgatccgcaagaagtgctacagcaacatgtccgccttcttctacatcaacctggccgggcagatcaccgtggtcaagtgcgagaccaaccacgtgctgagctccgactgcggcaactgcatcagcaagtccctcagcgggcagaaggtgtacacgcccgtccaggacgtgttctgccagaagggctggacccagagcatcccgtccacccggtacagcaaggacatctgctccatcggcctgcacaccgtgaaggagtgcaagatcgggacgaccagcttcgagcgcgtcggcttcatcgtggtcaaggggcggaagatgtacatcgagcagatgaagatgcgctcccggcaggagtacagcgaggaccagttcctgtgctacaagtccgagagcggctccgggagctccgtgaagctcaagaagttcaaggtggagagctgcaagggcgtcaccacctccagcgcctccaagtgcagcggcgacgagtacttctgctcccgcttcccctgcgagacggcgaacgtggaggcccactgcatcctgcggcgccacagcgccatcgtggaggtcaacgtgaacggggtgtgggtcgtgccccggtgcatcggctacgaggaggtgctggtcaagcgcaccagcctcaaggtggaggacaccaccgagcgggagtgcgactcctgcctgtgggagtgcgggaagaacaagctgatcgtgaagacgcacggccccaaggtcgtgtacgccaccgcctgcagccacgggtcctgcaagagcgtgatgcagaagccggcgaccttcgtctacctgccctaccccggcaactccgagatcgtgggcggggacatcggcatccacatgaccgaggagagctcccccagcaacatccacctcgtggcccactgcccggcccgcgactcctgcgacgtcagcgactgcctgttctgcgtgcacgggctgctcaactaccagtgccacaccctgttctccgccctgctcatcagcacgaccgtgatgtccatcctgaccctgctcctgctgctcgtcaagggcgccaaggacctggtgaagaagctgttccactggctcatcacgcccctgtgctggctgagcgtgttctgctgctgggtcgtgaagtcctggaagcggcgcgtggggagcgcgatctcccggaccaacgacaccatcggctggcgcgagaaccggcgccacgcccaggacatcgagcgcgcccagtacaccggcggggcccccggcgccaagtacagcttcttcggggtcatgatcctcggcctgctgtccagcgcgcagagctgctccgagagcgtgatcgccgactccaagatcatgcagtgcaccacgagcggctccagcaccctctgcaaggcctccgggaccgtgatcatgcggctgggcccgatcgggagcgagtcctgcctgatcctcaagggcctgaaggacagcgagaagcagttcatctccatcaagaccatcagctccgagctgacgtgccgcgagggggagagcttctggaccaccctctacacccccatctgcctgtccagccggcgctgccacctgatgggcgagtgcgtctccgaccggtgcctcaagtggaagacgaaccagaccagcgccgagttcaccggcaaggcgcacggggacgtgatgcacgagaaccgctgcttcgagcagtccggcgggatcggctacgggtgcttcaacgtgaaccccagctgcctgtacgtccacagctacctgaagtccgtgtaccggaacggcttcaaggtgttccgctgcgtcgcctggaaccaccggatccgcctcgaggtgaccacgcacagccggaagttccccatggtgctgatggccatgtccacccagccgaccgactggggcagcatcgggctgatcctcgactccgagggcatcaccgggacgaacagctactccttcatgaagcacggcagcgggtccttcgccatcatcgacgacccctacagccccgagccccgcaagggcttcctgggcgaggtccggtgcccgaccgaggagaccgccatgcgcgcgtcccccagctgcaagatggcccccaacctggtggagtaccagcccgagatggacaccgccgagtgcacgaccaacatgatcgacccgatggccatcttcaaccgggggtccctcccccaggtgcgcgacggcatgaccttcacccagagcatcgagaagaacacggtccaggccctgaccaccggggaggtgaaggcgtccatccggctgaccctcgacgactacgacgtggtctaccagaacagccagtccgactgcagcgccacgttcaagaacctgaccggctgctactcctgcgacgaggggagccgcctgtgctaccaggtgaaggccgagggcgagaccatcttccacttcatcaacgaggaggagagcatcaacgtgatcaacaaggtcagcccccgggtgtccgactactgcaccgtcctccacttctcccgccccgtgatcagcatcgagggcacctacgactgcgggctgtccaagcggccgatggtgatcaagggcacgctgatcgccaccgcgccccacgacgaccgcaagcacgagggcgggagctccctcgtcgtgaaccccaagggcgggagcgtggacttcttcggctggctgtccgggctgaccagctggctcggcgggcccctgaagaccttcctgacgatcctcggcttcctggccgtcggcctgctcctggtggtgatcatcatcatcatcatccgcaccgggatgcagcaggccctgaagaagaagatcaagtga

SEQ ID NO: 13070 - RNA, 4020 nt, synthetic construct
  misc_feature 1..4020: note = derived and/or modified CDS sequence (opt1) from TOSV(11368)__KU925897.1__GP
  source 1..4020: mol_type = other RNA
atgttcatcgccaagctgctcctgatcagctgcctggtgcagcaggcctacctcaagtacaccatcatctccgagaccggcaacgggacgcgcaccagcttctgctactccagccggacctccctgggcagcctgctcgaggcgtgggacaacgtcaccgagtccatcgggctgacgagcgggacctgcaaggtgggctccctggagaaccgcgactgccggaaggacatcatgagcaactacgtggccgaggtccactccaacctccacggcctgggcgccatgatgcacaactacggggacgacaagcgcgtggagatcctgaacgacgtgatccccgacgagctcaacccgggccaccacaactgcagcgacctggaccggaagcccttctggaccgagttcatcaacgtcgccaagcccctgtccgagatggtgcccatgagcgtgatcccgccgcccgtcgtgaagctccagccgcccgccgagccctccagcaagaagcacgtgcccttcgacgtcctgctgtccgaggcggagaaggagctcaaccagaccaagatccgcctggaggacgagcgcaagagcaacacggaggagaccgccaaggagcgggcccggatgaaggagatcgaggacgagctgcgccgggagtgggagctcgagcgcaagcggaaggacgccatggcggacgacctggccaaggagaccgcccgccggcgcgagatcgagcggaaggcccacgagctggacaagatgctcaagaagaaggagcgcgagtccctgatcgccaaggagaaggcggacgaggacatgcggagccacgtgcacaagcccaacaccacgcgcgccctggcccccaccatcatcaccaccctcctgatggccagcgccgcgctggccgggcccctcgagaaccgggagacgaaccacctcctgaaccgccccggcaacggggcctacaccctctccgacttcgccgagagcacgtgcaccctggcctacggctccgagtgcaagagctgggagcacctcctcaacgaggagctgttccccttcttccactccaacctggacaagtacagcatgctcgaggcggccacggagaccgtgccgatcctgaacaagtccagcgccgtctgcaccatctcccccagcacccactccagcaacgcctgcggccgcgaggcctccgtgatccggaagaagtgctacagcaacatgtccgcgttcttctacatcaacctggccgggcagatcacggtgatcaagtgcgagaccaaccacgtcctcagctccgactgcggcaactgcatcagcaagtccctgagcgggcagaaggtgtacacccccgtgcaggacgtcttctgccagaagggctggacccagagcatcccctccacgcgctacagcaaggacatctgctccatcggcctgcacaccgtgaaggagtgcaagatcgggaccaccagcttcgagcgggtgggcttcatcgtcgtgaaggggcgcaagatgtacatcgagcagatgaagatgcggtcccgccaggagtacagcgaggaccagttcctctgctacaagtccgagagcggctccgggagctccgtcaagctgaagaagttcaaggtgcagagctgcaagggcgtgacgacctccagcgcctccaagtgcagcggcgacgagtacttctgctcccggtacccgtgcgagaccgccaacgtcgaggcgcactgcatcctgcgccggcacagcgccatcgtggaggtgaacgtcaacggggtgtgggtggtcccccgctgcatcggctacgaggaggtgctcgtgaagcggaccagcctgaaggtcgaggacacgaccgggcgcgagtgcgactcctgcctgtgggagtgcggcaagaacaagctgatcgtgaagacccacgggcccaaggtggtctacgccaccgcctgcagccacggctcctgcaagagcgtgatgcagaagcccgccaccttcgtgtacctcccgtaccccggcaactccgagatcgtcgggggcgacatcgggatccacatgacggaggagagctcccccagcaacatccacctggtggcgcactgccccgcccgggactcctgcgacgtgagcgactgcctgttctgcgtccacggcctcctgaactaccagtgccacaccctgttctccgccctcctgatcagcaccaccgtgatgtccatcctgacgctcctgctgctcctggtgaagggggccaaggacctggtcaagaagctgttccactggctgatcaccccgctgtgctggctcagcgtgttctgctgctgggtggtcaagtcctggaagcgccgggtgggcagcgccatctcccgcaccaacgacaccatcggctggcgggagaaccgccggcacgcgcaggacatcgagcgcgcccagtacaccgggggcgcccccggggccaagtacagcttctacggcgtgatgatcctgggcctgctctccagcgcccagagctgctccgagagcgtcatcgcggactccaagatcatgcagtgcaccaccagcgggtccagcaccctgtgcaaggcctccggcacggtgatcatgcgcctggggcccatcggcagcgagtcctgcctcatcctgaaggggctgaaggacagcgagaagcagttcatctccatcaagaccatcagctccgagctgacctgccgggagggcgagagcttctggaccacgctgtacaccccgatctgcctgtccagccgccggtgccacctcatgggcgagtgcgtgtccgaccgctgcctgaagtggaagaccaaccagaccagcgccgagttcacggggaaggcccacggcgacgtcatgcacgagaaccggtgcttcgagcagtccgggggcatcgggtacggctgcttcaacgtgaaccccagctgcctgtacgtgcacagctacctcaagtccgtctaccgcaacggcttcaaggtgttccggtgcgtggcgtggaaccaccgcatccggctggaggtcaccacccacagccgcaagttccccatggtgctgatggccatgtccacccagcccacggactgggggagcatcggcctcatcctggactccgaggggatcaccggcaccaacagctactccttcatgaagcacgggagcggctccttcgccatcatcgacgacccgtacagccccgagccccggaagggcttcctgggggaggtgcgctgccccaccgaggagacggccatgcgggcctccccgagctgcaagatggcgcccaacctcatcgagtaccagcccgagatggacaccgccgagtgcaccaccaacatgatcgaccccatggccatcttcaaccgcggctccctgccgcaggtccgggacgggatgacgttcacccagagcatcgagaagaacaccgtgcaggccctgaccacgggcgaggtgaaggcctccatccgcctcatcctggacgactacgacgtcgtgtaccagaacagccagtccgactgcagcgcgaccttcaagaacctgaccgggtgctactcctgcgacgagggcagccggctctgctaccaggtgaaggccgagggcgagaccatcttccacttcatcaacgaggaggagagcatcaacgtcatcaacaaggtgtcccccggggtgagcgactactgcaccgtcctgcacttctcccgccccgtgatcagcatcgagggcacgtacgactgcgggctgtccaagcggcccatggtcatcaagggcaccctcatcgccaccgccccgcacgacgaccgcaagcacgagggcgggagctccctggtggtgaaccccaagggcgggagcgtcgacttcttcggctggctgtccgggctcaccagctggctgggcggccccctgaagacgttcctcaccatcctggggttcctggccgtgggcctcctgctggtggtcatcatcatcatcatcatccggaccgggatgcagcaggcgctcaagaagaagatcaagtga

SEQ ID NO: 13071 - RNA, 4020 nt, synthetic construct
  misc_feature 1..4020: note = derived and/or modified CDS sequence (opt1) from TOSV(5904242804)__KU935737.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgactgcaagcgggacatcatgagcaactacgtggccgaggtgcactccaacctccacggcctgggcgccatgatgcacaactacggggacgacaagcgcgtcgaggtgctgaacgacgtgatccccgacgagctcaacccgggccggcacaactgcagcgacctggaccgcaagcccttctggaccgagttcatcgacgtcgccaagcccaccaacaagatcgcccccatgtccgtgatcccgccgcccatcgtgaagcccatcccggtcgcggagagcaccatcaagaagtccatccccttcgacaagctgctcagcgaggccgagaaggagctgaaccagacgaagatccggctggagaccgagcgccggtccaacgccgaggaggccgcgaaggagcgcgcccggatgcgcgagatcgaggacaagctccggaaggactgggagctggagcgcgagcggaaggacgccgtggccgacgacctggccaaggagatcgcgcgccggcgcgagatcgagcggaaggcccacgagctcgacaagatgctgaagaagaaggagcgcgaggacctggtggcccgggagcgcgtcagcgaggacatgcgcaaccacgtgcggaagcccaacaccaccatcgcccccgccccgacgatcatcaccaccctcctgatggcgtccgccgtgatggccgggcccctggagaaccgcgagaccaaccacctcctgaaccggcccggcaacggggcctacacgctgagcgacttcgccgagagcacgtgcaccctcgcgtacggctccgagtgcaagagctgggagcaccagctggacgagctgtccttccccttcttccacagcaacctcgacaagtactccatgctggaggccgccaccgagaccatcccgatcctgaacaagagctccgccgtctgcaccatcagcccctccacccacagctccaacgcctgcggccgcgaggcgagcctcatcaagaagaagtgcgggtccaacatgagcgccttcttctacgtgaacctggccggccagatcaccgtggtcaagtgcgacacgaaccacgtgctgtccaacgactgcgggaactgcatcagcaagaccctctccggccagaagatctacacccccgtgcaggacatgttctgccagaagggctggaccgagagcatccccaacacgcggtactccaaggacctgtgcagcatcgggctgcacaccgtcaaggagtgcaagaccggcaccacgaacttcgagcgcgtggggttcatcgtggtcgagggccggaagatgtacatcgagcagatgaagatgcgcagccggcaggagttctccgaggaccagttcctctgctacaagagcgagtccagctccgggagctccgtgaagctgaagaaggtcaaggtggagagctgcaagggcgtgaccacctccagcgcctccaagtgcagcggcgacgagtacttctgctcccgctacccgtgcgagaccgcgaacgtcgaggcccactgcatcctgcggcgccacagcgccgtgatcgaggtgaacgtcaacggggtgtggatcgtgccccggtgcatcggctacgaggaggtcctcgtgcgccggacgtccctgaaggtggaggacaccagctcccgcgagtgcgacacgtgcctgtgggagtgcgggaagaacaagctcatcgtcaagacccacggccccaagatcgtgtacgccaccgcctgcagccacgggagctgcaagtccgtgatgcagaagcccgcgaccttcgtctacctgccgtaccccggcaacagcgagatcgtgggcggggacatcggcgtgcacatgaccgaggagtccagcccctccaacatccacatggtcgcccactgccccgccaaggacagctgcgaggtgtccagctgcctgttctgcgtgcacgggctgctcaactaccagtgccacaccctgttctccgccctgctcatcagcaccacggtcatgtccatcctgaccctgctcctgctgctcgtgaagggcgccaaggacctggtgaagcggctgttctactggctcatcaccccgctgtgctggctgagcgtcttctgcgggtgggtgatcaagtcctggaagaagcgcgtgggcagcgcgatctcccggaccaacgacacgatcggctggcgcgacaaccgccggtaccgccaggacgtcgagcgggcccagtacaccgggggcgcccccggggccaagtacagcttctacggcgtgatggtgctcggcctgctggggaacgtccactcctgcagcgagtccatcatcgccgacagcaagatcatgcagtgcaccaccagcggctccagcacgctctgcaaggcgtccgggaccgtgatcatgaagctgggccccatcgggagcgagtcctgcctgatcctcaagggcctgaaggacagcgagaagcagttcatctccatcaagaccatcagctccgagctgacctgccgcgagggcgagagcttctggacgaccctctacaccccggtgtgcctgtccagccggcgctgccacctgatgggggagtgcgtctccgaccggtgcctcaagtggaagaccaacgagacgagcgccgagttcaccggcaaggcccacggggaggtggtgcacgagaaccgctgcttcgagcagtccggcgggatcggctacggctgcttcaacgtcaaccccagctgcctgtacgtgcactcctacctcaagagcgtgtacaagaacgggttcaagatcttccggtgcgtcgcctggaaccaccgcatccggctggaggtgaccacccactcccgcaagttccccatggtgctgatggcgatgagcacgcagcccaccgactggggcagcatcgggctgatcctcgactccgagggcatcaccgggaccaacgcctacagcttcatgaagcacggctccggcagcttcgccatcatcgacgacccgtactcccccgagccccggaaggggttcctgggcgaggtccgctgccccacggaggagaccgccatccgggccagcccgtcctgcaagatggcgcccaacctgatcgagtaccagcccgagatggacaccgccgagtgcaccacgaacatgatcgaccccatggccatcttcaaccgcgggagcctcccccaggtgcgggacggcatgaccttcacccagtccatcgagaagaacaccgtgcaggccctgacgaccggggaggtccgcgccagcatccggctgaccctcgacgactacgacgtggtgtaccagaactcccagagcgactgctccgcgaccttcaagaacctgaccggctgctacagctgcgacgagggctcccgcatgtgctaccaggtcaaggccgagggggagacgatcttccacttcatcaacgaggacgagagcatcaacgtgatcaacaaggtgaaccccgacgtctccgactactgcaccgtgctgcacttcagccggcccgtcatctccatcgagggccgctacgactgcgggctcagcaagcgccccatggtgatcaagggcaccctgatcgccaccgccccgcacgacgaccggaagcacgagggcgggagctccctgatcgtgaaccccaagggcgggacggtcgacttcttcggctgggtgagcgggctcacctcctggctgggcggccccctgaagaccttcctcaccatcctggggttcctggccctcggcctgctgctcgtggtcatcatcatcatcatcgcgcgcacgggggtgcagcaggccctgaagaagaagaacaagtga

SEQ ID NO: 13072 - RNA, 4020 nt, synthetic construct
  misc_feature 1..4020: note = derived and/or modified CDS sequence (opt1) from TOSV(5963930705)__KU935734.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacgtcaccgagtccatcgggctgaccagcggcacgtgcaaggtggggtccctggagaaccgcgactgccggaaggacatcatgagcaactacgtggccgaggtccactccaacctccacggcctgggcgccatgatgcacaactacggggacgacaagcgcgtggagatcctgaacgacgtgatccccgacgagctcaacccgggccaccacaactgcagcgacctggaccggaagcccttctggaccgagttcatcaacgtcgccaagcccctgggggagatcgtgcccatgtccgtgatcccgccgcccgtcgtgaagctccagccgcccgccgagcccagctccaagaagcacgtgcccttcgacgtcctgctgagcgaggcggagaaggagctcaaccagaccaagatccgcctggaggacgagcggaagtccaacgccgaggagaccgccaaggagcgcgcccggatgaaggagatcgaggaggagctgcgccgggagtgggagctcgagcgcaagcggaaggacgcgatggccgacgacctggccaaggagacggcccgccggcgcgagatcgagcggaaggcccacgagctggaccgcatgctcaagaagaaggagcgggagagcctgatcgcgaaggagaaggccgacgaggacatgcgctcccacgtgcacaagcccaacaccacccgggcccccgcccccaccatcatcacgaccctgctcatggccagcgcggccctggccggccccctggagaaccgcgagaccaaccacctcctgaaccgccccgggaacggcgcctacaccctgagcgacttcgccgagtccacgtgcaccctcgcgtacggcagcgagtgcaagtcctgggagcacctcctgaacgaggagctgttcccgttcttccacagcaacctggacaagtactccatgctggaggccgccaccgagaccgtgcccatcctcaacaagagctccgccgtctgcacgatcagcccctccacccacagctccaacgcctgcgggcgggaggcgagcgtgatccgcaagaagtgctactccaacatgagcgccttcttctacatcaacctggccggccagatcaccgtggtcaagtgcgagaccaaccacgtgctgtccagcgactgcgggaactgcatctccaagagcctctccggccagaaggtgtacacgcccgtccaggacgtgttctgccagaagggctggacccagagcatcccgagcacccggtactccaaggacatctgcagcatcgggctgcacaccgtgaaggagtgcaagatcggcacgacctccttcgagcgcgtcgggttcatcgtggtcaagggccggaagatgtacatcgagcagatgaagatgcgcagccggcaggagtactccgaggaccagttcctgtgctacaagagcgagtccgggagcggctccagcgtgaagctcaagaagttcaaggtggagtcctgcaagggcgtcaccaccagctccgccagcaagtgctccggggacgagtacttctgcagccgctacccctgcgaggcggccaacgtggaggcccactgcatcctgcggcgccactccgccatcgtggaggtcaacgtgaacggcgtgtgggtcgtgccccggtgcatcgggtacgaggaggtgctggtcaagcgcacgagcctcaaggtggaggacaccaccgagcgggagtgcgacagctgcctgtgggagtgcggcaagaacaagctgatcgtgaagacccacgggcccaaggtcgtgtacgccacggcgtgctcccacggcagctgcaagtccgtgatgcagaagccggccaccttcgtctacctgccctaccccggcaacagcgagatcgtcgggggcgacatcgggatccacatgaccgaggagtccagcccctccaacatccacctcgtggcccactgcccggcccgcgacagctgcgacgtgtccgactgcctgttctgcgtgcacggcctgctcaactaccagtgccacaccctgttcagcgccctgctcatctccaccacggtgatgagcatcctgaccctgctcctgctgctcgtcaagggggcgaaggacctggtgaagaagctgttccactggctcatcacgcccctgtgctggctgtccgtgttctgctgctggatggtcaagagctggaagcggcgcgtgggctccgccatcagccggaccaacgacaccatcggctggcgcgagaaccggcgccacgcccaggacatcgagcgcgcccagcacaccgggggcgcccccggggcgaagtactccttctacggcgtgatgatcctcggcctgctgagctccgcccagagctgcagcgagtccgtcatcgccgacagcaagatcatgcagtgcaccacctccgggagctccacgctctgcaaggccagcggcaccgtgatcatgcggctggggccgatcggctccgagagctgcctgatcctcaaggggctgaaggactccgagaagcagttcatcagcatcaagaccatctccagcgagctgacctgccgcgagggcgagtccttctggacgaccctctacacccccatctgcctgagctcccggcgctgccacctgatgggcgagtgcgtgagcgaccggtgcctcaagtggaagaccaaccagacgtccgcggagttcaccgggaaggcccacggcgacgtcatgcacgagaaccgctgcttcgagcagagcgggggcatcgggtacggctgcttcaacgtgaacccctcctgcctgtacgtgcacagctacctcaagagcgtctaccggaacggcttcaaggtgttccgctgcgtggcctggaaccaccggatccgcctggaggtcaccacccactcccggaagttccccatggtgctgatggccatgagcacgcagccgaccgactgggggtccatcggcctgatcctcgacagcgaggggatcaccggcaccaactcctacagcttcatgaagcacgggtccggcagcttcgccatcatcgacgacccctactcccccgagccccgcaagggcttcctgggggaggtgcggtgcccgacggaggagaccgcgatgcgcgccagcccctcctgcaagatggcccccaacctgatcgagtaccagcccgagatggacaccgccgagtgcaccacgaacatgatcgacccgatggccatcttcaaccggggcagcctcccccaggtccgcgacgggatgaccttcacccagtccatcgagaagaacaccgtgcaggcgctgacgaccggcgaggtgaaggccagcatccggctgaccctcgacgactacgacgtcgtgtaccagaactcccagagcgactgctccgccaccttcaagaacctgacggggtgctacagctgcgacgagggctcccgcctgtgctaccaggtgaaggccgagggcgagaccatcttccacttcatcaacgaggaggagagcatcaacgtcatcaacaaggtgagccccggggtgtccgactactgcaccgtcctccacttcagctcccccgtgatcagcatcgagggcacctacgactgcgggctgtccaagcggccgatggtcatcaagggcaccctgatcgccacggcgccccacgacgaccgcaagcacgagggcgggagctccctcgtggtgaaccccaagggcgggagcgtcgacttcttcggctggctgtccgggctgaccagctggctcggcggccccctgaagaccttcctgaccatcctcgggttcctggccgtgggcctgctcctggtggtcatcatcatcatcatcatccggacggggatgcagcaggccctgaagaagaagatcaagtga

SEQ ID NO: 13073 - RNA, 4020 nt, synthetic construct
  misc_feature 1..4020: note = derived and/or modified CDS sequence (opt1) from TOSV(H4906)__KU922125.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacgtcaccgagtccatcgggctgaccagcggcacgtgcaaggtggggtccctggagaaccgcgactgccggaaggacatcatgagcaactacgtggccgaggtccactccaacctccacggcctgggcgccatgatgcacaactacggggacgacaagcgcgtggagatcctgaacgacgtgatccccgacgagctcaacccgggccaccacaactgcagcgacctggaccggaagcccttctggaccgagttcatcaacgtcgccaagcccctgtccgagatcgtgcccatgagcgtgatcccgccgcccgtcgtgaagccccagccgcccgccgagccctccagcaagaagcacgtgcccttcgacgtcctcctgtccgaggcggagaaggagctgaaccagaccaagatccgcctcgaggacgagcgcaagagcaacgccgaggagaccgccaaggagcgggcccggatgaaggagatcgaggacgagctgcgccgggagtgggagctggagcgcaagcggaaggacgcgatggccgacgacctcgccaaggagacggcccgccggcgcgagatcgagcggaaggcccacgagctggaccgcatgctgaagaagaaggagcgggagtccctcatcgcgaaggagaaggccgacgaggacatgcgcagccacgtgcacaagcccaacaccacccgggcccccgcccccaccatcatcacgaccctgctgatggccagcgcggccctcgccgggcccctggagaaccgcgagaccaaccacctcctgaaccgcccgggcaacggggcctacaccctgtccgacttcgccgagagcacgtgcaccctggcgtacggctccgagtgcaagagctgggagcacctcctgaacgaggagctgttccccttcttccactccaacctcgacaagtacagcatgctggaggccgccaccgagaccgtgcccatcctgaacaagtccagcgccgtctgcacgatctcccccagcacccactccagcaacgcctgcggccgggaggcgtccgtgatccgcaagaagtgctacagcaacatgtccgccttcttctacatcaacctcgccgggcagatcaccgtggtcaagtgcgagaccaaccacgtgctgagctccgactgcggcaactgcatcagcaagtccctgagcgggcagaaggtgtacacgccggtccaggacgtgttctgccagaagggctggacccagagcatcccctccacccggtacagcaaggacatctgctccatcggcctccacaccgtgaaggagtgcaagatcgggacgaccagcttcgagcgcgtcggcttcatcgtggtcaaggggcggaagatgtacatcgagcagatgaagatgcgctcccggcaggagtacagcgaggaccagttcctgtgctacaagtccgagagcggctccgggagctccgtgaagctgaagaagttcaaggtggagagctgcaagggcgtcaccacctccagcgcctccaagtgcagcggcgacgagtacttctgctcccgcttcccctgcgagacggcgaacgtggaggcccactgcatcctccggcgccacagcgccatcgtggaggtcaacgtgaacggggtgtgggtcgtgccccggtgcatcggctacgaggaggtgctggtcaagcgcaccagcctgaaggtggaggacaccaccgagcgggagtgcgactcctgcctctgggagtgcgggaagaacaagctgatcgtgaagacgcacggcccgaaggtcgtgtacgccaccgcctgcagccacgggtcctgcaagagcgtgatgcagaagcccgcgaccttcgtctacctgccctaccccggcaactccgagatcgtgggcggggacatcggcatccacatgaccgaggagagctccccgagcaacatccacctggtggcccactgccccgcccgcgactcctgcgacgtcagcgactgcctcttctgcgtgcacgggctgctgaactaccagtgccacaccctcttctccgccctgctgatcagcacgaccgtgatgtccatcctcaccctgctgctcctgctggtcaagggcgccaaggacctcgtgaagaagctgttccactggctgatcacgcccctctgctggctgagcgtgttctgctgctgggtcgtgaagtcctggaagcggcgcgtggggagcgcgatctcccggaccaacgacaccatcggctggcgcgagaaccggcgccacgcccaggacatcgagcgcgcccagtacaccggcggggccccgggcgccaagtacagcttctacggggtcatgatcctgggcctcctgtccagcgcgcagagctgctccgagagcgtgatcgccgactccaagatcatgcagtgcaccacgagcggctccagcaccctgtgcaaggcctccgggaccgtgatcatgcggctcggccccatcgggagcgagtcctgcctgatcctgaagggcctcaaggacagcgagaagcagttcatctccatcaagaccatcagctccgagctgacgtgccgcgagggggagagcttctggaccaccctgtacacccccatctgcctctccagccggcgctgccacctgatgggcgagtgcgtctccgaccggtgcctgaagtggaagacgaaccagaccagcgccgagttcaccggcaaggcgcacggggacgtgatgcacgagaaccgctgcttcgagcagtccggcgggatcggctacgggtgcttcaacgtgaaccccagctgcctctacgtccacagctacctgaagtccgtgtaccggaacggcttcaaggtgttccgctgcgtcgcctggaaccaccggatccgcctggagatgaccacgcacagccggaagttcccgatggtgctcatggccatgtccacccagcccaccgactggggcagcatcgggctgatcctggactccgagggcatcaccgggacgaacagctactccttcatgaagcacggcagcgggtccttcgccatcatcgacgacccctacagccccgagccgcgcaagggcttcctcggcgaggtgcggtgccccaccgaggagaccgccatgcgcgcgtcccccagctgcaagatggcccccaacctgatcgagtaccagccggagatggacaccgccgagtgcacgaccaacatgatcgaccccatggccatcttcaaccgggggtccctgccccaggtccgcgacggcatgaccttcacccagagcatcgagaagaacacggtgcaggccctcaccaccggggaggtgaaggcgtccatccggctgaccctggacgactacgacgtcgtgtaccagaacagccagtccgactgcagcgccacgttcaagaacctcaccggctgctactcctgcgacgaggggagccgcctgtgctaccaggtgaaggccgagggcgagaccatcttccacttcatcaacgaggaggagagcatcaacgtcatcaacaaggtgaaccccggcgtgtccgactactgcaccgtcctgcacttcagccggccggtgatctccatcgaggggacctacgactgcggcctcagcaagcgccccatggtcatcaaggggacgctgatcgccaccgcgccccacgacgaccggaagcacgagggcggctccagcctggtggtgaaccccaagggcgggtccgtcgacttcttcgggtggctcagcggcctgacctcctggctcgggggcccgctgaagaccttcctgacgatcctgggcttcctcgccgtggggctgctgctcgtggtcatcatcatcatcatcatccgcaccggcatgcagcaggccctgaagaagaagatcaagtga

SEQ ID NO: 13074 - RNA, 4020 nt, synthetic construct
  misc_feature 1..4020: note = derived and/or modified CDS sequence (opt1) from TOSV(MRS2010-4319501)__KC776215.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacgtcaccgagtccatcgggctgatcagcgggacctgcaaggtggggtccctggagaaccgcgactgccggaaggacatcatgagcaactacgtggccgaggtccactccaacctccacggcctgggcgccatgatgcacaactacgccgacgacaagcgcgtggagatcctgaacgacgtgatccccgacgagctcaacccggggcaccacaactgcagcgacctggaccggaagcccttctggacggagttcatcaacgtcgccaagcccctgtccgagatcgtgcccatgagcgtgatcccgccgcccgtcgtgaagctccagccgcccgcggagccctccagcaagaagcacgtgcccttcgacgtcctgctgtccgaggccgagaaggagctcaaccagaccaagatccgcctggaggacgagcgcaagagcaacgccgaggagaccgccaaggagcgggcgcggatgaaggagatcgaggacgagctgcgccgggagtgggagctcgagcgcaagcggaaggacgccatggccgacgacctggccaaggagaccgcccgccggcgcgagatcgagcggaaggcgcacgagctggaccgcatgctcaagaagaaggagcgggagtccctgatcgccaaggagaaggccgacgaggacatgcgcagccacgtgtacaagcccaacacgacccgggcccccgcccccaccatcatcaccacgctgctcatggcgagcgccgccctggccggccccctggagaaccgcgagaccaaccacctcctgaaccgccccgggaacggcgcctacaccctgtccgacttcgcggagagcacgtgcaccctcgcctacgggtccgagtgcaagagctgggagcacctcctgaacgaggagctgttcccgttcttccactccaacctggacaagtacagcatgctggaggccgccaccgagaccgtgcccatcctcaacaagtccagcgccgtctgcaccatctcccccagcacgcactccagcaacgcgtgcggccgggaggcctccgtgatccgcaagaagtgctacagcaacatgtccgccttcttctacatcaacctggccggccagatcaccgtggtcaagtgcgagaccaaccacgtgctgagctccgactgcgggaactgcatcagcaagtccctcagcggccagaaggtgtacacccccgtccaggacgtgttctgccagaaggggtggacgcagagcatcccgtccaccaagtacagcaaggacatctgctccatcggcctgcacaccgtgaaggagtgcaagatcggcatcaccagcttcgagcgggtcgggttcatcgtggtcaagggccgcaagatgtacatcgagcagatgaagatgcggtcccgccaggagtacagcgaggaccagttcctgtgctacaagtccgagagctccagcgggtccagcgtgaagctcaagaagttcaaggtggagtcctgcaagggcgtcacgaccagctccgcgagcaagtgctccggggacgagtacttctgcagccggtacccctgcgagaccgccaacgtggaggcccactgcatcctgcgccggcacagcgccatcgtggaggtcaacgtgaacggcgtgtgggtcgtgccccgctgcatcggctacgaggaggtgctggtcaagcggacctccctcaaggtggaggacacgaccgggcgcgagtgcgacagctgcctgtgggagtgcggcaagaacaagctgatcgtgaagacccacgggcccaaggtcgtgtacgccaccgcgtgctcccacggcagctgcaagtccgtgatgcagaagccggccacgttcgtctacctgccctaccccgggaacagcgagatcgtgggcggcgacatcgggatccacatgaccgaggagtccagcccctccaacatccacctcgtggcccactgcccggcccgggacagctgcgacgtctccgactgcctgttctgcgtgcacggcctgctcaactaccagtgccacaccctgttcagcgccctgctcatctccaccaccgtgatgagcatcctgacgctgctcctgctgctcgtcaagggggcgaaggacctggtgaagaagctgttccactggctcatcacgcccctgtgctggctgtccgtgttctgctgctgggtcgtcaagagctggaagcgccgggtgggctccgccatcagccgcaccaacgacaccatcgggtggcgggagaaccgccggcacgcccaggacatcgagcgcgcccagtacaccggcggcgcccccggggcgaagtactccttctacggcgtgatgatcctcgggctgctgagcagcgcccagtcctgcagcgagtccgtgatcgccgacagcaagatcatgcagtgcaccacctccggcagctccaccctctgcaaggccagcggcacggtgatcatgcgcgtcgggccgatcggctccgagagctgcctgatcctgaaggggctcaaggactccgagaagcagttcatcagcatcaagaccatctccagcgagctgacctgccgggagggcgagtccttctggaccacgctgtacacccccatctgcctcagctcccgccggtgccacctgatgggggagtgcgtgagcgaccgctgcctgaagtggaagaccaaccagacctccgcggagttcacgggcaaggcccacggcgacgtgatgcacgagaaccggtgcttcgagcagagcgggggcatcgggtacggctgcttcaacgtcaaccccagctgcctctacgtgcactcctacctcaagagcgtgtaccgcaacgggttcaaggtcttccggtgcgtggcctggaaccaccgcatccggctggaggtgaccacccactcccgcaagttccccatggtcctgatggccatgagcacccagccgacggactggggctccatcggcctgatcctggacagcgagggggtgaccggcaccaactcctacagcttcatgaagcacgggtccggcagcttcgccatcatcgacgacccctactcccccgagccccggaaggggttcctcggcgaggtgcgctgcccgaccgaggagacggcgatgcgggccagcccctcctgcaagatggcccccaacctgatcgagtaccagcccgagatggacaccgccgagtgcaccaccaacatgatcgacccgatggccatcttcaaccgcggcagcctgccccaggtccgggacgggatgacgttcacccagtccatcgagaagaacaccgtgcaggcgctcaccacgggcgaggtgaaggccagcatccgcctgaccctggacgactacgacgtcgtgtaccagaactcccagagcgactgctccgccaccttcaagaacctcaccgggtgctacagctgcgacgagggcagccggctgtgctaccaggtgaaggccgagggggagacgatcttccacttcatcaacgaggaggagtccatcaacgtcatcaacaaggtgagccccggcgtctccgactactgcaccgtgctgcacttcagccgccccgtgatctccatcgagggcacctacgactgcgggctcagcaagcggccgatggtcatcaagggcaccctgatcgccaccgcgccccacgacgaccgcaagcacgagggcggctccagcctggtggtgaaccccaagggcgggtccgtcgacttcttcggctggctcagcgggctgacgtcctggctgggcgggcccctcaagaccttcctgaccatcctgggcttcctcgccgtgggcctgctgctcgtggtcatcatcatcatcatcatccggaccgggatgcagcaggccctgaagaagaagatcaagtga

SEQ ID NO: 13075 - RNA, 4020 nt, synthetic construct
  misc_feature 1..4020: note = derived and/or modified CDS sequence (opt1) from TOSV(Nice/113)__KU204982.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacgtcaccgagtccatcgggctgaccagcggcacgtgcaaggtggggtccctggagaaccgcgactgcggcaaggacatcatgagcaactacgtggccgaggtccactccaacctccacggcctgggggccatgatgcacaactacggcgacgacaagcgggtggagatcctgaacgacgtgatccccgacgagctcaacccggggcaccacaactgcagcgacctggaccgcaagcccttctggaccgagttcatcaacgtcgcccggcccctgtccgagatcgcccccatgagcgtgatcccgccgcccgtggtcaagctccagccgcccgcggagccctccagcaagaagcacgtgcccttcgacgtgctgctgtccgaggccgagaaggagctcaaccagaccaagatccgcctggaggacgagcgcaagagcaacgccgaggagaccgccaaggagcgggcgcggatgaaggagatcgaggacgagctgcgccgggagtgggagctcgagcgcaagcggaaggacgccatggccgacgacctggccaaggagacggcccgccggcgcgagatcgagcggaaggcgcacgagctggaccgcatgctcaagaagaaggagcgggagtccctgatcgccaaggagaaggccgacgaggacatgcgcagccacgtccacaagcccaacaccacccgggcccccgcccccaccatcatcacgaccctgctcatggcgagcgccgccctggccggccccctggagaaccgcgagaccaaccacctcctgaaccgccccgggaacggcgcctacaccctgtccgacttcgcggagagcacgtgcaccctcgcctacggctccgagtgcaagagctgggagcacctcctgaacgaggagctgttcccgttcttccactccaacctggacaagtacagcatgctggaggccgccaccgagaccgtgcccatcctcaacaagtccagcgccgtgtgcacgatctcccccagcacccactccagcaacgcgtgcgggcgggaggcctccgtcatccgcaagaagtgctacagcaacatgtccgccttcttctacatcaacctggccggccagatcaccgtggtgaagtgcgagaccaaccacgtcctgagctccgactgcgggaactgcatcagcaagtccctcagcggccagaaggtgtacacgcccgtgcaggacgtcttctgccagaagggctggacccagagcatcccgtccacccggtacagcaaggacatctgctccatcgggctgcacaccgtgaaggagtgcaagatcggcacgaccagcttcgagcgcgtggggttcatcgtcgtgggcgggcggaagatgtacatcgagcagatgaagatgcgctcccggcaggagtacagcgaggaccagttcctgtgctacaagtccgagagcggctccggcagctccgtcaagctcaagaagttcaaggtggagagctgcaagggggtgaccacctccagcgcgtccaagtgcagcggcgacgagtacttctgctcccgctacccctgcgagacggccaacgtcgaggcccactgcatcctgcggcgccacagcgccatcgtggaggtgaacgtcaacggggtgtgggtggtcccccggtgcatcggctacgaggaggtgctggtgaagcgcaccagcctcaaggtcgaggacaccaccgagcgggagtgcgactcctgcctgtgggagtgcgggaagaacaagctgatcgtgaagacgcacggccccaaggtggtctacgccaccgcgtgcagccacggctcctgcaagagcgtgatgcagaagccggccaccttcgtgtacctgccctaccccgggaactccgagatcgtcggcggggacatcggcatccacatgaccgaggagagctcccccagcaacatccacctcgtggcccactgcccggcccgcgactcctgcgacgtgagcgactgcctgttctgcgtccacgggctgctcaactaccagtgccacaccctgttctccgccctgctcatcagcacgaccgtgatgtccatcctgaccctgctcctgctgctcgtgaagggcgcgaaggacctggtcaagaagctgttctactggctcatcacgcccctgtgctggctgagcgtgttctgctgctgggtgatcaagtcctggaagcggcgcgtcggcagcgccatctcccggaccaacgacaccatcgggtggcgcgagaaccggcgccacgcccaggacatcgagcgcgcccagtacaccggcggggcccccggcgcgaagtacagcttctacggcgtgatgatcctcgggctgctgtccagcgcccagagctgctccgagagcgtgatcgccgactccaagatcatgcagtgcaccacgagcggctccagcaccctctgcaaggcctccgggaccgtcatcatgcggctgggcccgatcgggagcgagtcctgcctgatcctcaagggcctgaaggacagcgagaagcagttcatctccatcaagaccatcagctccgagctgacgtgccgcgagggcgagagcttctggaccaccctctacacccccatctgcctgtccagccggcgctgccacctgatgggggagtgcgtgtccgaccggtgcctcaagtggaagacgaaccagaccagcgcggagttcaccggcaaggcccacggggacgtgatgcacgagaaccgctgcttcgagcagtccggcgggatcggctacggctgcttcaacgtcaaccccagctgcctgtacgtgcacagctacctgaagtccgtgtaccggaacgggttcaaggtcttccgctgcgtggcctggaaccaccggatccgcctcgaggtgaccacgcacagccggaagttccccatggtcctgatggccatgtccacccagccgaccgactggggcagcatcgggctgatcctcgactccgagggcatcaccgggacgaacagctactccttcatgaagcacggcagcggctccttcgccatcatcgacgacccctacagccccgagccccgcaaggggttcctgggcgaggtgcggtgcccgaccgaggagaccgcgatgcgcgcctcccccagctgcaagatggcccccaacctgatcgagtaccagcccgagatggacaccgccgagtgcacgaccaacatgatcgacccgatggccatcttcaaccgggggtccctcccccaggtgcgcgacggcatgaccttcacccagagcatcgagaagaacacggtccaggcgctgaccaccggggaggtgaaggcctccatccggctgaccctcgacgactacgacgtggtctaccagaacagccagtccgactgcagcgccacgttcaagaacctgaccggctgctactcctgcgacgagggcagccgcctgtgctaccaggtgaaggccgagggggagaccatcttccacttcatcaacgaggaggagagcatcaacgtgatcaacaaggtctcccccgaggtgagcaactactgcaccgtgctccacttctcccggcccgtcatcagcatcgagggcacctacgactgcgggctgtccaagcgcccgatggtgatcaagggcacgctgatcgccaccgcgccccacgacgaccggaagcacgagggcgggagctccctcgtcgtgaaccccaagggcgggagcgtggacttcttcggctggctgtccgggctgaccagctggctcggcggccccctgaagaccttcctgacgatcctcgggttcctggccgtcggcctgctcctggtggtgatcatcatcatcatcatccgcaccgggatgcagcaggccctgaagaagaagatcaagtga

SEQ ID NO: 13076 - RNA, 4020 nt, synthetic construct
  misc_feature 1..4020: note = derived and/or modified CDS sequence (opt1) from TOSV(P233)__KU204976.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacgtcaccgagtccatcgggctgaccagcggcacgtgcaaggtggggtccctggagaaccgcgactgccggaaggacatcatgagcaactacgtggccgaggtccactccaacctccacggcctgggcgccatgatgcacaactacggggacgacaagcgcgtggagatcctgaacgacgtgatccccgacgagctcaacccgggccaccacaactgcagcgacctggaccggaagcccttctggaccgagttcatcaacgtcgccaagcccctgtccgagatcgtgcccatgagcgtgatcccgccgcccgtcgtgaagccccagccgcccgccgagccctccagcaagaagcacgtgcccttcgacgtcctcctgtccgaggcggagaaggagctgaaccagaccaagatccgcctcgaggacgagcgcaagagcaacgccgaggagaccgccaaggagcgggcccggatgaaggagatcgaggacgagctgcgccgggagtgggagctggagcgcaagcggaaggacgcgatggccgacgacctcgccaaggagacggcccgccggcgcgagatcgagcggaaggcccacgagctggacaagatgctgaagaagaaggagcgcgagtccctcatcgcgaaggagaaggccgacgaggacatgcggagccacgtgcacaagcccaacaccacccgcgcccccgcccccaccatcatcacgaccctgctgatggccagcgcggccctcgccgggcccctggagaaccgggagaccaaccacctcctgaaccgcccgggcaacggggcctacaccctgtccgacttcgccgagagcacgtgcaccctggcgtacggctccgagtgcaagagctgggagcacctcctgaacgaggagctgttccccttcttccactccaacctcgacaagtacagcatgctggaggccgccaccgagaccgtgcccatcctgaacaagtccagcgccgtctgcacgatctcccccagcacccactccagcaacgcctgcggccgcgaggcgtccgtgatccggaagaagtgctacagcaacatgtccgccttcttctacatcaacctcgccgggcagatcaccgtgatcaagtgcgagaccaaccacgtcctgagctccgactgcggcaactgcatcagcaagtccctgagcgggcagaaggtgtacacgccggtgcaggacgtcttctgccagaagggctggacccagagcatcccctccacccgctacagcaaggacatctgctccatcggcctccacaccgtgaaggagtgcaagatcgggacgaccagcttcgagcgggtgggcttcatcgtcgtgaaggggcgcaagatgtacatcgagcagatgaagatgcggtcccgccaggagtacagcgaggaccagttcctgtgctacaagtccgagagcggctccgggagctccgtcaagctgaagaagttcaaggtcaagagctgcaagggcgtgaccacctccagcgcctccaagtgcagcggcgacgagtacttctgctcccggtacccctgcgagacggcgaacgtggaggcccactgcatcctccgccggcacagcgccatcgtggaggtgaacgtcaacggggtgtgggtggtcccccgctgcatcggctacgaggaggtgctggtgaagcggaccagcctgaaggtcgaggacaccaccgggcgcgagtgcgactcctgcctctgggagtgcggcaagaacaagctgatcgtgaagacgcacgggccgaaggtggtctacgccaccgcctgcagccacggctcctgcaagagcgtgatgcagaagcccgcgaccttcgtgtacctgccctaccccggcaactccgagatcgtcgggggcgacatcgggatccacatgaccgaggagagctccccgagcaacatccacctggtggcccactgccccgcccgggactcctgcgacgtgagcgactgcctcttctgcgtccacggcctgctgaactaccagtgccacaccctcttctccgccctgctgatcagcacgaccgtgatgtccatcctcaccctgctgctcctgctggtgaagggggccaaggacctcgtcaagaagctgttccactggctgatcacgcccctctgctggctgagcgtgttctgctgctgggtggtcaagtcctggaagcgccgggtgggcagcgcgatctcccgcaccaacgacaccatcggctggcgggagaaccgccggcacgcccaggacatcgagcgcgcccagtacaccgggggcgccccgggggccaagtacagcttctacggcgtgatgatcctgggcctcctgtccagcgcgcagagctgctccgagagcgtcatcgccgactccaagatcatgcagtgcaccacgagcgggtccagcaccctgtgcaaggcctccggcaccgtgatcatgcgcctcgggcccatcggcagcgagtcctgcctgatcctgaaggggctcaaggacagcgagaagcagttcatctccatcaagaccatcagctccgagctgacgtgccgggagggcgagagcttctggaccaccctgtacacccccatctgcctctccagccgccggtgccacctgatgggcgagtgcgtgtccgaccgctgcctgaagtggaagacgaaccagaccagcgccgagttcaccgggaaggcgcacggcgacgtcatgcacgagaaccggtgcttcgagcagtccgggggcatcgggtacggctgcttcaacgtgaaccccagctgcctctacgtgcacagctacctgaagtccgtctaccgcaacggcttcaaggtgttccggtgcgtggcctggaaccaccgcatccggctggaggtcaccacgcacagccgcaagttcccgatggtgctcatggccatgtccacccagcccaccgactgggggagcatcggcctgatcctggactccgaggggatcaccggcacgaacagctactccttcatgaagcacgggagcggctccttcgccatcatcgacgacccctacagccccgagccgcggaagggcttcctcggggaggtgcgctgccccaccgaggagaccgccatgcgggcgtcccccagctgcaagatggcccccaacctgatcgagtaccagccggagatggacaccgccgagtgcacgaccaacatgatcgaccccatggccatcttcaaccgcggctccctgccccaggtccgggacgggatgaccttcacccagagcatcgagaagaacacggtgcaggccctcaccaccggcgaggtgaaggcgtccatccgcctgaccctggacgactacgacgtcgtgtaccagaacagccagtccgactgcagcgccacgttcaagaacctcaccgggtgctactcctgcgacgagggcagccggctgtgctaccaggtgaaggccgagggcgagaccatcttccacttcatcaacgaggaggagagcatcaacgtcatcaacaaggtgtcccccggggtgagcgactactgcaccgtcctgcacttctcccgcccggtgatcagcatcgagggcacctacgactgcgggctctccaagcggcccatggtcatcaagggcacgctgatcgccaccgcgccccacgacgaccgcaagcacgagggcgggagctccctggtggtgaaccccaagggcgggagcgtcgacttcttcggctggctctccgggctgaccagctggctgggcggcccgctcaagaccttcctgacgatcctggggttcctcgccgtgggcctgctgctcgtggtcatcatcatcatcatcatccggaccgggatgcagcaggccctgaagaagaagatcaagtga

SEQ ID NO: 13077 - RNA, 4020 nt, synthetic construct
  misc_feature 1..4020: note = derived and/or modified CDS sequence (opt1) from TOSV(T152)__JX867535.1__GP
  source 1..4020: mol_type = other RNA
atgttcatcgccaagctgctcctgatcagctgcctggtgcagcaggcctacctcaagtacaccatcatctccgagatcggcaacgggacccgcacgagctcctgctacagctcccggaccagcctgggctccctgctcgaggcgtgggacaacatcaccgagagcatcgggctgacctccggcacgtgcaaggtcgggagcctggagaaccgcgactgcaagcgggacatcatgtccaactacgtggccgaggtgcacagcaacctccacggcctgggcgccatgatgcacaactacggggacgacaagcgcgtcgaggtgctgaacgacgtgatccccgacgagctcaacccgggccggcacaactgctccgacctggaccgcaagcccttctggaccgagttcatcaacgtcgccaagcccaccaacaagatcgcccccatcagcgtgatcccgccgcccatcgtgaagcccatccccatcgcggagcccaccacgaagaagaacatccccttcgacaagctgctctccgaggccgagaaggagctgaaccagaccaagatccggctggagaccgagcgccggagcaacgccgaggaggccgcgaaggagcgcgcccggatgcgcgagatcgaggacaagctccggaaggactgggagctggagcgcgagcggaaggacgccgtcgccgacgacctggccaaggagatcgcgcgccggcgcgagatcgagcggaaggcccacgagctcgacaagatgctgaagaagaaggagcgcgaggacctggtggccatcgagaaggtgtccgaggacatgcggaaccacgtccgccgccccaacaccacgatcgccccggcccccaccatcatcaccaccctcctgctggcgagcgccgtgatggccgggcccctcgagaaccgggagacgaaccacctcctgaaccgccccggcaacggggcctacaccctctccgacttcgccgagagcacgtgcaccctggcgtacggcagcgagtgcaagtcctgggagcaccagctggacgagctcagcttcccgttcttccactccaacctggacaagtacagcatgctggaggccgccaccgagaccatccccatcctcaacaagtccagcgccgtgtgcaccatctcccccagcacccactccagcaacgcctgcggccgggaggcgtccctgatcaagaagaagtgcgggagcaacatgtccgccttcttctacgtcaacctggccggccagatcacggtggtgaagtgcgacaccaaccacgtcctcagcaacgactgcgggaactgcatctccaagaccctgagcggccagaagatctacacccccgtgcaggacatgttctgccagaagggctggacggagtccatcccgagcacccgctactccaaggacctgtgcagcatcgggctccacaccgtgaaggagtgcaagaccggcacgaccaacttcgagcgggtcgggttcatcgtggtggagagccgcaagatgtacatcgagcagatgaagatgcggtcccgccaggagttcagcgaggaccagttcctgtgctacaagtccgagagctccagcggctccagcgtcaagctgaagaaggtgaaggtcgagtcctgcaagggggtgaccaccagctccgccagcaagtgctccggcgacgagtacttctgcagccggtacccctgcgagacggcgaacgtggaggcccactgcatcctccgccggcactccgccgtcatcgaggtgaacgtgaacggcgtctgggtggtgccccgctgcatcgggtacgaggaggtcctggtgcggcgcaccagcctgaaggtggaggacacctccagccgggagtgcgacacgtgcctctgggagtgcggcaagaacaagctgatcgtcaagacccacgggcccaagatcgtgtacgccaccgcctgcagccacggctcctgcaagagcgtgatgcagaagccggcgaccttcgtcttcctgccctaccccgggaactccgagatcgtgggcggcgacatcggggtgcacatgaccgaggagagctcccccagcaacatccacatggtcgcccactgcccggccaaggactcctgcgaggtgagctcctgcctgttctgcgtgcacggcctcctgaactaccagtgccacaccctgttcagcgccctcctgatctccacgaccgtcatgagcatcctgaccctcctgctgctcctggtgaagggggccaaggacctggtgaagcgcctcttctactggctgatcacgcccctgtgctggctctccgtcttctgcagctggatgatcaagtcctggcggaagcgcgtgggcagcgcgatctcccggaccaacgacaccatcgggtggcgcgacaaccgccggtacggccaggacgtggagcgcgcccagtacaccggcggggcccccggcaccaagtacagcttctacggggtcatgatcctgggcctgctcggcaacgtgcactcctgcagcgagagcgtgatcgccgactccaaggtcatgcagtgcacgaccagcgggtccagcaccctgtgcaaggcctccggcaccgtgatcatgaagctggggccgatcggcagcgagtcctgcctcatcctgaaggggctgaaggacagcgagaagcagttcatctccatcaagacgatcagctccgagctgacctgccgggagggcgagagcttctggaccaccctgtacacgcccgtgtgcctgtccagccgccggtgccacctcatgggcgagtgcgtctccgaccgctgcctgaagtggaagaccaacgagaccagcgcggagttcaccgggaaggcccacggcgaggtgatgcacgagaacaagtgcttcgagcagtccgggggcatcgggtacggctgcttcaacgtgaaccccagctgcctgtacgtccactcctacctcaagagcgtgtacaagaacggcttcaagatcttccggtgcgtggcctggaaccaccgcatccggctggaggtcacgacccacagccgcaagttccccatggtgctgatggccatgtccacccagccgaccgactgggggagcatcggcctcatcctggactccgaggggatcacgggcaccaacgcgtacagcttcatgaagcacgggtccggcagcttcgccatcatcgacgacccctactcccccgagccccggaagggcttcctgggggaggtgcgctgcccgaccgaggagaccgccatccgggccagcccctcctgcaagatggcccccaacctcatcgagtaccagcccgagatggacacggcggagtgcaccaccaacatgatcgacccgatggccatcttcaaccgcggcagcctgccccaggtccgggacgggatgaccttcacgcagtccatcgagaagaacaccgtgcaggccctgaccaccggcgaggtgcgcgccagcatccggctcaccctggacgactacgacgtcgtgtaccagaactcccagagcgactgctccgccacgttcaagaacctgaccgggtgctacagctgcgacgagggctcccgcatgtgctaccaggtgaaggcggagggcgagaccatcttccacttcgtcaacgaggacgagagcatcaacgtgatcaacaaggtgtcccccgacgtcagcgactactgcaccgtgctccacttcagccggcccgtcatctccatcgaggggcgctacgactgcggcctgagcaagcggccgatggtgatcaaggggacgctgatcgccaccgcgccccacgacgaccgcaagcacgagggcggctccagcctcgtggtcaaccccaagggcgggaccgtggacttcttcgggtgggtgtccggcctgaccagctggctcgggggccccctgaagacgttcctgaccatcctgggcttcctcgccctggggctgctcctggtcgtggtgatcatcatcatcgcccgcaccggcgtccagcaggccctgaagaagaagaacaagtga

SEQ ID NO: 13078 - RNA, 4020 nt, synthetic construct
  misc_feature 1..4020: note = derived and/or modified CDS sequence (opt1) from TOSV(TOSV/P51)__KU204979.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacgtcaccgagtccatcgggctgaccagcggcacgtgcaaggtggggtccctggagaaccgcgactgccggaaggacatcatgagcaactacgtggccgaggtccactccaacctccacggcctgggcgccatgatgcacaactacggggacgacaagcgcgtggagatcctgaacgacgtgatccccgacgagctcaacccgggccaccacaactgcagcgacctggaccggaagcccttctggaccgagttcatcaacgtcgccaagcccctgtccgagatcgtgcccatgagcgtgatcccgccgcccgtcgtgaagctccagccgcccgccgagccctccagcaagaagcacgtgcccttcgacgtcctgctgtccgaggcggagaaggagctcaaccagaccaagatccgcctggaggacgagcgcaagagcaacgccgaggagaccgccaaggagcgggcccggatgaaggagatcgaggacgagctgcgccgggagtgggagctcgagcgcaagcggaaggacgcgatggccgacgacctggccaaggagacggcccgccggcgcgagatcgaccggaaggcccacgagctggaccgcatgctcaagaagaaggagcgggagtccctgatcgcgaaggagaaggccgacgagaacatgcgcagccacgtgcacgagcccaacaccacccgggcccccgcccccaccatcatcacgaccctgctcatggccagcgcggccctggccgggcccctggagaaccgcgagaccaaccacctcctgaaccgccccggcaacggggcctacaccctgtccgacttcgccgagagcacgtgcaccctcgcgtacggctccgagtgcaagagctgggagcacctcctgaacgaggagctgttcccgttcttccactccaacctggacaagtacagcatgctggaggccgccaccgagaccgtgcccatcctcaacaagtccagcgccgtctgcacgatctcccccagcacccactccagcaacgcctgcggccgggaggcgtccgtgatccgcaagaagtgctacagcaacatgtccgccttcttctacatcaacctggccgggcagatcaccgtggtcaagtgcgagaccaaccacgtgctgagctccgactgcggcaactgcatcagcaagtccctcagcgggcagaaggtgtacacgcccgtccaggacgtgttctgccagaagggctggacccagagcatcccgtccacccggtacagcaaggacatctgctccatcggcctgcacaccgtgaaggagtgcaagatcgggacgaccagcttcgagcgcgtcggcttcatcgtggtcaaggggcggaagatgtacatcgagcagatgaagatgcgctcccggcaggagtacagcgaggaccagttcctgtgctacaagtccgagagcggctccgggagctccgtgaagctcaagaagttcaaggtggagagctgcaagggcgtcaccacctccagcgcctccaagtgcagcggcgacgagtacttctgctcccgctacccctgcgagacggcgaacgtggaggcccactgcatcctgcggcgccacagcgccatcgtggaggtcaacgtgaacggggtgtgggtcgtgccccggtgcatcggctacgaggaggtgctggtcaagcgcaccagcctcaaggtggaggacaccaccgggcgggagtgcgactcctgcctgtgggagtgcggcaagaacaagctgatcgtgaagacgcacgggcccaaggtcgtgtacgccaccgcctgcagccacggctcctgcaagagcgtgatgcagaagccggcgaccttcgtctacctgccctaccccggcaactccgagatcgtcgggggcgacatcgggatccacatgaccgaggagagctcccccagcaacatccacctcgtggcccactgcccggcccgcgactcctgcgacgtgagcgactgcctgttctgcgtgcacggcctgctcaactaccagtgccacaccctgttctccgccctgctcatcagcacgaccgtgatgtccatcctgaccctgctcctgctgctcgtcaagggggccaaggacctggtgaagaagctgttctactggctcatcacgcccctgtgctggctgagcgtgttctgctgctgggtcgtgaagtcctggaagcggcgcgtgggcagcgcgatctcccggaccaacgacaccatcggctggcgcgagaaccggcgccacgcccaggacatcgagcgcgcccagtacaccgggggcgcccccggggccaagtacagcttctacggcgtcatgatcctcggcctgctgtccagcgcgcagagctgctccgagagcgtgatcgccgactccaagatcatgcagtgcaccacgagcgggtccagcaccctctgcaaggcctccggcaccgtgatcatgcggctggggccgatcggcagcgagtcctgcctgatcctcaaggggctgaaggacagcgagaagcagttcatctccatcaagaccatcagctccgagctgacgtgccgcgagggcgagagcttctggaccaccctctacacccccatctgcctgtccagccggcgctgccacctgatgggcgagtgcgtctccgaccggtgcctcaagtggaagacgaaccagaccagcgccgagttcaccgggaaggcgcacggcgacgtgatgcacgagaaccgctgcttcgagcagtccgggggcatcgggtacggctgcttcaacgtgaaccccagctgcctgtacgtccacagctacctgaagtccgtgtaccggaacggcttcaaggtgttccgctgcgtcgcctggaaccaccggatccgcctcgaggtgaccacgcacagccggaagttccccatggtgctgatggccatgtccacccagccgaccgactgggggagcatcggcctgatcctcgactccgaggggatcaccggcacgaacagctactccttcatgaagcacgggagcggctccttcgccatcatcgacgacccctacagccccgagccccgcaagggcttcctgggggaggtccggtgcccgaccgaggagaccgccatgcgcgcgtcccccagctgcaagatggcccccaacctggtggagtaccagcccgagatggacaccgccgagtgcacgaccaacatgatcgacccgatggccatcttcaaccggggctccctcccccaggtgcgcgacgggatgaccttcacccagagcatcgagaagaacacggtccaggccctgaccaccggcgaggtgaaggcgtccatccggctgaccctcgacgactacgacgtggtctaccagaacagccagtccgactgcagcgccacgttcaagaacctgaccgggtgctactcctgcgacgagggcagccgcctgtgctaccaggtgaaggccgagggcgagaccatcttccacttcatcaacgaggaggagagcatcaacgtgatcaacaaggtcagcccccgggtgtccgactactgcaccgtcctccacttctcccgccccgtgatcagcatcgaggggacctacgactgcggcctgtccaagcggccgatggtgatcaaggggacgctgatcgccaccgcgccccacgacgaccgcaagcacgagggcggcagctccctcgtcgtgaaccccaagggcgggagcgtggacttcttcgggtggctgtccggcctgaccagctggctcgggggccccctgaagaccttcctgacgatcctcggcttcctggccgtcgggctgctcctggtggtgatcatcatcatcatcatccgcaccggcatgcagcaggccctgaagaagaagatcaagtga

SEQ ID NO: 13079 - RNA, 4020 nt, synthetic construct
  misc_feature 1..4020: note = derived and/or modified CDS sequence (opt1) from TOSV(TOSV_Italy/BB8/2014/human)__KY626661.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacatcaccgagtccatcgggctgaccagcggcacgtgcaaggtcgggtccctggagaaccgcgactgcaagcgggacatcatgagcaactacgtggccgaggtgcactccaacctccacggcctgggcgccatgatgcacaactacggggacgacaagcgcgtcgaggtgctgaacgacgtgatccccgacgagctcaacccgggccggcacaactgcagcgacctggaccgcaagcccttctggaccgagttcatcgacgtcgccaagcccaccaacaagatcgcccccatgtccgtgatcccgccgcccatcgtgaagcccatccccgtcgcggagagcaccatcaagaagtccatccccttcgacaagctgctcagcgaggccgagaaggagctgaaccagacgaagatccggctggagaccgagcgccggtccaacgccgaggaggccgcgaaggagcgcgcccggatgcgcgagatcgaggacaagctccggaaggactgggagctggagcgcgagcggaaggacgccgtggccgacgacctggccaaggagatcgcgcgccggcgcgagatcgagcggaaggcccacgagctcgacaagatgctgaagaagaaggagcgcgaggacctggtggcccgggagcgcgtcagcgaggacatgcgcaaccacgtgtgcaagcccaacaccaccatcgcccccgccccgacgatcatcaccaccctcctgatggcgtccgccgtgatggccgggcccctggagaaccgggagaccaaccacctcctgaaccgccccggcaacggggcctacacgctgagcgacttcgccgagagcacgtgcaccctcgcgtacggctccgagtgcaagagctgggagcaccagctggacgagctgtccttccccttcttccacagcaacctcgacaagtactccatgctggaggccgccaccgagacgatcccgatcctgaacaagagctccgccgtctgcaccatcagcccctccacccacagctccaacgcctgcggccgggaggcgagcctcatcaagaagaagtgcgggtccaacatgagcgccttcttctacgtgaacctggccggccagatcaccgtggtcaagtgcgacacgaaccacgtgctgtccaacgactgcgggaactgcatcagcaagaccctctccggccagaagatctacacccccgtgcaggacatgttctgccagaagggctggaccgagagcatccccaacacgcgctactccaaggacctgtgcagcatcgggctgcacagcgtcaaggagtgcaagaccggcaccaccaacttcgagcgggtggggttcatcgtggtcaagggccgcaagatgtacatcgagcagatgaagatgcggtcccgccaggagttcagcgaggaccagttcctctgctacaagtccgagagctccagcgggtccagcgtgaagctgaagaaggtcaaggtggagtcctgcaagggcgtgacgaccagctccgccagcaagtgctccggcgacgagtacttctgcagccggtacccgtgcgagaccgcgaacgtcgaggcccactgcatcctgcgccggcactccgccgtgatcgaggtgaacgtcaacggggtgtggatcgtgccccgctgcatcggctacgaggaggtcctcgtgcggcgcaccagcctgaaggtggaggacacgtccagccgggagtgcgacacgtgcctgtgggagtgcgggaaggacaagctcatcgtcaagacccacggccccaagatcgtgtacgccaccgcctgcagccacgggtcctgcaagagcgtgatgcagaagcccgcgaccttcgtctacctgccgtaccccggcaactccgagatcgtgggcggggacatcggcgtgcacatgaccgaggagagctcccccagcaacatccacatggtcgcccactgccccgccaaggactcctgcgaggtgagctcctgcctgttctgcgtgcacgggctgctcaactaccagtgccacaccctgttcagcgccctgctcatctccaccaccgtcatgagcatcctgacgctgctcctgctgctcatgaagggcgccaaggacctggtgaagcgcctgttctactggctcatcaccccgctgtgctggctgtccgtgttctgcgggtgggtcatcaagagctggaagaagcgggtgggctccgcgatcagccgcaccaacgacaccatcggctggcgggacaaccgccgctaccggcaggacgtggagcgcgcccagtacaccgggggcgcccccggggccaagtactccttctacggcgtcatggtgctcggcctgctggggaacgtgcacagctgctccgagagcgtcatcgccgacagcaagatcatgcagtgcaccacctccggcagctccaccctctgcaaggcgagcgggacggtgatcatgaagctgggccccatcgggtccgagagctgcctgatcctcaagggcctgaaggactccgagaagcagttcatcagcatcaagaccatctccagcgagctgacctgccgggagggcgagtccttctggaccacgctctacaccccggtgtgcctgagctcccgccggtgccacctgatgggggagtgcgtcagcgaccgctgcctcaagtggaagaccaacgagacctccgccgagttcacgggcaaggcccacggggaggtgatgcacgagaaccggtgcttcgagcagagcggcgggatcggctacggctgcttcaacgtgaacccctcctgcctgtacgtccacagctacctgaagtccgtgtacaagaacgggttcaagaccttccgctgcgtggcctggaaccaccggatccgcctcgaggtcaccacccacagccggaagttccccatggtgctgatggcgatgagcacgcagcccaccgactggggctccatcgggctgatcctcgacagcgagggcatcaccgggaccaacgcctactccttcatgcgccacggcagcggctccttcgccatcatcgacgacccgtacagccccgagccccggaaggggttcctgggcgaggtgcgctgccccacggaggagaccgccatccgggcctccccgagctgcaagatggcgcccaacctgatcgagtaccagcccgagatggacaccgccgagtgcaccacgaacatgatcgaccccatggccatcttcaaccgcgggtccctcccgcaggtccgggacggcatgaccttcacccagagcatcgagaagaacaccgtgcaggccctgacgaccggggaggtgcgcgcctccatccggctgaccctcgacgactacgacgtcgtgtaccagaacagccagtccgactgcagcgcgaccttcaagaacctgaccggctgctactcctgcgacgagggcagccgcatgtgctaccaggtgaaggccgagggggagacgatcttccacttcatcaacgaggacgagtccatcaacgtcatcagcaaggtgaaccccgacgtgtccgactactgcaccgtcctgcacttcagccggcccgtgatcagcatcgagggccgctacgactgcgggctctccaagcgccccatggtcatcaagggcaccctgatcgccaccgccccgcacgacgaccggaagcacgagggcgggagctccctgatcgtgaaccccaagggcgggacggtggacttcttcggctgggtcagcgggctcacctcctggctgggcggccccctgaagaccttcctcaccatcctggggttcctggccctcggcctgctgctcgtggtgatcatcatcatcatcgcgcgcacgggggtccagcaggccctgaagaagaagaacaagtga

SEQ ID NO: 13080 - RNA, 4020 nt, synthetic construct
  misc_feature 1..4020: note = derived and/or modified CDS sequence (opt1) from TOSV(TOSV-54441132704)__KX010933.1__GP
  source 1..4020: mol_type = other RNA
atgttcatcgccaagctgctcctgatcagctgcctggtgcagcaggcctacctcaagtacaccatcatctccgagatcggcaacgggacccgcacgagcttctgctactccagccggacctccctgggcagcctgctcgaggcgtgggacaacgtcaccgagtccatcgggctgaccagcggcacgtgcaaggtggggtccctggagaaccgcgactgccggaaggacatcatgagcaactacgtggccgaggtccactccaacctccacggcctgggcgccatgatgcacaactacggggacgacaagcgcgtggagatcctgaacgacgtgatccccgacgagctcaacccgggccaccacaactgcagcgacctggaccggaagcccttctggaccgagttcatcaacgtcgccaagcccctgtccgagatcgtgcccatgagcgtgatcccgccgcccgtcgtgaagctccagccgcccgccgagccctccagcaagaagcacgtgcccttcgacgtcctgctgtccgaggcggagaaggagctcaaccagaccaagatccgcctggaggacgagcgcaagagcaacgccgaggagaccgccaaggagcgggcccggatgaaggagatcgaggacgagctgcgccgggagtgggagctcgagcgcaagcggaaggacgcgatggccgacgacctggccaaggagacggcccgccggcgcgagatcgagcggaaggcccacgagctggacaagatgctcaagaagaaggagcgcaagtccctgatcgcgaaggagaaggccgacgtggacatgcggagccacgtgcacaagcccaacaccacccgcgcccccgcccccaccatcatcacgaccctgctcatggccagcgcggccctggccgggcccctggagaaccgggagaccaaccacctcctgaaccgccccggcaacggggcctacaccctgtccgacttcgccgagagcacgtgcaccctcgcgtacggctccgagtgcaagagctgggagcacctcctgaacgaggagctgttcccgttcttccactccaacctggacaagtacagcatgctggaggccgccaccgagaccgtccccatcctcaacaagtccagcgccgtgtgcacgatctcccccagcacccactccagcaacgcctgcggccgcgaggcgtccgtgatccggaagaagtgctacagcaacatgtccgccttcttctacatcaacctggccgggcagatcaccgtcatcaagtgcgagaccaaccacgtgctgagctccgactgcggcaactgcatcagcaagtccctcagcgggcagaaggtgtacacgcccgtccaggacgtgttctgccagaagggctggacccagagcatcccgtccacccgctacagcaaggacatctgctccatcggcctgcacaccgtgaaggagtgcaagatcgggacgaccagcttcgagcgggtcggcttcatcgtggtcaaggggcgcaagatgtacatcgagcagatgaagatgcggtcccgccaggagtacagcgaggaccagttcctgtgctacaagtccgagagcggctccgggagctccgtgaagctcaagaagttcaaggtggagagctgcaagggcgtcaccacctccagcgcctccaagtgcagcggcgacgagtacttctgctcccggtacccctgcgagacggcgaacgtggaggcccactgcatcctgcgccggcacagcgccatcgtggaggtcaacgtgaacggggtgtgggtcgtgccccgctgcatcggctacgaggaggtgctggtcaagcggaccagcctcaaggtggaggacaccaccgggcgcgagtgcgactcctgcctgtgggagtgcggcaagaacaagctgatcgtgaagacgcacgggcccaaggtcgtgtacgccaccgcctgcagccacggctcctgcaagagcgtgatgcagaagccggcgaccttcgtctacctgccctaccccggcaactccgagatcgtcgggggcgacatcgggatccacatgaccgaggagagctcccccagcaacatccacctcgtggcccactgcccggcccgggactcctgcgacgtgagcgactgcctgttctgcgtgcacggcctgctcaactaccagtgccacaccctgttctccgccctgctcatcagcacgaccgtgatgtccatcctgaccctgctcctgctgctcgtcaagggggccaaggacctggtgaagaagctgttctactggctcatcacgcccctgtgctggctgagcgtgttctgctgctgggtcgtgaagtcctggaagcgccgggtgggcagcgcgatctcccgcaccaacgacaccatcggctggcgggagaaccgccggcacgcccaggacatcgagcgcgcccagtacaccgggggcgcccccggggccaagtacagcttctacggcgtcatgatcctcggcctgctgtccagcgcgcagagctgctccgagagcgtgatcgccgactccaagatcatgcagtgcaccacgagcgggtccagcaccctctgcaaggcctccggcaccgtgatcatgcgcctggggccgatcggcagcgagtcctgcctgatcctcaaggggctgaaggacagcgagaagcagttcatctccatcaagaccatcagctccgagctgacgtgccgggagggcgagagcttctggaccaccctctacacccccatctgcctgtccagccgccggtgccacctgatgggcgagtgcgtctccgaccgctgcctcaagtggaagacgaaccagaccagcgccgagttcaccgggaaggcgcacggcgacgtgatgcacgagaaccggtgcttcgagcagtccgggggcatcgggtacggctgcttcaacgtgaaccccagctgcctgtacgtccacagctacctgaagtccgtgtaccgcaacggcttcaaggtgttccggtgcgtcgcctggaaccaccgcatccggctcgaggtgaccacgcacagccgcaagttccccatggtgctgatggccatgtccacccagccgaccgactgggggagcatcggcctgatcctcgactccgaggggatcaccggcacgaacagctactccttcatgaagcacgggagcggctccttcgccatcatcgacgacccctacagccccgagccccggaagggcttcctgggggaggtccgctgcccgaccgaggagaccgccatgcgggcgtcccccagctgcaagatggcccccaacctgatcgagtaccagcccgagatggacaccgccgagtgcacgaccaacatgatcgacccgatggccatcttcaaccgcggctccctcccccaggtgcgggacgggatgaccttcacccagagcatcgagaagaacacggtgcaggccctgaccaccggcgaggtcaaggcgtccatccgcctgatcctcgacgactacgacgtggtgtaccagaacagccagtccgactgcagcgccaccttcaagaacctgacggggtgctactcctgcgacgagggcagccggctgtgctaccaggtcaaggccgagggcgagaccatcttccacttcatcaacgaggaggagagcatcaacgtgatcaacaaggtgtcccccggggtcagcgactactgcaccgtgctccacttctcccgccccgtcatcagcatcgagggcacctacgactgcgggctgtccaagcggccgatggtgatcaagggcaccctgatcgccacggcgccccacgacgaccgcaagcacgagggcgggagctccctcgtggtcaaccccaagggcgggagcgtggacttcttcggctggctgtccgggctgaccagctggctcggcggccccctgaagaccttcctgaccatcctcgggttcctggccgtgggcctgctcctggtcgtgatcatcatcatcatcatccggacggggatgcagcaggccctgaagaagaagatcaagtga

SEQ ID NO: 13081 - RNA, 3222 nt, synthetic construct
  misc_feature 1..3222: note = derived and/or modified CDS sequence (opt1) from SFTSV(HB29)__NC_018138.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcacccgggtccgcccgaagtgctacgggttcagccggatgatggcgaccctggaggtgaacccgcccgagcagcgcatcggccagtgcacggggtgccacctcgagtgcatcaacggcggggtgcggctgatcaccctgacctccgagctccgcagcgccaccgtctgcgcctcccacttctgcagctccgccagctccggcaagaagtccacggagatccacttccactccggcagcctggtggggaagaccgccatccacgtcaagggcgcgctggtggacgggaccgagttcaccttcgagggctcctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctgctcaccaacgtgctgaaggccatcggggtgtggggcagctgggtcatcgcgcccgtgaagctgatgttcgccatcatcaagaagctcatgcgcaccgtgtcctgcctggtcgggaagctgatggaccggggccgccaggtgatccacgaggagatcggcgagaacggggagggcaaccaggacgacgtgcggatcgagatggcccgcccccgccgggtccgccactggatgtacagcccggtgatcctcaccatcctggccatcgggctggccgagggctgcgacgagatggtgcacgcggactccaagctcgtcagctgccggcaggggtccggcaacatgaaggagtgcatcacgaccggccgcgccctgctgcccgccgtgaaccccgggcaggaggcctgcctccacttcaccgcccccggcagcccggacagcaagtgcctgaagatcaaggtgaagcggatcaacctgaagtgcaagaagtccagctcctacttcgtccccgacgcgcgcagccggtgcacctccgtgcgccggtgccgctgggccggggactgccagagcggctgcccgccccacttcacgtccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtggagaacccccacggcatcatctggaaggtctccccctgcgccgcgtgggtgccgagcgccgtgatcgagctgaccatgccctccggcgaggtccggaccttccaccccatgagcgggatccccacccaggtgttcaagggcgtgtccgtcacgtacctggggagcgacatggaggtgtccggcctcaccgacctgtgcgagatcgaggagctcaagagcaagaagctggccctggccccgtgcaaccaggccggcatgggggtggtcggcaaggtgggggagatccagtgcagctccgaggagagcgcgcgcaccatcaagaaggacggctgcatctggaacgccgacctggtggggatcgagctgcgggtcgacgacgccgtgtgctactccaagatcaccagcgtggaggccgtcgccaactactccgcgatccccacgaccatcggcggcctccgcttcgagcggagccacgactcccaggggaagatcagcggcagccccctggacatcaccgccatccgcgggagcttctccgtgaactaccggggcctgcgcctcagcctgtccgagatcaccgccacgtgcaccggggaggtgaccaacgtcagcggctgctactcctgcatgaccggcgccaaggtgagcatcaagctgcactccagcaagaactccaccgcgcacgtgcgctgcaagggggacgagacggccttcagcgtcctcgagggcgtgcacagctacatcgtgcggctgtccttcgaccacgccgtcgtggacgagcagtgccagctgaactgcgggggccacgagagccaggtgaccctcaaggggaacctgatcttcctggacgtccccaagttcgtggacggctcctacatgcagacctaccacagcaccgtgccgacgggcgccaacatcccctcccccaccgactggctcaacgccctgttcgggaacggcctgagccgctggatcctcggggtcatcggcgtgctgctgggcgggctcgcgctgttcttcctgatcatgttcctcctgaagctgggcaccaagcaggtcttccggtcccgcaccaagctcgcctga

SEQ ID NO: 13082 - RNA, 3222 nt, synthetic construct
  misc_feature 1..3222: note = derived and/or modified CDS sequence (opt1) from SFTSV(Jilin)__KT890281.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccaacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggcgcccctggaggtgaacccgcccgagcagcgcatcgggcagtgcacgggctgccacctcgagtgcatcaacgggggcgtgcggctgatcaccctgaccagcgagctcaagagcgccaccgtctgcgcctaccacttctgctcctgcgccacgagcggcaagaagtccaccgagatccagttccacagcgggtccctggtgggcaagaccgccatccacgtcaagggggccctggtggacggcaccgagttcacgttcgagggccgctgcatgttccccgacgggtgcgacgcggtggactgcaccttctgccgggagttcctcaagaacccccagtgctaccccgcccagaagtggctgttcatcatcatcgtcatcctgctcggctacgccgggctgatgctgctcaccaacgtgctgaaggccatgggcgtgtgggggagctgggtcatcgcccccgtgaagctggtgttcgcgatcatcaagaagctcatgcgcgccgtctcctgcctgatgggcaagctgatggaccggggccgccaggtgatccacgaggagatcggggagaaccgggagggcaaccaggacgacgtgcgcatcgagatggcccgcccgcggcgcgtccggcactggatgtacagccccgtgatccagaccatcgtggccatcgggctcgccgagggctgcgacgagatggtccacgcggactccaagctggtgagctgccgccaggggtccggcaacatgaaggagtgcgtgacgaccggccgggccctgctccccgccgtcaaccccgggcaggaggcctgcctgcacttcaccgccccgggcagccccgactccaagtgcctgaagatccgcgtgaagcggatcaacctcaagtgcaagaagtcctccagctacttcgtgcccgacgcgcgctcccggtgcaccagcgtccgccggtgccgctgggccggggactgccagagcggctgcccgccccacttcacgtccaacagcttctccgacgactgggccgggaagatggaccgggccggcctgggcttcagcgggtgctccgacggctgcgggggcgcggcctgcgggtgcttcaacgccgcccccagctgcatcttctggcgcaagtgggtggagaacccccacggcatcatctggaaggtgtccccgtgcgccgcgtgggtccccagcgccgtgatcgagctgaccatgccctccggcgaggtgcggaccttccaccccatgagcgggatcccgacccaggtcttcaagggcgtgtccgtgacgtacctcgggagcgacatggaggtctccggcctgaccgacctgtgcgagatcgaggagctcaagagcaagaagctggccctggccccctgcaaccaggccggcatgggggtggtgggcaaggtcggggagatccagtgctccagcgaggagtccgcgcgcaccatcaagaaggacggctgcatctggaacgccgacctggtggggatcgagctccgggtggacgacgccgtctgctacagcaagatcacctccgtggaggccgtggccaactacagcgcgatccccacgaccatcggcggcctgcgcttcgagcggagccacgactcccaggggaagatcagcggcagccccctggacatcaccgccatccgcgggagcttctccgtcaactaccgcggcctccggctgagcctgtccgagatcaccgccacgtgcaccggggaggtgaccaacgtgagcggctgctactcctgcatgaccggcgccaaggtcagcatcaagctccactccagcaagaactccaccgcgcacgtgcgctgcaagggggacgagacggccttcagcgtgctggagggcgtccactcctacagcgtgtccctgagcttcgaccacgccgtggtcgacgagcagtgccagctcaactgcgggggccacgagtcccaggtgaccctgcgggggaacctgatcttcctcgacgtgccgaagttcgtcgacggcagctacatgcagacctaccacagcaccgtgcccacgggcgccaacatcccctcccccaccgactggctgaacgccctgttcgggaacggcctcagccgctggatcctgggggtcatcggcgtgctgctcggcgggctggcgctgttcttcctcatcatgtccctgttcaagctgggcaccaagcagatcttccggagccgcaccaagctcgcctga

SEQ ID NO: 13083 - RNA, 3222 nt, synthetic construct
  misc_feature 1..3222: note = derived and/or modified CDS sequence (opt1) from SFTSV(05-Lu'an(CHN)-2015)__KX302597.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcggggccaagtgccgctgctccctcgtgcacaagcccggcgaggtcgtggtgagctacggcgggatgcgggtccgcccgaagtgctacggcttcagccggatgatggccaccctggaggtgaaccagcccgagcagcgcatcgggcagtgcacgggctgccacctggagtgcatcaacgggggcgtgcggctcatcaccctgacctccgagctcaagagcgcgaccgtctgcgcctcccacttctgcagctccgccacgagcggcaagaagtccaccgagatccagttccacagcgggtccctcgtgggcaagaccgccatccacgtcaagggggccctggtggacggcaccgagttcacgttcgagggcagctgcatgttccccgacgggtgcgacgcggtggactgcaccttctgccgcgagttcctgaagaacccccagtgctacccggccaagaagtggctgttcatcatcatcgtcatcctgctgggctacgccgggctcatgctgctgaccaacgtgctcaaggccatcggcatctgggggtcctgggtgatcgcccccgtcaagctgatgttcgcgatcatcaagaagctgatgcggaccgtgagctacctcatgggcaagctgatggaccgcggccgccaggtgatccacgaggagatcggggagaaccgggagggcaaccaggacgacgtccggatcgagatggcccgcccccgccgggtgcgccactggatgtactcccccgtgatcctgacgatcctcgccatcgggctggccgagagctgcgacgagatggtccacgccgactccaagctggtgagctgccggcagggctccgggaacatgaaggagtgcgtgaccaccggccgcgcgctcctgccggccgtcaaccccggccaggaggcctgcctgcacttcaccgcccccgggagccccgacagcaagtgcctcaagatcaaggtgaagcggatcaacctgaagtgcaagaagtccagctcctacttcgtgccggacgcccgcagccggtgcacgtccgtccgccggtgccgctgggcgggcgactgccagagcgggtgcccgccccacttcacctccaacagcttctccgacgactgggccggcaagatggaccgggccgggctgggcttcagcggctgctccgacgggtgcggcggggccgcgtgcggctgcttcaacgccgcccccagctgcatcttctggcgcaagtgggtggagaacccccacgggatcatctggaaggtgtccccctgcgccgcctgggtccccagcgcggtgatcgagctcaccatgccgtccggcgaggtgcggaccttccaccccatgagcggcatccccacgcaggtcttcaagggggtgtccgtgacctacctgggcagcgacatggaggtctccgggctgaccgacctctgcgagatcgaggagctcaagagcaagaagctggccctggccccctgcaaccaggccggcatgggcgtggtggggaaggtcggcgagatccagtgcagctccgaggagagcgcccgcaccatcaagaaggacgggtgcatctggaacgcggacctggtgggcatcgagctgcgggtggacgacgccgtctgctactccaagatcacgagcgtggaggccgtggccaactactccgccatcccgaccaccatcgggggcctgcgcttcgagcggagccacgactcccagggcaagatcagcgggagccccctcgacatcaccgcgatccgcggcagcttctccgtcaactaccgggggctgcgcctgagcctctccgagatcacggcgacctgcaccggcgaggtgaccaacgtgagcgggtgctactcctgcatgaccggcgccaaggtcagcatcaagctgcactccagcaagaactccacggcccacgtgcgctgcaagggcgacgagaccgccttcagcgtgctggagggggtccacagctacaccgtgtccctcagcttcgaccacgccgtggtcgacgagcagtgccagctgaactgcggcgggcacgagtcccaggtgaccctgaagggcaacctcatcttcctggacgtgcccaagttcgtcgacgggagctacatgcagacgtaccactccaccgtgcccaccggcgccaacatcccgagccccaccgactggctgaacgccctcttcggcaacgggctgtcccggtggatcctgggcgtgatcggggtcctcctgggcggcctggccctcttcttcatgatcatgagcctgttcaagctggggacgaagcaggtcttccgctcccggaccaagctcgcgtga

SEQ ID NO: 13084 - RNA, 3222 nt, synthetic construct
  misc_feature 1..3222: note = derived and/or modified CDS sequence (opt1) from SFTSV(07-Lu'an(CHN)-2015)__KX302598.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcatgcgggtccgcccgaagtgctacgggttcagccggatgatggcgaccctggaggtgaacccgcccgagcagcgcatcggccagtgcaccgggtgccacctcgagtgcatcaacggcggggtgcggctgatcacgctgacctccgagctccgcagcgccaccgtctgcgcctcccacttctgcagctccgccaccagcggcaagaagtccacggagatccacttccacagcggctccctggtggggaagaccgccatccacgtcaagggcgcgctggtggacgggaccgagttcaccttcgagggcagctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctgctcaccaacgtgctgaaggccatcggggtgtggggctcctgggtcatcgcgcccgtgaagctgatgttcgccatcatcaagaagctcatgcgcaccgtgagctgcctggtcgggaagctgatggaccggggccgccaggtgatccacgaggagatcggcgagaacggggagggcaaccaggacgacgtgcggatcgagatggcccgcccccgccgggtccgccactggatgtactccccggtgatcctcaccatcctggccatcgggctggccgagggctgcgacgagatggtgcacgcggacagcaagctcgtctcctgccggcaggggagcggcaacatgaaggagtgcatcacgaccggccgcgccctgctgcccgccgtgaaccccgggcaggaggcctgcctccacttcaccgcccccggctccccggacagcaagtgcctgaagatcaaggtgaagcggatcaacctgaagtgcaagaagtccagcagctacttcgtccccgacgcgcgctcccggtgcaccagcgtgcgccggtgccgctgggccggggactgccagtccggctgcccgccccacttcacgagcaactccttcagcgacgactgggccgggaagatggaccgggccggcctcggcttctccgggtgcagcgacggctgcgggggcgcggcctgcgggtgcttcaacgccgccccctcctgcatcttctggcgcaagtgggtggagaacccccacggcatcatctggaaggtcagcccctgcgccgcgtgggtgccgtccgccgtgatcgagctgaccatgcccagcggcgaggtccggaccttccaccccatgtccgggatccccacccaggtgttcaagggcgtgagcgtcacgtacctggggtccgacatggaggtgagcggcctcaccgacctgtgcgagatcgaggagctgaagtccaagaagctggccctcgccccgtgcaaccaggccggcatgggggtggtcggcaaggtgggggagatccagtgcagcagcgaggagtccgcgcgcaccatcaagaaggacggctgcatctggaacgccgacctggtggggatcgagctgcgggtcgacgacgccgtgtgctacagcaagatcacctccgtggaggccgtcgccaactacagcgcgatccccacgaccatcggcggcctccgcttcgagcggtcccacgacagccaggggaagatctccggcagccccctggacatcaccgccatccgcgggtccttcagcgtgaactaccggggcctgcgcctctccctgagcgagatcaccgccacgtgcaccggggaggtgaccaacgtctccggctgctacagctgcatgaccggcgccaaggtgtccatcaagctgcacagctccaagaacagcaccgcgcacgtgcgctgcaagggggacgagacggccttctccgtcctcgagggcgtgcacagctacatcgtgagcctgtccttcgaccacgccgtcgtggacgagcagtgccagctgaactgcgggggccacgagagccaggtgaccctcaaggggaacctgatcttcctggacgtccccaagttcgtggacggctcctacatgcagacctaccacagcaccgtgccgacgggcgccaacatcccctcccccaccgactggctcaacgccctgttcgggaacggcctgagccggtggatcctcggggtcatcggcgtgctgctgggcgggctcgcgctgttcttcctgatcatgttcctcctgaagctgggcaccaagcaggtcttccgctcccggaccaagctcgcctga

SEQ ID NO: 13085 - RNA, 3222 nt, synthetic construct
  misc_feature 1..3222: note = derived and/or modified CDS sequence (opt1) from SFTSV(12-Lu'an(CHN)-2014)__KX302595.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaaggtggacgggatcgtcttcaaccagtgcgacagcgagtccctcccgcagcccatcgacgtggcctggatggacgtgggccacagccacaagatcatcatgcgcgagcacaagacgaagtgggtccaggagtccagctccaaggacttcgtgtgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtccacaagcccggcgaggtggtggtcagctacgggggcatgcgggtgcgcccgaagtgctacggcttcagccggatgatggccacgctggaggtgaacccgcccgagcagcgcatcgggcagtgcaccggctgccacctcgagtgcatcaacgggggcgtccggctgatcaccctgacctccgagctcaagagcgcgacggtgtgcgcctcccacttctgcagctccgccaccagcgggaagaagtccaccgagatccagttccacagcggctccctggtcggcaaggccgccatccacgtgaagggggcgctggtggacggcaccgagttcacgttcgaggggagctgcatgttccccgacggctgcgacgccgtcgactgcaccttctgccgcgagttcctcaagaacccccagtgctaccccgccaagaagtggctgttcatcatcatcgtgatcctgctcggctacgccgggctgatgctgctcaccaacgtgctgaaggccatcggcgtctgggggtcctgggtgatggcgcccgtgaagctgatgttcgccatcatgaagaagctcatgcggagcgtctcctgcctgatgggcaagctgatggaccgcgggcgccaggtgatccacgaggagatcggcgagaaccgggagggcaaccaggacgacgtgcggatcgagatggcccgcccccgccgggtccgccactggatgtacagcccggtgatcctcaccatcctggccatcgggctggccgagggctgcgacgagatggtgcacgcggactccaagctcgtcagctgccggcaggggtccggcaacatgaaggagtgcgtgacgaccgggcgcgccctgctgcccgccgtgaaccccggccaggaggcctgcctccacttcaccgcccccggcagcccggacagcaagtgcctgaagatcaaggtcaagcggatcaacctgaagtgcaagaagtccagctcctacttcgtgcccgacgcgcgcagccggtgcacctccgtgcgccggtgccgctgggccggggactgccagagcggctgcccctcctacttcacgagcaactccttcagcgacgactgggccgggaagatggaccgggccggcctcgggttctccggctgcagcgacggctgcgggggcgcggcctgcgggtgcttcaacgccgccccgtcctgcatcttctggcgcaagtgggtcgagaacccccacggcatcatctggaaggtgagcccctgcgccgcgtgggtgccctccgccgtcatcgagctgaccatgccgagcggggaggtgcggaccttccaccccatgtccggcatccccacccaggtgttcaagggcgtcagcgtgacgtacctggggtccgacatggaggtgagcggcctcaccgacctgtgcgagatcgaggagctcaagagcaagaagctggccctggccccctgcaaccaggccgggatgggcgtcgtgggcaaggtgggggagatccagtgctccagcgaggagtccgcgcgcaccatcaagaaggacggctgcatctggaacgccgacctggtcgggatcgagctgcgggtggacgacgccgtgtgctacagcaagatcacctccgtcgaggccgtggccaactacagcgcgatcccgacgaccatcggcgggctccgcttcgagcggtcccacgacagccagggcaagatctccggcagccccctggacatcaccgccatccgcgggtccttcagcgtgaactaccggggcctgcgcctctccctgagcgagatcaccgccacgtgcaccggggaggtcaccaacgtgtccggctgctacagctgcatgaccggggccaaggtgtccatcaagctgcacagctccaagaacagcaccgcgcacgtccgctgccggggcgacgagacggccttcagcgtgctcgagggcgtgcactcctacaccgtcagcctgtccttcgaccacgccgtggtggacgagcagtgccagctgaactgcgggggccacgagagccaggtcaccctcaaggggaacctgatcttcctggacgtgcccaagttcgtggacggctcctacatgcagacctaccacagctccgtccccacgggggccaacatcccgagccccaccgactggctcaacgccctgttcggcaacggcctgtcccgctggatcctcggggtgatcggcgtcctgctgggggtgctcgcgctgttcttcctgatcatgagcctcttcaagctgggcaccaagcaggtcatccggtcccgcaccaagctggcctga

SEQ ID NO: 13086 - RNA, 3222 nt, synthetic construct
  misc_feature 1..3222: note = derived and/or modified CDS sequence (opt1) from SFTSV(14-Lu'an(CHN)-2014)__KX302596.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaaggtggacgggatcgtcttcaaccagtgcgacagcgagtccctcccgcagcccatcgacgtggcctggatggacgtgggccacagccacaagatcatcatgcgcgagcacaagacgaagtgggtccaggagtccagctccaaggacttcgtgtgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtccacaagcccggcgaggtggtggtcagctacgggggcatgcgggtgcgcccgaagtgctacggcttcagccggatgatggccacgctggaggtgaacccgcccgagcagcgcatcgggcagtgcaccggctgccacctcgagtgcatcaacgggggcgtccggctgatcaccctgacctccgagctcaagagcgcgacggtgtgcgcctcccacttctgcagctccgccaccagcgggaagaagtccaccgagatccagttccacagcggctccctggtcggcaaggccgccatccacgtgaagggggcgctggtggacggcaccgagttcacgttcgaggggagctgcatgttccccgacggctgcgacgccgtcgactgcaccttctgccgcgagttcctcaagaacccccagtgctaccccgccaagaagtggctgttcatcatcatcgtgatcctgctcggctacgccgggctgatgctgctcaccaacgtgctgaaggccatcggcgtctgggggtcctgggtgatggcgcccgtgaagctgatgttcgccatcatgaagaagctcatgcggagcgtctcctgcctgatgggcaagctgatggaccgcgggcgccaggtgatccacgaggagatcggcgagaaccgggagggcaaccaggacgacgtgcggatcgagatggcccgcccccgccgggtccgccactggatgtacagcccggtgatcctcaccatcctggccatcgggctggccgagggctgcgacgagatggtgcacgcggactccaagctcgtcagctgccggcaggggtccggcaacatgaaggagtgcgtgacgaccgggcgcgccctgctgcccgccgtgaaccccggccaggaggcctgcctccacttcaccgcccccggcagcccggacagcaagtgcctgaagatcaaggtcaagcggatcaacctgaagtgcaagaagtccagctcctacttcgtgcccgacgcgcgcagccggtgcacctccgtgcgccggtgccgctgggccggggactgccagagcggctgcccctcccacttcacgagcaactccttcagcgacgactgggccgggaagatggaccgggccggcctcgggttctccggctgcagcgacggctgcgggggcgcggcctgcgggtgcttcaacgccgccccgtcctgcatcttctggcgcaagtgggtcgagaacccccacggcatcatctggaaggtgagcccctgcgccgcgtgggtgccctccgccgtcatcgagctgaccatgccgagcggggaggtgcggaccttccaccccatgtccggcatccccacccaggtgttcaagggcgtcagcgtgacgtacctggggtccgacatggaggtgagcggcctcaccgacctgtgcgagatcgaggagctcaagagcaagaagctggccctggccccctgcaaccaggccgggatgggcgtcgtgggcaaggtgggggagatccagtgctccagcgaggagtccgcgcgcaccatcaagaaggacggctgcatctggaacgccgacctggtcgggatcgagctgcgggtggacgacgccgtgtgctacagcaagatcacctccgtcgaggccgtggccaactacagcgcgatcccgacgaccatcggcgggctccgcttcgagcggtcccacgacagccagggcaagatctccggcagccccctggacatcaccgccatccgcgggtccttcagcgtgaactaccggggcctgcgcctctccctgagcgagatcaccgccacgtgcaccggggaggtcaccaacgtgtccggctgctacagctgcatgaccggggccaaggtgtccatcaagctgcacagctccaagaacagcaccgcgcacgtccgctgccggggcgacgagacggccttcagcgtgctcgagggcgtgcactcctacaccgtcagcctgtccttcgaccacgccgtggtggacgagcagtgccagctgaactgcgggggccacgagagccaggtcaccctcaaggggaacctgatcttcctggacgtgcccaagttcgtggacggctcctacatgcagacctaccacagctccgtccccacgggggccaacatcccgagccccaccgactggctcaacgccctgttcggcaacggcctgtcccgctggatcctcggggtgatcggcgtcctgctgggggtgctcgcgctgttcttcctgatcatgagcctcttcaagctgggcaccaagcaggtcttccggtcccgcaccaagctggcctga

SEQ ID NO: 13087 - RNA, 3222 nt, synthetic construct
  misc_feature 1..3222: note = derived and/or modified CDS sequence (opt1) from SFTSV(18-Lu'an(CHN)-2015)__KX302599.1__GP
  source 1..3222: mol_type = other RNA
atgatgaaggtgatctggttcttcagcctgatctgcttcgtcatccagtgctccggcgacagcgggcccatcatctgcgccggcccgatccactccaacaagagcgccgacatcccccacctcctggggtactccgagaagatctgccagatcgaccgcctgatccacgtgagctcctggctccggaaccacagccagttccagggctacgtggggcagcgcggcggccggtcccaggtcagctactaccccgcggagaactcctacagccgctggtccgggctgctgagcccctgcgacgccgactggctcggcatgctggtggtgaagaaggccaaggggtccgacatgatcgtcccgggccccagctacaaggggaaggtgttcttcgagcggcccaccttcgacggctacgtgggctgggggtgcggctccggcaagagccgcaccgagtccggggagctgtgcagcagcgactccggcacgagctccgggctcctgcccagcgaccgggtcctgtggatcggcgacgtggcctgccagccgatgacccccatccccgaggagaccttcctcgagctgaagtccttcagccagtccgagttccccgacatctgcaagatcgacgggatcgtgttcaaccagtgcgagggcgagagcctgccgcagcccttcgacgtcgcctggatggacgtggggcactcccacaagatcatcatgcgcgagcacaagaccaagtgggtgcaggagagctccagcaaggacttcgtctgctacaaggagggcacgggcccctgctccgagagcgaggagaagacctgcaagacctccgggagctgccggggcgacatgcagttctgcaaggtggcggggtgcgagcacggcgaggaggcctccgaggccaagtgccgctgcagcctcgtgcacaagcccggggaggtcgtggtgtcctaccggggcatgcgcatccggccgaagtgctacggcttcagccgcatgatggccaccctggaggtcaaccagcccgagcagcggatcgggcagtgcacgggctgccacctggagtgcatcaacgggggcgtgcgcctcatcaccctgaccagcgagctgaagtccgcgaccgtgtgcgccagccacttctgctccagcgccacgtccgggaagaagtccaccgagatccagttccactccggcagcctcgtcggcaagaccgccatccacgtgaagggggccctggtcgacggcaccgagttcacgttcgaggggtcctgcatgttccccgacggctgcgacgcggtggactgcaccttctgccgggagttcctgaagaacccccagtgctacccggccaagaagtggctgttcatcatcatcgtgatcctgctgggctacgccgggctcatgctgctgaccaacgtcctcaaggccatcggcatctgggggagctgggtgatcgcccccgtgaagctgatcttcgcgatcatcaagaagctgatgcgcaccgtctcctgcctcatgggcaagctgatggaccgggggcgccaggtgatccacgaggagatcggcgagaaccgggagggcaaccaggacgacgtgcgcatcgagatggcccgcccccggcgcgtccggcactggatgtacagccccgtgatcctgacgatcctcgccatcgggctggccgagggctgcgacgagatggtgcacgccgactccaagctggtcagctgccgccaggggtccggcaacgtgaaggagtgcgtgaccaccgggcgggcgctcctgccggccgtcaaccccggccaggaggcctgcctgcacttcaccgcccccggcagccccgactccaagtgcctcaagatccgcgtgaagcggatcaacctgaagtgcaagaagtccagcagctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccatcacctacctggggagcgacatggaggtgtccggcctgaccgacctctgcgagatcgaggagctcaagagcaagaagctggccctggccccctgcaaccaggccgggatgggcgtcgtgggcaaggtgggggagatccagtgctccagcgaggagagcgcccgcaccatcaagaaggacggctgcatctggaacgcggacctcgtcgggatcgagctgcgggtggacgacgccgtgtgctactccaagatcacgagcgtcgaggccgtggccaactactccgccatcccgaccaccatcggcgggctgcgcttcgagcggagccacgactcccagggcaagatcagcggcagccccctcgacatcaccgcgatccgcgggagcttctccgtgaactaccgcggcctgcggctgagcctctccgagatcacggcgacctgcaccggggaggtcaccaacgtgagcggctgctactcctgcatgaccggggccaaggtgagcatcaagctgcactccaacaagaacagcacggcccacgtccgctgcaagggcgacgagaccgccttctccgtgctggagggcgtgcacagctacaccgtctccctcagcttcgaccacgccgtggtggacgagcagtgccagctgaactgcgggggccacgagagccaggtcaccctgaaggggaacctcatcttcctggacgtgcccaagttcgtggacggctcctacatgcagacgtaccacagcaccgtccccaccggggccaacatcccgtcccccaccgactggctgaacgccctcttcggcaacggcctgagccggtggatcctgggggtgatcggcgtgctcctcgggggcctggccctgttcttcatgatcatgtccctgttcaagctgggcacgaagcaggtcttccgcagccggaccaagctcgcgtga

SEQ ID NO: 13088 - RNA, 3222 nt, synthetic construct
  misc_feature 1..3222: note = derived and/or modified CDS sequence (opt1) from SFTSV(27-Lu'an(CHN)-2015)__KX302600.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcggatccgcccgaagtgctacgggttcagccggatgatggccaccctggaggtcaaccagcccgagcagcgcatcggccagtgcacggggtgccacctggagtgcatcaacggcggggtgcggctcatcaccctgacctccgagctcaagagcgcgaccgtgtgcgcctcccacttctgcagctccgccacgagcggcaagaagtccaccgagatccagttccacagcggctccctcgtcgggaagaccgccatccacgtgaagggcgccctggtcgacgggaccgagttcacgttcgagggcagctgcatgttccccgacggctgcgacgcggtggactgcaccttctgccgcgagttcctgaagaacccccagtgctacccggccaagaagtggctgttcatcatcatcgtgatcctgctggggtacgccggcctcatgctgctgaccaacgtcctcaaggccatcgggatctggggctcctgggtgatcgcccccgtgaagctgatcttcgcgatcatcaagaagctgatgcggaccgtcagctgcctcatggggaagctgatggaccgcggccgccaggtgatccacgaggagatcggcgagaaccgggaggggaaccaggacgacgtgcggatcgagatggcccgcccccgccgggtccgccactggatgtactcccccgtgatcctgacgatcctcgccatcggcctggccgagagctgcgacgagatggtgcacgccgactccaagctggtcagctgccggcaggggtccggcaacatgaaggagtgcgtgaccaccgggcgcgcgctcctgccggccgtgaaccccggccaggaggcctgcctgcacttcaccgcccccggcagccccgacagcaagtgcctcaagatcaaggtcaagcggatcaacctgaagtgcaagaagtccagctcctacttcgtgccggacgcccgcagccggtgcacgtccgtgcgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtcgagaacccccacggcatcatctggaaggtgtccccctgcgccgcctgggtgcccagcgcggtcatcgagctcaccatgccgtccggggaggtgcggaccttccaccccatgagcggcatccccacccaggtgttcaagggcgtctccgtgacctacctggggagcgacatggaggtgtccggcctgaccgacctctgcgagatcgaggagctcaagagcaagaagctggccctggccccctgcaaccaggccgggatgggcgtcgtgggcaaggtgggggagatccagtgcagctccgaggagagcgcccgcaccatcaagaaggacggctgcatctggaacgcggacctggtcgggatcgagctgcgggtggacgacgccgtgtgctactccaagatcacgagcgtcgaggccgtggccaactactccgccatcccgaccaccatcggcgggctgcgcttcgagcggagccacgactcccagggcaagatcagcggcagccccctcgacatcaccgcgatccgcgggagcttctccgtgaactaccggggcctgcgcctgagcctctccgagatcacggccacgtgcaccggggaggtcaccaacgtgagcggctgctactcctgcatgaccggggccaaggtgagcatcaagctgcactccagcaagaactccacggcccacgtccgctgcaagggcgacgagaccgcgttcagcgtgctggagggcgtgcacagctacaccgtctccctcagcttcgaccacgccgtggtggacgagcagtgccagctgaactgcgggggccacgagtcccaggtcaccctgaaggggaacctcatcttcctggacgtgcccaagttcgtggacggcagctacatgcagacgtaccactccaccgtccccaccggggccaacatcccgagccccaccgactggctgaacgccctcttcggcaacggcctgtcccggtggatcctgggggtgatcggcgtgctcctcgggggcctggccctgttcttcatgatcatgagcctgttcaagctgggcacgaagcaggtcttccgctcccggaccaagctcgcgtga

SEQ ID NO: 13089 - RNA, 3222 nt, synthetic construct
  misc_feature 1..3222: note = derived and/or modified CDS sequence (opt1) from SFTSV(36-Lu'an(CHN)-2015)__KX302601.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatgttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtggtcctgacgatcctcgccatcggcctggccgagagctgcgacgagatggtgcacgccgactccaagctggtgagctgccggcaggggtccggcaacatgaaggagtgcgtcaccaccgggcgcgcgctcctgccggccgtgaaccccggccaggaggcctgcctgcacttcaccgcccccggcagccccgacagcaagtgcctcaagatcaaggtgaagcggatcaacctgaagtgcaagaagtccagctcctacttcgtcccggacgcccgcagccggtgcacgtccgtgcgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtctccccctgcgccgcctgggtgcccagcgcggtgatcgagctcaccatgccgtccggggaggtccggaccttccaccccatgagcggcatccccacccaggtgttcaagggcgtgtccgtcacctacctggggagcgacatggaggtgtccggcctgaccgacctctgcgagatcgaggagctcaagagcaagaagctggccctggccccctgcaaccaggccgggatgggcgtggtcggcaaggtgggggagatccagtgcagctccgaggagagcgcccgcaccatcaagaaggacggctgcatctggaacgcggacctggtggggatcgagctgcgggtcgacgacgccgtgtgctactccaagatcacgagcgtggaggccgtcgccaactactccgccatcccgaccaccatcggcgggctgcgcttcgagcggagccacgactcccagggcaagatcagcggcagccccctcgacatcaccgcgatccgcgggagcttctccgtgaactaccggggcctgcgcctgagcctctccgagatcacggccacgtgcaccggggaggtgaccaacgtcagcggctgctactcctgcatgaccggggccaaggtgagcatcaagctgcactccagcaagaactccacggcccacgtgcgctgcaagggcgacgagaccgcgttcagcgtcctggagggcgtgcacagctacaccgtgtccctcagcttcgaccacgccgtcgtggacgagcagtgccagctgaactgcgggggccacgagtcccaggtgaccctgaaggggaacctcatcttcctggacgtccccaagttcgtggacggcagctacatgcagacgtaccactccaccgtgcccaccggggccaacatcccgagccccaccgactggctgaacgccctcttcggcaacggcctgtcccggtggatcctgggggtcatcggcgtgctcctcgggggcctggccctgttcttcatgatcatgagcctgttcaagctgggcacgaagcaggtcttccgctcccggaccaagctcgcgtga

SEQ ID NO: 13090 - RNA, 3222 nt, synthetic construct
  misc_feature 1..3222: note = derived and/or modified CDS sequence (opt1) from SFTSV(42-Lu'an(CHN)-2015)__KX302602.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggttcagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggccggatgcgcgtccggccgaagtgctacggcttcagccgcatgatggccaccctggaggtgaaccagcccgagcagcggatcgggcagtgcacgggctgccacctggagtgcatcaacgggggcgtgcgcctcatcaccctgacctccgagctcaagagcgcgaccgtctgcgcctcccacttctgcagctccgccacgagcgggaagaagtccaccgagatccagttccacagcggctccctggtgggcaagaccgccatccacgtcaagggggccctggtggacggcaccgagttcacgttcgaggggagctgcatgttccccgacggctgcgacgcggtggactgcaccttctgccgggagttcctgaagaacccccagtgctacccggccaagaagtggctgttcatcatcatcgtcatcctgctgggctacgccgggctcatgctgctgaccaacgtgctcaaggccatcggcatctgggggtcctgggtgatcgcccccgtcaagctgatcttcgcgatcatcaagaagctgatgcgcaccgtgagctgcctcatgggcaagctgatggaccgggggcgccaggtgatccacgaggagatcggcgagaaccgggagggcaaccaggacgacgtccgcatcgagatggcccgcccccggcgcgtgcggcactggatgtactcccccgtgatcctgacgatcctcgccatcgggctggccgagagctgcgacgagatggtccacgccgactccaagctggtgagctgccgccagggctccgggaacatgaaggagtgcgtgaccaccggccgggcgctcctgccggccgtcaaccccgggcaggaggcctgcctgcacttcaccgcccccggcagccccgacagcaagtgcctcaagatcaaggtgaagcgcatcaacctgaagtgcaagaagtccagctcctacttcgtgccggacgcccggagccgctgcacgtccgtccggcgctgccggtgggcgggcgactgccagagcgggtgcccgccccacttcacctccaacagcttctccgacgactgggccggcaagatggaccgcgccgggctgggcttcagcgggtgctccgacggctgcggcggggccgcgtgcggctgcttcaacgccgcccccagctgcatcttctggcggaagtgggtggagaacccccacgggatcatctggaaggtgtccccctgcgccgcctgggtccccagcgcggtgatcgagctcaccatgccgtccggcgaggtgcgcaccttccaccccatgagcgggatccccacgcaggtcttcaagggcgtgtccgtgacctacctgggcagcgacatggaggtctccgggctgaccgacctctgcgagatcgaggagctcaagagcaagaagctggccctggccccctgcaaccaggccggcatgggggtggtgggcaaggtcggcgagatccagtgcagctccgaggagagcgcccggaccatcaagaaggacgggtgcatctggaacgcggacctggtgggcatcgagctgcgcgtggacgacgccgtctgctactccaagatcacgagcgtggaggccgtgtccaactacagcgccatcccgaccaccatcgggggcctgcggttcgagcgctcccacgacagccaggggaagatctccggcagccccctcgacatcaccgccatccggggctccttcagcgtcaactaccgcgggctgcgcctgtccctcagcgagatcacggcgacctgcaccggcgaggtgaccaacgtgtccgggtgctacagctgcatgaccggcgccaaggtctccatcaagctgcacagctccaagaacagcacggcccacgtgcggtgcaagggggacgagaccgccttcagcgtgctggagggcgtccactcctacaccgtgagcctctccttcgaccacgcggtggtcgacgagcagtgccagctgaactgcggcgggcacgagagccaggtgaccctgaagggcaacctcatcttcctggacgtgcccaagttcgtcgacgggtcctacatgcagacgtaccacagcaccgtgcccaccggcgccaacatcccgtcccccaccgactggctgaacgccctcttcgggaacggcctgagccgctggatcctgggcgtgatcggggtcctcctgggcgggctggccctcttcttcatgatcatgtccctgttcaagctgggcacgaagcaggtcttccggagccgcaccaagctcgcctga

SEQ ID NO: 13091 - RNA, 3222 nt, synthetic construct
  misc_feature 1..3222: note = derived and/or modified CDS sequence (opt1) from SFTSV(44-Lu'an(CHN)-2015)__KX302603.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggttcagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtgtccaactacagcgccatcccgaccaccatcggcgggctgcgcttcgagcggtcccacgacagccagggcaagatctccggcagccccctcgacatcaccgccatccgcgggtccttcagcgtcaactaccggggcctgcgcctgtccctcagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttcagcgtgctggagggcgtccactcctacaccgtgagcctctccttcgaccacgcggtggtcgacgagcagtgccagctgaactgcgggggccacgagagccaggtgaccctgaaggggaacctcatcttcctggacgtgcccaagttcgtcgacggctcctacatgcagacgtaccacagcaccgtgcccaccggggccaacatcccgtcccccaccgactggctgaacgccctcttcggcaacggcctgagccggtggatcctgggggtgatcggcgtcctcctcgggggcctggccctgttcttcatgatcatgtccctgttcaagctgggcacgaagcaggtcttccgcagccggaccaagctcgcctga

SEQ ID NO: 13092 - RNA, 3222 nt, synthetic construct
  misc_feature 1..3222: note = derived and/or modified CDS sequence (opt1) from SFTSV(52-Lu'an(CHN)-2015)__KX302604.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagcgctccagctcctacttcgtgccggacgcccggagccgctgcacgtccgtccggcgctgccggtgggcgggggactgccagagcggctgcccgccccacttcacctccaacagcttctccgacgactgggccgggaagatggaccgcgccggcctggggttcagcggctgctccgacggctgcgggggcgccgcgtgcgggtgcttcaacgccgcccccagctgcatcttctggcggaagtgggtggagaacccccacggcatcatctggaaggtgtccccctgcgccgcctgggtccccagcgcggtgatcgagctcaccatgccgtccggggaggtgcgcaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccggaccatcaagaaggacggctgcatctggaacgcggacctggtggggatcgagctgcgcgtggacgacgccgtctgctactccaagatcacgagcgtggaggccgtggccaactactccgccatcccgaccaccatcggcgggctgcggttcgagcgcagccacgactcccagggcaagatcagcggcagccccctcgacatcaccgcgatccgggggagcttctccgtcaactaccgcggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcggtgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcctgtcccgctggatcctgggggtgatcggcgtcctcctcgggggcctggccctgttcttcatgatcatgagcctgttcaagctgggcacgaagcaggtcttccggtcccgcaccaagctcgcgtga

SEQ ID NO: 13093 - RNA, 3222 nt, synthetic construct
  misc_feature 1..3222: note = derived and/or modified CDS sequence (opt1) from SFTSV(HL/Injected)__KF791953.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgagccagcccgagcagcgcatcgggcagtgcaccggctgccacctcgagtgcatcaacgggggcgtgcggctgatcaccctgaccagcgagctcaagtccgcgacggtctgcgccagccacttctgctccagcgccacctccggcaagaagtccaccgagatccagttccactccgggagcctggtgggcaagaccgccatccacgtcaagggggccctggtggacggcacggagttcaccttcgagggctcctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggagctgggtcatcgcccccgtgaagctggtgttcgcgatcatcaagaagctcatgcgggccgtctcctgcctgatgggcaagctgatggaccgcggccgccaggtgatccacgaggagatcggggagaaccgggagggcaaccaggacgacgtgcggatcgagatggcccgcccccgccgggtccgccactggatgtacagccccgtgatcctcacgatcctggccatcgggctggccgagggctgcgacgagatggtgcacgcggactccaagctcgtcagctgccggcaggggtccggcaacatgaaggagtgcgtgaccaccggccgcgccctgctgccggccgtgaaccccgggcaggaggcctgcctccacttcaccgcccccggcagccccgactccaagtgcctgaagatcaaggtcaagcggatcaacctgaagtgcaagaagtccagcagctacttcgtgccggacgcgcgcagccggtgcacgtccgtgcgccggtgccgctgggccggggactgccagagcggctgcccgccccacttcacctccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtcgagaacccccacggcatcatctggaaggtgtccccctgcgccgcgtgggtgcccagcgccgtcatcgagctgaccatgccgtccggcgaggtgcggaccttccaccccatgagcgggatccccacccaggtgttcaagggcgtctccgtgacctacctggggagcgacatggaggtgtccggcctcaccgacctgtgcgagatcgaggagctcaagagcaagaagctggccctggccccctgcaaccaggccggcatgggggtcgtgggcaaggtgggggagatccagtgctccagcgaggagagcgcgcgcaccatcaagaaggacggctgcatctggaacgccgacctggtcgggatcgagctgcgggtggacgacgccgtgtgctactccaagatcacgagcgtcgaggccgtggccaactactccgcgatcccgaccaccatcggcggcctccgcttcgagcggagccacgactcccaggggaagatcagcggcagccccctggacatcaccgccatccgcgggagcttctccgtgaactaccggggcctgcgcctcagcctgtccgagatcacggccacgtgcaccggggaggtcaccaacgtgagcggctgctactcctgcatgaccggcgccaaggtgagcatcaagctgcactccagcaagaactccacggcgcacgtccgctgcaagggggacgagaccgccttcagcgtgctcgagggcgtgcactcctacagcgtcagcctgtccttcgaccacgccgtggtggacgagcagtgccagctgaactgcgggggccacgagagccaggtcaccctccgggggaacctgatcttcctggacgtgcccaagttcgtggacggctcctacatgcagacctaccacagcacggtccccaccggcgccaacatcccgtcccccaccgactggctcaacgccctgttcgggaacggcctgagccgctggatcctcggggtgatcggcgtcctgctgggcgggctcgcgctgttcttcctgatcatgtccctcttcaagctgggcaccaagcagatcttccggagccgcacgaagctggcctga

SEQ ID NO: 13094 - RNA, 3222 nt, synthetic construct
  misc_feature 1..3222: note = derived and/or modified CDS sequence (opt1) from SFTSV(HL/Larvae/G2)__KF791955.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagccggacctccagcgggctgctgccctccgaccgcgtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgggagcacaagacgaagtgggtgcaggagtccagctccaaggacttcgtctgctacaaggagggcaccggcccctgcagcgagtccgaggagaagacctgcaagaccagcgggtcctgccgcggcgacatgcagttctgcaaggtggcggggtgcgagcacggcgaggaggccagcgaggccaagtgccggtgctccctggtgcacaagcccggggaggtcgtggtgagctacggcggcatgcgcgtccggccgaagtgctacgggttctcccgcatgatggccacgctggaggtgagccagcccgagcagcggatcggccagtgcaccgggtgccacctcgagtgcatcaacggcggggtgcgcctgatcaccctgaccagcgagctcaagtccgcgacggtctgcgccagccacttctgctccagcgccacctccggcaagaagtccaccgagatccagttccactccggcagcctggtggggaagaccgccatccacgtcaagggcgccctggtggacgggacggagttcaccttcgagggctcctgcatgttccccgacggctgcgacgcggtggactgcaccttctgccgggagttcctcaagaacccccagtgctacccggccaagaagtggctgttcatcatcatcgtcatcctgctcgggtacgccggcctgatgctgctcaccaacgtgctgaaggccatcggggtgtggggcagctgggtcatcgcccccgtgaagctggtgttcgcgatcatcaagaagctcatgcgcgccgtctcctgcctgatggggaagctgatggaccggggccgccaggtgatccacgaggagatcggcgagaaccgggaggggaaccaggacgacgtgcgcatcgagatggcccgcccccggcgcgtccggcactggatgtacagccccgtgatcctcacgatcctggccatcggcctggccgaggggtgcgacgagatggtgcacgcggactccaagctcgtcagctgccgccagggctccgggaacatgaaggagtgcgtgaccaccggccgggccctgctgccggccgtgaaccccggccaggaggcctgcctccacttcaccgcccccgggagccccgactccaagtgcctgaagatcaaggtcaagcgcatcaacctgaagtgcaagaagtccagcagctacttcgtgccggacgcgcggagccgctgcacgtccgtgcggcgctgccggtgggccggcgactgccagagcgggtgcccgccccacttcacctccaacagcttctccgacgactgggccggcaagatggaccgcgccgggctcggcttcagcggctgctccgacgggtgcggcggggcggcctgcggctgcttcaacgccgcccccagctgcatcttctggcggaagtgggtcgagaacccccacgggatcatctggaaggtgtccccctgcgccgcgtgggtgcccagcgccgtcatcgagctgaccatgccgtccggcgaggtgcgcaccttccaccccatgagcggcatccccacccaggtgttcaagggggtctccgtgacctacctgggcagcgacatggaggtgtccgggctcaccgacctgtgcgagatcgaggagctcaagagcaagaagctggccctggccccctgcaaccaggccggcatgggcgtcgtggggaaggtgggcgagatccagtgctccagcgaggagagcgcgcggaccatcaagaaggacgggtgcatctggaacgccgacctggtcggcatcgagctgcgcgtggacgacgccgtgtgctactccaagatcacgagcgtcgaggccgtggccaactactccgcgatcccgaccaccatcgggggcctccggttcgagcgcagccacgactcccagggcaagatcagcgggagccccctggacatcaccgccatccggggcagcttctccgtgaactaccgcgggctgcgcctcagcctgtccgagatcacggccacgtgcaccggcgaggtcaccaacgtgagcgggtgctactcctgcatgaccggcgccaaggtgagcatcaagctgcactccagcaagaactccacggcgcacgtccggtgcaagggcgacgagaccgccttcagcgtgctcgagggggtgcactcctacagcgtcagcctgtccttcgaccacgccgtggtggacgagcagtgccagctgaactgcggcgggcacgagagccaggtcaccctccgcggcaacctgatcttcctggacgtgcccaagttcgtggacgggtcctacatgcagacctaccacagcacggtccccaccggcgccaacatcccgtcccccaccgactggctcaacgccctgttcggcaacgggctgagccggtggatcctcggcgtgatcggggtcctgctgggcggcctcgcgctgttcttcctgatcatgtccctcttcaagctggggaccaagcagatcttccgcagccggacgaagctggcctga

SEQ ID NO: 13095 - RNA, 3222 nt, synthetic construct
  misc_feature 1..3222: note = derived and/or modified CDS sequence (opt1) from SFTSV(JS2011-004)__KC505124.1__GP
  source 1..3222: mol_type = other RNA
atgatgaaggtgatctggttcagctccctgatctgcctcgtgatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgggggcgagtccctgccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggcgaggtcgtggtgagctacgggggcatgcgggtccgcccgaagtgctacgggttctcccggatgatggccacgctggaggtgaaccagcccgagcagcgcatcggccagtgcaccgggtgccacctcgagtgcatcaacggcggcgtgcggctgatcaccctgaccagcgagctcaagagcgcgacggtctgcgcctcccacttctgcagctccgccaccagcgggaagaagtccaccgagatccagttccacagcggctccctggtggggaagaccgccatccacgtcaagggcgccctggtggacggcacggagttcaccttcgaggggagctgcatgttccccgacggctgcgacgcggtggactgcaccttctgccgcgagttcctcaagaacccccagtgctacccggccaagaagtggctgttcatcatcatcgtcatcctgctcgggtacgccggcctgatgctgctcaccaacgtgctgaaggccatcggggtgtggggctcctgggtcatcgcccccgtgaagctggtgttcgcgatcatgaagaagctcatgcgggccgtcagctgcctgatgggcaagctgatggaccgcgggcgccaggtgatccacgaggagatcggcgagaaccgggaggggaaccaggacgacgtgcggatcgagatggcccgcccccgccgggtccgccactggatgtactcccccgtgatcctcacgatcctggccatcggcctggccgaggggtgcgacgagatggtgcacgcggacagcaagctcgtctcctgccggcagggcagcggcaacatgaaggagtgcgtgaccaccgggcgcgccctgctgccggccgtgaaccccggccaggaggcctgcctccacttcaccgcccccgggtcccccgacagcaagtgcctgaagatcaaggtcaagcggatcaacctgaagtgcaagaagtccagcagctacttcgtgccggacgcgcgctcccggtgcacgagcgtgcgccggtgccgctgggccggcgactgccagtccgggtgcccgccccacttcaccagcaactccttcagcgacgactgggccggcaagatggaccgggccggcctcgggttctccggctgcagcgacgggtgcggcggggcggcctgcggctgcttcaacgccgccccctcctgcatcttctggcgcaagtgggtcgagaacccccacggcatcatctggaaggtgagcccctgcgccgcgtgggtgccctccgccgtcatcgagctgaccatgccgagcggggaggtgcggaccttccaccccatgtccggcatccccacccaggtgttcaagggggtcagcgtgacctacctgggctccgacatggaggtgagcggcctcaccgacctgtgcgagatcgaggagctgaagtccaagaagctggccctcgccccctgcaaccaggccgggatgggcgtcgtggggaaggtgggcgagatccagtgcagctccgaggagagcgcgcgcaccatcaagaaggacgggtgcatctggaacgccgacctggtcggcatcgagctgcgggtggacgacgccgtgtgctacagcaagatcacgtccgtcgaggccgtggccaactacagcgcgatcccgaccaccatcggcgggctccgcttcgagcggtcccacgacagccagggcaagatctccgggagccccctggacatcaccgccatccgcggctccttcagcgtgaactaccgggggctgcgcctctccctgagcgagatcacggccacgtgcaccggcgaggtcaccaacgtgtccggctgctacagctgcatgaccggggccaaggtgtccatcaagctgcacagctccaagaacagcacggcgcacgtccgctgcaagggcgacgagaccgccttctccgtgctcgagggggtgcacagctactccgtcagcctgagcttcgaccacgccgtggtggacgagcagtgccagctgaactgcggcgggcacgagtcccacgtcaccctcaagggcaacctgatcttcctggacgtgcccaagttcgtggacggcagctacatgcagacctaccactccacggtccccaccggggccaacatcccgagccccaccgactggctcaacgccctgttcggcaacgggctgtcccggtggatcctcggcgtgatcggcgtcctgctcgggggcctggcgctgttcttcctgatcatgagcctcttcaagctggggaccaagcaggtcttccgctcccggacgaagctggcctga

SEQ ID NO: 13096 - RNA, 3222 nt, synthetic construct
  misc_feature 1..3222: note = derived and/or modified CDS sequence (opt1) from SFTSV(JS2011-013-1)__KC505127.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcctgggccagtgcacggggtgccacctcgagtgcatcaacggcggggtgcggctgatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgcgagttcctcaagaacccccagtgctacccggccaagaagtggctgttcatcatcatcgtcatcctgctcgggtacgccggcctgatgctgctcaccaacgtgctgaaggccatcgggatctggggctcctgggtgatcgcccccgtcaagctgatgttcgcgatcatcaagaagctcatgcggaccgtgagctgcctgatgcgcaagctgatggaccgggggcgccaggtgatccacgaggagatcggcgagaaccgggagggcaaccaggacgacgtccgcatcgagatggcccgcccccggcgcgtgcggcactggatgtactcccccgtgatcctcacgatcctggccatcgggctggccgagagctgcgacgagatggtccacgccgactccaagctcgtgagctgccgccagggctccgggaacatgaaggagtgcgtgaccaccggccgggcgctgctgccggccgtcaaccccgggcaggaggcctgcctccacttcaccgcccccggcagccccgacagcaagtgcctgaagatcaaggtgaagcgcatcaacctgaagtgcaagaagtccagctcctacttcgtgccggacgcccggagccgctgcacgtccgtccggcgctgccggtgggcgggcgactgccagagcgggtgcccgccccacttcacctccaacagcttctccgacgactgggccggcaagatggaccgcgccgggctcggcttcagcgggtgctccgacggctgcggcggggccgcgtgcggctgcttcaacgccgcccccagctgcatcttctggcggaagtgggtggagaacccccacgggatcatctggaaggtgtccccctgcgccgcctgggtccccagcgcggtgatcgagctgaccatgccgtccggcgaggtgcgcaccttccaccccatgagcgggatccccacgcaggtcttcaagggcgtgtccgtgacctacctgggcagcgacatggaggtctccgggctcaccgacctgtgcgagatcgaggagctcaagagcaagaagctggccctggccccctgcaaccaggccggcatgggggtggtgggcaaggtcggcgagatccagtgcagctccgaggagagcgcccggaccatcaagaaggacgggtgcatctggaacgcggacctggtgggcatcgagctgcgcgtggacgacgccgtctgctactccaagatcacgagcgtggaggccgtggccaactactccgccatcccgaccaccatcgggggcctccggttcgagcgcagccacgactcccaggggaagatcagcggcagccccctggacatcaccgcgatccggggcagcttctccgtcaagtaccgcgggctgcgcctcagcctgtccgagatcacggcgacctgcaccggcgaggtgaccaacgtgagcgggtgctactcctgcatgaccggcgccaaggtcagcatcaagctgcactccagcaagaactccacggcccacgtgcggtgcaagggggacgagaccgccttcagcgtgctcgagggcggccacagctacaccgtctccctgagcttcgaccacgccgtggtggacgagcagtgccagctgaactgcgggggccacgagtcccaggtcaccctcaaggggaacctgatcttcctggacgtgcccaagttcgtggacggcagctacatgcagacgtaccactccaccgtccccaccggggccaacatcccgagccccaccgactggctcaacgccctgttcggcaacggcctgtcccgctggatcctcggggtgatcggcgtgctgctcgggggcctggccctgttcttcatgatcatgagcctgttcaagctcggcacgaagcaggtcttccggtcccgcaccaagctggcgtga

SEQ ID NO: 13097 - RNA, 3222 nt, synthetic construct
  misc_feature 1..3222: note = derived and/or modified CDS sequence (opt1) from SFTSV(JS2011-027)__KC505130.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgaacgagcccgagcagcgcatcgggcagtgcaccggctgccacctcgagtgcatcagcgggggcgtgcggctgatcaccctgaccagcgagctcaagtccgcgacggtctgcgccagccacttctgctccagcgccacctccggcaagaagtccaccgagatccagttccactccgggagcctggtgggcaagaccgccatccacgtcaagggggccctggtggacggcacggagttcaccttcgagggctcctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggagctgggtcatcgcccccgtgaagctggtgttcgcgatcatcaagaagctcatgcgggccgtctcctgcctgatgggcaagctgatggaccgcggccgccaggtgatccacgaggagatcggggagaaccgggagggcaaccaggacgacgtgcggatcgagatggcccgcccccgccgggtccgccactggatgtacagccccgtgatcctcacgatcctggccatggggctggccgagggctgcgacgagatggtgcacgcggactccaagctcgtcagctgccggcaggggtccggcaacatgaaggagtgcgtgaccaccggccgcgccctgctgccggccgtgaaccccgggcaggaggcctgcctccacttcaccgcccccggcagccccgactccaagtgcctgaagatcaaggtcaagcggatcaacctgaagtgcaagaagtccagcagctacttcgtgccggacgcgcgcagccggtgcacgtccgtgcgccggtgccgctgggccggggactgccagagcggctgcccgccccacttcacctccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtcgagaacccccacggcatcatctggaaggtgtccccctgcgccgcgtgggtgcccagcgccgtcatcgagctgaccatgccgtccggcgaggtgcggaccttccaccccatgagcgggatccccacccaggtgttcaagggcgtctccgtgacctacctggggagcgacatggaggtgtccggcctcaccgacctgtgcgagatcgaggagctcaagagcaagaagctggccctggccccctgcaaccaggccggcatgggggtcgtgggcaaggtgggggagatccagtgctccagcgaggagagcgcgcgcaccatcaagaaggacggctgcatctggaacgccgacctggtcgggatcgagctgcgggtggacgacgccgtgtgctactccaagatcacgagcgtcgaggccgtggccaactactccgcgatcccgaccaccatcggcggcctccgcttcgagcggagccacgactcccaggggaagatcagcggcagccccctggacatcaccgccatccgcgggagcttctccatcaactaccggggcctgcgcctcagcctgtccgagatcacggccacgtgcaccggggaggtgaccaacgtcagcggctgctactcctgcatgaccggcgccaaggtgagcatcaagctgcactccagcaagaactccacggcgcacgtgcgctgcaagggggacgagaccgccttcagcgtcctcgagggcgtgcactcctacagcgtgagcctgtccttcgaccacgccgtcgtggacgagcagtgccagctgaactgcgggggccacgagagccaggtgaccctccgggggaacctgatcttcctggacgtccccaagttcgtggacggctcctacatgcagacctaccacagcacggtgcccaccggcgccaacatcccgtcccccaccgactggctcaacgccctgttcgggaacggcctgagccgctggatcctcggggtcatcggcgtgctgctgggcgggctcgcgctgttcttcctgatcatgtccctcttcaagctgggcaccaagcaggtcttccggagccgcacgaagctggcctga

SEQ ID NO: 13098 - RNA, 3222 nt, synthetic construct
  misc_feature 1..3222: note = derived and/or modified CDS sequence (opt1) from SFTSV(JS2011-034)__KC505133.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcggatccgcccgaagtgctacgggttcagccggatgatggccaccctggaggtcaaccagcccgagcagcgcatcggccagtgcacggggtgccacctggagtgcatcaacggcggggtgcggctcatcaccctgacctccgagctcaagagcgcgaccgtgtgcgcctcccacttctgcagctccgccacgagcggcaagaagtccaccgagatccagttccacagcggctccctcgtcgggaagaccgccatccacgtgaagggcgccctggtcgacgggaccgagttcacgttcgagggcagctgcatgttccccgacggctgcgacgcggtggactgcaccttctgccgcgagttcctgaagaacccccagtgctacccggccaagaagtggctgttcatcatcatcgtgatcctgctggggtacgccggcctcatgctgctgaccaacgtcctcaaggccatcgggatctggggctcctgggtgatcgcccccgtgaagctgatgttcgcgatcatcaagaagctgatgcggaccgtcagctgcctcatggggaagctgatggaccgcggccgccaggtgatccacgaggagatcggcgagaaccgggaggggaaccaggacgacgtgcggatcgagatggcccgcccccgccgggtccgccactggatgtactcccccgtgatcctgacgttcctcgccatcggcctggccgagagctgcgacgagatggtgcacgccgactccaagctggtcagctgccggcaggggtccggcaacatgaaggagtgcgtgaccaccgggcgcgcgctcctgccggccgtgaaccccggccaggaggcctgcctgcacttcaccgcccccggcagccccgacagcaagtgcctcaagatcaaggtcaagcggatcaacctgaagtgcaagaagtccagctcctacttcgtgccggacgcccgcagccggtgcacgtccgtgcgccggtgccgctgggcgggggactgccagagcggctgcccgccccacttcacctccaacagcttctccgacgactgggccgggaagatggaccgggccggcctggggttcagctgctgctccgacggctgcggcggggccgcgtgcggctgcttcaacgccgcccccagctgcatcttctggcgcaagtgggtcgagaacccccacgggatcatctggaaggtgtccccctgcgccgcctgggtgcccagcgcggtcatcgagctcaccatgccgtccggcgaggtgcggaccttccaccccatgagcgggatccccacccaggtgttcaagggcgtctccgtgacctacctgggcagcgacatggaggtgtccgggctgaccgacctctgcgagatcgaggagctcaagagcaagaagctggccctggccccctgcaaccaggccggcatgggggtcgtgggcaaggtgggcgagatccagtgcagctccgaggagagcgcccgcaccatcaagaaggacgggtgcatctggaacgcggacctggtcggcatcgagctgcgggtggacgacgccgtgtgctactccaagatcacgagcgtcgaggccgtggccaactactccgccatcccgaccaccatcgggggcctgcgcttcgagcggagccacgactcccaggggaagatcagcggcagccccctcgacatcaccgcgatccgcggcagcttctccgtgaactaccgggggctgcgcctgagcctctccgagatcacggccacgtgcaccggcgaggtcaccaacgtgagcgggtgctactcctgcatgaccggcgccaaggtgagcatcaagctgcactccagcaagaactccacggcccacgtccgctgcaagggggacgagaccgcgttcagcgtgctggagggcgtgcacagctacaccgtctccctcagcttcgaccacgccgtggtggacgagcagtgccagctgaactgcggcgggcacgagtcccaggtcaccctgaagggcaacctcatcttcctggacgtgcccaagttcgtggacgggagctacatgcagacgtaccactccaccgtccccaccggcgccaacatcccgagccccaccgactggctgaacgccctcttcgggaacggcctgtcccggtggatcctgggcgtgatcggggtgctcctgggcgggctggccctcttcttcatgatcatgagcctgctgaagctcggcacgaagcaggtctaccgctcccggaccaagctggcgtga

SEQ ID NO: 13099 - RNA, 3222 nt, synthetic construct
  misc_feature 1..3222: note = derived and/or modified CDS sequence (opt1) from SFTSV(JS2011-062)__KC505136.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctgcggaaccactcccagttccagggctacgtggggcagcgcggcggccggagccaggtctcctactaccccgcggtgaacagctactcccgctggagcgggctgctctccccctgcgacgccgactggctgggcatgctggtggtcaagaaggccaaggggagcgacatgatcgtgccgggcccctcctacaaggggaaggtgttcttcgagcggcccaccttcgacggctacgtcggctgggggtgcggcagcgggaagtcccgcaccgagagcggcgagctctgcagctccgacagcggcacgtccagcgggctgctgccctccaaccgggtgctctggatcggcgacgtggcctgccagccgatgacccccatccccgaggagaccttcctggagctcaagagcttctcccagagcgagttccccgacatctgcaagatcgacgggatcgtcttcaaccagtgcgagggcgagtccctgccgcagcccttcgacgtggcctggatggacgtggggcacagccacaagatcatcatgcgcgagcacaagaccaagtgggtccaggagtccagctccaaggacttcgtgtgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtccacaagcccggggaggtggtggtcagctacggcggcatgcgggtgcgcccgaagtgctacgggttcagccggatgatggcgaccctggaggtgaacccgcccgagcagcgcatcggccagtgcaccgggtgccacctcgagtgcatcaacggcggggtccggctgatcacgctgacctccgagctcaagagcgccaccgtgtgcgcctcccacttctgcagctccgccaccagcggcaagaagtccacggagatccagttccacagcggctccctggtcgggaagaccgccatccacgtgaagggcgcgctggtggacgggaccgagttcaccttcgagggcagctgcatgttccccgacggctgcgacgccgtcgactgcacgttctgccgcgagttcctcaagaacccccagtgctaccccgccaagaagtggctgttcatcatcatcgtgatcctgctcgggtacgccggcctgatgctgctcaccaacgtgctgaaggccatcggggtctggggctcctgggtgatcgcgcccgtgaagctgatgttcgccatcatgaagaagctcatgcggaccgtcagctgcctgatggggaagctgatcgaccgcggccgccaggtgatccacgaggagatcggcgagaacggggagggcaaccgggacgacgtgcggatcgagatggcccgcccccgccgggtccgccactggatgtactccccggtgatcctcaccatcctggccatcgggctggccgagggctgcgacgagatggtgcacgcggacagcaagctcgtctcctgccggcaggggagcggcaacatgaaggagtgcgtgacgaccggccgcgccctgctgcccgccgtgaaccccgggcaggaggcctgcctccacttcaccgcccccggctccccggacagcaagtgcctgaagatcaaggtcaagcggatcaacctgaagtgcaagaagtccagcagctacttcgtgcccgacgcgcgctcccggtgcaccagcgtgcgccggtgccgctgggccggggactgccagtccggctgcccgccccacttcacgagcaactccttcagcgacgactgggccgggaagatggaccgggccggcctcggcttctccgggtgcagcgacggctgcgggggcgcggcctgcgggtgcttcaacgccgccccctcctgcatcttctggcgcaagtgggtcgagaacccccacggcatcatctggaaggtgagcccctgcgccgcgtgggtgccgtccgccgtcatcgagctgaccatgcccagcggcgaggtgcggaccttccaccccatgtccgggatccccacccaggtgttcaagggcgtcagcgtgacgtacctggggtccgacatggaggtgagcggcctcaccgacctgtgcgagatcgaggagctgaagtccaagaagctggccctcgccccgtgcaaccaggccggcatgggggtcgtgggcaaggtgggggagatccagtgcagcagcgaggagtccgcgcgcaccatcaagaaggacggctgcatctggaacgccgacctggtcgggatcgagctgcgggtggacgacgccgtgtgctacagcaagatcacctccgtcgaggccgtggccaactacagcgcgatccccacgaccatcggcggcctccgcttcgagcggtcccacgacagccaggggaagatctccggcagccccctggacatcaccgccatccgcgggtccttcagcgtgaactaccggggcctgcgcctctccctgagcgagatcaccgccacgtgcaccggggaggtcaccaacgtgtccggctgctacagctgcatgaccggcgccaaggtgtccatcaagctgcacagctccaagaacagcaccgcgcacgtccgctgcaagggggacgagacggccttctccgtgctcgagggcgtgcacagctacaccgtcagcctgtccttcgaccacgccgtggtggacgagcagtgccagctgaactgcgggggccacgagagccaggtcaccctcaaggggaacctgatcttcctggacgtgcccaagttcgtggacggctcctacatgcagacctaccacagcacggtcccgaccggcgccaacatcccctcccccaccgactggctcaacgccctgttcgggaacggcctgagccggtggatcctcgggctgatcggcgtgctgctcggcgggctggcgctgttcttcctcatcatgtccctgttcaagctgggcaccaagcaggtcttccgcagccggacgaagctcgcctga

SEQ ID NO: 13100 - RNA, 3222 nt, synthetic construct
  misc_feature 1..3222: note = derived and/or modified CDS sequence (opt1) from SFTSV(JS2011-109)__KC505139.1__GP
  source 1..3222: mol_type = other RNA
atgatgaaggtgatctggttcagctccctgatctgcctcgtgatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgaaccagcccgagcagcgcatcgggcagtgcaccggctgccacctcgagtgcatcaacgggggcgtgcggctgatcaccctgaccagcgagctcaagagcgcgacggtctgcgcctcccacttctgcagctccgccaccagcggcaagaagtccaccgagatccagttccacagcgggtccctggtgggcaagaccgccatccacgtcaagggggccctggtggacggcacggagttcaccttcgagggcagctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggtcctgggtcatcgcccccgtgaagctggtgttcgcgatcatcaagaagctcatgcgggccgtcagctgcctgatgggcaagctgatggaccgcggccgccaggtgatccacgaggagatcggggagaaccgggagggcaaccaggacgacgtgcggatcgagatggcccgcccccgccgggtccgccactggatgtactcccccgtgatcctcacgatcctggccatcgggctggccgagggctgcgacgagatggtgcacgcggacagcaagctcgtctcctgccggcaggggagcggcaacatgaaggagtgcgtgaccaccggccgcgccctgctgccggccgtgaaccccgggcaggaggcctgcctccacttcaccgcccccggctcccccgacagcaagtgcctgaagatcaaggtcaagcggatcaacctgaagtgcaagaagtccagcagctacttcgtgccggacgcgcgctcccggtgcacgagcgtgcgccggtgccgctgggccggggactgccagtccggctgcccgccccacttcaccagcaactccttcagcgacgactgggccgggaagatggaccgggccggcctcggcttctccgggtgcagcgacggctgcgggggcgcggcctgcgggtgcttcaacgccgccccctcctgcatcttctggcgcaagtgggtcgagaacccccacggcatcatctggaaggtgagcccctgcgccgcgtgggtgccctccgccgtcatcgagctgaccatgccgagcggcgaggtgcggaccttccaccccatgtccgggatccccacccaggtgttcaagggcgtcagcgtgacctacctggggtccgacatggaggtgagcggcctcaccgacctgtgcgagatcgaggagctgaagtccaagaagctggccctcgccccctgcaaccaggccggcatgggggtcgtgggcaaggtgggggagatccagtgcagctccgaggagagcgcgcgcaccatcaagaaggacggctgcatctggaacgccgacctggtcgggatcgagctgcgggtggacgacgccgtgtgctacagcaagatcacgtccgtcgaggccgtggccaactacagcgcgatcccgaccaccatcggcggcctccgcttcgagcggtcccacgacagccaggggaagatctccggcagccccctggacatcaccgccatccgcgggtccttcagcgtgaactaccggggcctgcgcctctccctgagcgagatcacggccacgtgcaccggggaggtcaccaacgtgtccggctgctacagctgcatgaccggcgccaaggtgtccatcaagctgcacagctccaagaacagcacggcgcacgtccgctgcaagggggacgagaccgccttctccgtgctcgagggcgtgcacagctactccgtcagcctgagcttcgaccacgccgtggtggacgagcagtgccagctgaactgcgggggccacgagtcccacgtcaccctccgggggaacctgatcttcctggacgtgcccaagttcgtggacggcagctacatgcagacctaccactccacggtccccaccggcgccaacatcccgagccccaccgactggctcaacgccctgttcgggaacggcctgtcccgctggatcctcggggtgatcggcgtcctgctgggcgggctcgcgctgttcttcctgatcatgagcctcttcaagctgggcaccaagcaggtcttccggtcccgcacgaagctggcctga

SEQ ID NO: 13101 - RNA, 3222 nt, synthetic construct
  misc_feature 1..3222: note = derived and/or modified CDS sequence (opt1) from SFTSV(JS2011-13-2)__KR230770.1__GP
  source 1..3222: mol_type = other RNA
atgatgaaggtgatctggttcagctccctgatctgcctcgtgatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgaaccagcccgagcagcgcatcgggcagtgcaccggctgccacctcgagtgcatcaacgggggcgtgcggctgatcaccctgaccagcgagctcaagagcgcgacggtctgcgcctcccacttctgcagctccgccaccagcggcaagaagtccaccgagatccagttccacagcgggtccctggtgggcaagaccgccatccacgtcaagggggccctggtggacggcacggagttcaccttcgagggcagctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggtcctgggtcatcgcccccgtgaagctggtgttcgcgatcatcaagaagctcatgcgggccgtcagctgcctgatgggcaagctgatggaccgcggccgccaggtgatccacgaggagatcggggagaaccgggagggcaaccaggacgacgtgcggatcgagatggcccgcccccgccgggtccgccactggatgtactcccccgtgatcctcacgatcctggccatcgggctggccgagggctgcgacgagatggtgcacgcggacagcaagctcgtctcctgccggcaggggagcggcaacatgaaggagtgcgtgaccaccggccgcgccctgctgccggccgtgaaccccgggcaggaggcctgcctccacttcaccgcccccggctcccccgacagcaagtgcctgaagatcaaggtcaagcggatcaacctgaagtgcaagaagtccagcagctacttcgtgccggacgcgcgctcccggtgcacgagcgtgcgccggtgccgctgggccggggactgccagtccggctgcccgccccacttcaccagcaactccttcagcgacgactgggccgggaagatggaccgggccggcctcggcttctccgggtgcagcgacggctgcgggggcgcggcctgcgggtgcttcaacgccgccccctcctgcatcttctggcgcaagtgggtcgagaacccccacggcatcatctggaaggtgagcccctgcgccgcgtgggtgccctccgccgtcatcgagctgaccatgccgagcggcgaggtgcggaccttccaccccatgtccgggatccccacccaggtgttcaagggcgtcagcgtgacctacctggggtccgacatggaggtgagcggcctcaccgacctgtgcgagatcgaggagctgaagtccaagaagctggccctcgccccctgcaaccaggccggcatgggggtcgtgggcaaggtgggggagatccagtgcagctccgaggagagcgcgcgcaccatcaagaaggacggctgcatctggaacgccgacctggtcgggatcgagctgcgggtggacgacgccgtgtgctacagcaagatcacgtccgtcgaggccgtggccaactacagcgcgatcccgaccaccatcggcggcctccgcttcgagcggtcccacgacagccaggggaagatctccggcagccccctggacatcaccgccatccgcgggtccttcagcgtgaactaccggggcctgcgcctctccctgagcgagatcacggccacgtgcaccggggaggtcaccaacgtgtccggctgctacagctgcatgaccggcgccaaggtgtccatcaagctgcacagctccaagaacagcacggcgcacgtccgctgcaagggggacgagaccgccttctccgtgctcgagggcgtgcacagctactccgtcagcctgagcttcgaccacgccgtggtggacgagcagtgccagctgaactgcgggggccacgagtcccacgtcaccctcaaggggaacctgatcttcctggacgtgcccaagttcgtggacggcagctacatgcagacctaccactccacggtccccaccggcgccaacatcccgagccccaccgactggctcaacgccctgttcgggaacggcctgtcccggtggatcctcggggtgatcggcgtcctgctgggcgggctcgcgctgttcttcctgatcatgagcctcttcaagctgggcaccaagcaggtcttccgctcccggacgaagctggcctga

SEQ ID NO: 13102 - RNA, 3222 nt, synthetic construct
  misc_feature 1..3222: note = derived and/or modified CDS sequence (opt1) from SFTSV(JS2011-69)__KR230771.1__GP
  source 1..3222: mol_type = other RNA
atgatgaaggtgatctggttcagctccctggtctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtcgggcagcgcggcggccggtcccaggtgagctactaccccgcggagaactcctacagccgctggtccgggctgctcagcccctgcgacgccgactggctgggcatgctggtggtcaagaaggccaaggggtccgacatgatcgtgccgggccccagctacaaggggaaggtgttcttcgagcggcccaccttcgacggctacgtcggctgggggtgcggctccggcaagagccgcacggagtccggggagctctgcagcagcgactccggcaccagctccgggctgctgcccagcgaccgggtgctctggatcggcgacgtggcctgccagccgatgacccccatccccgaggagaccttcctggagctgaagtccttcagccagtccgagttccccgacatctgcaagatcgacgggatcgtcttcaaccagtgcgacagcgagtccctcccgcagcccttcgacgtggcctggatggacgtgggccacagccacaagatcatcatgcgcgagcacaagacgaagtgggtccaggagtccagctccaaggacttcgtgtgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtccacaagcccggcgaggtggtggtcagctacgggggcatgcgggtgcgcccgaagtgctacggcttcagccggatgatggccacgctggaggtgaacccgcccgagcagcgcatcgggcagtgcaccggctgccacctcgagtgcatcaacgggggcgtccggctgatcaccctgacctccgagctcaagagcgcgacggtgtgcgcctcccacttctgcagctccgccaccagcgggaagaagtccaccgagatccagttccacagcggctccctggtcggcaaggccgccatccacgtgaagggggcgctggtggacggcaccgagttcacgttcgaggggagctgcatgttccccgacggctgcgacgccgtcgactgcaccttctgccgcgagttcctcaagaacccccagtgctaccccgccaagaagtggctgttcatcatcatcgtgatcctgctcggctacgccgggctgatgctgctcaccaacgtgctgaaggccatcggcgtctgggggtcctgggtgatggcgcccgtgaagctgatgttcgccatcatcaagaagctcatgcggagcgtctcctgcctgatgggcaagctgatggaccgcgggcgccaggtgatccacgaggagatcggcgagaaccgggagggcaaccaggacgacgtgcggatcgagatggcccgcccccgccgggtccgccactggatgtacagcccggtgatcctcaccatcctggccatcgggctggccgagggctgcgacgagatggtgcacgcggactccaagctcgtcagctgccggcaggggtccggcaacatgaaggagtgcgtgacgaccgggcgcgccctgctgcccgccgtgaaccccggccaggaggcctgcctccacttcaccgcccccggcagcccggacagcaagtgcctgaagatcaaggtcaagcggatcaacctgaagtgcaagaagtccagctcctacttcgtgcccgacgcgcgcagccggtgcacctccgtgcgccggtgccgctgggccggggactgccagagcggctgcccctcccacttcacgagcaactccttcagcgacgactgggccgggaagatggaccgggccggcctcgggttctccggctgcagcgacggctgcgggggcgcggcctgcgggtgcttcaacgccgccccgtcctgcatcttctggcgcaagtgggtcgagaacccccacggcatcatctggaaggtgagcccctgcgccgcgtgggtgccctccgccgtcatcgagctgaccatgccgagcggggaggtgcggaccttccaccccatgtccggcatccccacccaggtgttcaagggcgtcagcgtgacgtacctggggtccgacatggaggtgagcggcctcaccgacctgtgcgagatcgaggagctcaagagcaagaagctggccctggccccctgcaaccaggccgggatgggcgtcgtgggcaaggtgggggagatccagtgctccagcgaggagtccgcgcgcaccatcaagaaggacggctgcatctggaacgccgacctggtcgggatcgagctgcgggtggacgacgccgtgtgctacagcaagatcacctccgtcgaggccgtggccaactacagcgcgatcccgacgaccatcggcgggctccgcttcgagcggtcccacgacagccagggcaagatctccggcagccccctggacatcaccgccgtgcgcgggtccttcagcgtcaactaccggggcctgcgcctctccctgagcgagatcaccgccacgtgcaccggggaggtgaccaacgtgtccggctgctacagctgcatgaccggggccaaggtctccatcaagctgcacagctccaagaacagcaccgcgcacgtgcgctgcaagggcgacgagacggccttcagcgtgctcgagggcgtccactcctacaccgtgagcctgtccttcgaccacgccgtggtcgacgagcagtgccagctgaactgcgggggccacgagagccaggtgaccctcaaggggaacctgatcttcctggacgtgcccaagttcgtcgacggctcctacatgcagacctaccacagctccgtgcccacgggggccaacatcccgagccccaccgactggctcaacgccctgttcggcaacggcctgtcccggtggatcctcggggtcatcggcgtgctgctgggggtgctcgcgctgttcttcctgatcatgagcctcttcaagctgggcaccaagcaggtcttccgctcccggaccaagctggcctga

SEQ ID NO: 13103 - RNA, 3222 nt, synthetic construct
  misc_feature 1..3222: note = derived and/or modified CDS sequence (opt1) from SFTSV(JS2012-020)__KC505142.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctgaagtccttctcccagagcgagttccccgacatctgcaagatcgacggcatcgtgttcaaccagtgcgggggcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggcgaggtcgtggtgagctacgggggcatgcgggtcgggccgaagtgctacggcttctcccgcatgatggccacgctggaggtgaaccagcccgagcagcggatcgggcagtgcaccggctgccacctcgagtgcatcaacggcggggtgcgcctgatcaccctgaccagcgagctcaagagcgcgacggtctgcgcctcccacttctgcagctccgccaccagcggcaagaagtccaccgagatccagttccacagcgggtccctggtgggcaagaccgccatccacgtcaagggcgccctggtggacgggacggagttcaccttcgagggcagctgcatgttccccgacgggtgcgacgcggtggactgcaccttctgccgggagttcctcaagaacccccagtgctacccggccaagaagtggctgttcatcatcatcatcatcctgctcggctacgccgggctgatgctgctcaccaacgtcctgaaggccatcggcgtgtggggctcctgggtgatcgcccccgtcaagctggtgttcgcgatcatcaagaagctcatgcgcgccgtgagctgcctgatggggaagctgatggaccggggccgccaggtcatccacgaggagatcggggagaaccgggagggcaaccaggacgacgtgcgcatcgagatggcccggccccgccgcgtgcggcactggatgtactcccccgtcatcctcacgatcctggccatcgggctggccgagggctgcgacgagatggtgcacgcggacagcaagctcgtgtcctgccgccagggcagcgggaacatgaaggagtgcgtcaccaccggccgggccctgctgccggccgtgaaccccgggcaggaggcctgcctccacttcaccgcccccggctcccccgacagcaagtgcctgaagatcaaggtgaagcgcatcaacctgaagtgcaagaagtccagcagctacttcgtcccggacgcgcggtcccgctgcacgagcgtgcggcgctgccggtgggccggggactgccagtccggctgcccgccccacttcaccagcaactccttcagcgacgactgggccggcaagatggaccgcgccgggctcggcttctccgggtgcagcgacggctgcgggggcgcggcctgcggctgcttcaacgccgccccctcctgcatcttctggcggaagtgggtggagaacccccacgggatcatctggaaggtcagcccctgcgccgcgtgggtgccctccgccgtgatcgagctgaccatgccgagcggcgaggtccgcaccttccaccccatgtccgggatccccacccaggtgttcaagggcgtgagcgtctcctacctgggcagcgacatggaggtgtccgggctcacggacctgtgcgagatcgaggagctcaagagcaagaagctggccctggccccctgcaaccaggccggcatgggggtggtcggcaaggtgggggagatccagtgctccagcgaggagagcgcgcggaccatcaagaaggacggctgcatctggaacgccgacctggtgggcatcgagctgcgcgtcgacgacgccgtgtgctactccaagatcaccagcgtggaggccgtcgccaactactccgcgatcccgacgaccatcgggggcctccggttcgagcgcagccacgactcccaggggaagatcagcggcagccccctggacatcaccgccatccgggggagcttctccgtgaactaccgcggcctgcggctcagcctgtccgagatcaccgccacgtgcaccggcgaggtgaccaacgtcagcgggtgctactcctgcatgaccggcgccaaggtgagcatcaagctgcactccagcaagaactccaccgcgcacgtgcgctgcaagggggacgagacggccttcagcgtcctcgagggcgtgcactcctacagcgtgagcctgtccttcgaccacgccgtcgtggacgagcagtgccagctgaactgcgggggccacgagagccacgtgaccctcaagggcaacctgatcttcctggacgtccccaagttcgtggacgggtcctacatgcagacctaccacagcaccgtgcccacgggcgccaacatcccgtcccccaccgactggctcaacgccctgttcgggaacggcctgagccgctggatcctcggcgtcatcggggtgctgctgggcgggctcgcgctgttcttcctgatcatgtccctcttcaagctgggcaccaagcaggtcttccggagccgcaccaagctggcctga

SEQ ID NO: 13104 - RNA, 3222 nt, synthetic construct
  misc_feature 1..3222: note = derived and/or modified CDS sequence (opt1) from SFTSV(JS2012-035)__KC505145.1__GP
  source 1..3222: mol_type = other RNA
atgatgaaggtgatctggttcagctccctgatctgcctcgtgatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctgggggtgaaccagcccgagcagcgcatcggccagtgcaccgggtgccacctcgagtgcatcaacggcggcgtgcggctgatcaccctgaccagcgagctcaagagcgcgacggtctgcgcctcccacttctgcagctccgccaccagcgggaagaagtccaccgagatccagttccacagcggctccctggtggggaagaccgccatccacgtcaagggcgccctggtggacggcacggagttcaccttcgaggggagctgcatgttccccgacggctgcgacgcggtggactgcaccttctgccgcgagttcctcaagaacccccagtgctacccggccaagaagtggctgttcatcatcatcgtcatcctgctcgggtacgccggcctgatgctgctcaccaacgtgctgaaggccatcggggtgtggggctcctgggtcatcgcccccgtgaagctggtgttcgcgatcatcaagaagctcatgcgggccgtcagctgcctgatgggcaagctgatggaccgcgggcgccaggtgatccacgaggagatcggcgagaaccgggaggggaaccaggacgacgtgcggatcgagatggcccgcccccgccgggtccgccactggatgtactcccccgtgatcctcacgatcctggccatcggcctggccgaggggtgcgacgagatggtgcacgcggacagcaagctcgtctcctgccggcagggcagcggcaacatgaaggagtgcgtgaccaccgggcgcgccctgctgccggccgtgaaccccggccaggaggcctgcctccacttcaccgcccccgggtcccccgacagcaagtgcctgaagatcaaggtcaagcggatcaacctgaagtgcaagaagtccagcagctacttcgtgccggacgcgcgctcccggtgcacgagcgtgcgccggtgccgctgggccggcgactgccagtccgggtgcccgccccacttcaccagcaactccttcagcgacgactgggccggcaagatggaccgggccggcctcgggttctccggctgcagcgacgggtgcggcggggcggcctgcggctgcttcaacgccgccccctcctgcatcttctggcgcaagtgggtcgagaacccccacggcatcatctggaaggtgagcccctgcgccgcgtgggtgccctccgccgtcatcgagctgaccatgccgagcggggaggtgcggaccttccaccccatgtccggcatccccacccaggtgttcaagggggtcagcgtgacctacctgggctccgacatggaggtgagcggcctcaccgacctgtgcgagatcgaggagctgaagtccaagaagctggccctcgccccctgcaaccaggccgggatgggcgtcgtggggaaggtgggcgagatccagtgcagctccgaggagagcgcgcgcaccatcaagaaggacgggtgcatctggaacgccgacctggtcggcatcgagctgcgggtggacgacgccgtgtgctacagcaagatcacgtccgtcgaggccgtggccaactacagcgcgatcccgaccaccatcggcgggctccgcttcgagcggtcccacgacagccagggcaagatctccgggagccccctggacatcaccgccatccgcggctccttcagcgtgaactaccgggggctgcgcctctccctgagcgagatcacggccacgtgcaccggcgaggtcaccaacgtgtccggctgctacagctgcatgaccggggccaaggtgtccatcaagctgcacagctccaagaacagcacggcgcacgtccgctgcaagggcgacgagaccgccttctccgtgctcgagggggtgcacagctactccgtcagcctgagcttcgaccacgccgtggtggacgagcagtgccagctgaactgcggcgggcacgagtcccacgtcaccctccggggcaacctgatcttcctggacgtgcccaagttcgtggacggcagctacatgcagacctaccactccacggtccccaccggggccaacatcccgagccccaccgactggctcaacgccctgttcggcaacgggctgtcccgctggatcctcggcgtgatcggcgtcctgctcgggggcctggcgctgttcttcctgatcatgagcctcttcaagctggggaccaagcaggtcttccggtcccgcacgaagctggcctga

SEQ ID NO: 13105 - RNA, 3222 nt, synthetic construct
  misc_feature 1..3222: note = derived and/or modified CDS sequence (opt1) from SFTSV(JS2012-79)__KR230772.1__GP
  source 1..3222: mol_type = other RNA
atgatgaaggtgatctggttcagctccctgacctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcacggagagcggcgagctgtgcagctccgacagcggcacctccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagacgaagtgggtgcaggagtccagctccaaggacttcgtctgctacaaggagggcaccggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggggaggtcgtggtgagctacggcggcatgcggatccgcccgaagtgctacgggttcagccggatgatggccacgctggaggtcaaccagcccgagcagcgcctgggccagtgcaccgggtgccacctcgagtgcatcaacggcggggtgcggctgatcaccctgacctccgagctcaagagcgcgacggtgtgcgcctcccacttctgcagctccgccaccagcggcaagaagtccaccgagatccagttccacagcggctccctggtcgggaagaccgccatccacgtgaagggcgccctggtcgacgggacggagttcaccttcgagggcagctgcatgttccccgacggctgcgacgcggtggactgcaccttctgccgcgagttcctcaagaacccccagtgctacccggccaagaagtggctgttcatcatcatcgtgatcctgctcgggtacgccggcctgatgctgctcaccaacgtcctgaaggccatcgggatctggggctcctgggtgatcgcccccgtgaagctgatgttcgcgatcatcaagaagctcatgcggacggtcagctgcctgatgcgcaagctgatggaccgggggcgccaggtgatccacgaggagatcggcgagaaccgggagggcaaccaggacgacgtgcgcatcgagatggcccgcccccggcgcgtccggcactggatgtactcccccgtgatcctcaccatcctggccatcgggctggccgagagctgcgacgagatggtgcacgccgactccaagctcgtcagctgccgccagggctccgggaacatgaaggagtgcgtgaccaccggccgggcgctgctgagcgccgtgaacccggggcaggaggcctgcctccacttcacggcccccggcagccccgactccaagtgcctgaagatcaaggtcaagcgcatcaacctgaagtgcaagaagtccagcagctacttcgtgcccgacgcccggtcccgctgcaccagcgtgcggcgctgccggtgggcgggcgactgccagtccgggtgcccgccccacttcaccagcaactccttcagcgacgactgggccggcaagatggaccgcgccgggctcggcttctccgggtgcagcgacggctgcggcggggccgcgtgcggctgcttcaacgccgccccctcctgcatcttctggcggaagtgggtcgagaacccgcacgggatcatctggaaggtgagcccctgcgccgcctgggtgccctccgcggtcatcgagctgaccatgcccagcggcgaggtgcgcacgttccacccgatgtccgggatccccacccaggtgttcaagggcgtcagcgtgacctacctgggctccgacatggaggtgagcgggctcaccgacctgtgcgagatcgaggagctcaagagcaagaagctggccctggccccctgcaaccaggccggcatgggggtcgtgggcaaggtgggcgagatccagtgctccagcgaggagtccgcccggacgatcaagaaggacgggtgcatctggaacgcggacctggtcggcatcgagctgcgcgtggacgacgccgtgtgctacagcaagatcacctccgtcgaggccgtggccaactacagcgccatccccaccaccatcgggggcctccggttcgagcgctcccacgacagccaggggaagatctccggcagcccgctggacatcacggcgatccggggctccttcagcgtgaactaccgcgggctgcgcctctccctgagcgagatcaccgcgacctgcaccggcgaggtcaccaacgtgtccgggtgctacagctgcatgacgggcgccaaggtgtccatcaagctgcacagctccaagaacagcaccgcccacgtccggtgcaagggggacgagaccgccttcagcgtgctcgagggcggccactcctacaccgtgagcctgtccttcgaccacgccgtcgtggacgagcagtgccagctgaactgcgggggccacgagagccaggtgacgctcaaggggaacctgatcttcctggacgtccccaagttcgtggacggctcctacatgcagacctaccacagcaccgtgcccaccggggccaacatcccctccccgacggactggctcaacgccctgttcggcaacggcctgagccgctggatcctcggggtcatcggcgtgctgctcgggggcctggccctgttcttcatgatcatgtccctgttcaagctcggcaccaagcaggtcttccggagccgcaccaagctggcgtga

SEQ ID NO: 13106 - RNA, 3222 nt, synthetic construct
  misc_feature 1..3222: note = derived and/or modified CDS sequence (opt1) from SFTSV(JS2013-44)__KR230773.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggagaccagcgaggccaagtgccgctgctccctcgtgcacaagcccggggaggtcgtggtgagctacggcggcatgcggatccgcccgaagtgctacgggttcagccggatgatggccacgctggaggtcaaccagcccgagcagcgcctgggccagtgcaccgggtgccacctcgagtgcatcaacggcggggtgcggctgatcaccctgacctccgagctcaagagcgccacggtgtgcgcgtcccacttctgcagctccgccaccagcggcaagaagtccaccgagatccagttccacagcggctccctggtcgggaagaccgccatccacgtgaagggcgccctggtcgacgggacggagttcaccttcgagggcagctgcatgttccccgacggctgcgacgccgtggactgcaccttctgccgcgagttcctcaagaacccccagtgctacccggcgaagaagtggctgttcatcatcatcgtgatcctgctcgggtacgccggcctgatgctgctcaccaacgtcctgaaggccatcgggatctggggctcctgggtgatcgcccccgtgaagctgatgttcgccatcatcaagaagctcatgcggacggtcagctgcctgatgcgcaagctgatggaccgggggcgccaggtgatccacgaggagatcggcgagaaccgggagggcaaccaggacgacgtgcgcatcgagatggcgcgcccccggcgcgtccggcactggatgtactcccccgtgatcctcaccatcctggccatcgggctggccgagagctgcgacgagatggtgcacgccgactccaagctcgtcagctgccgccagggctccgggaacatgaaggagtgcgtgaccaccggccgggccctgctgccggcggtgaaccccgggcaggaggcctgcctccacttcacggcccccggcagccccgacagcaagtgcctgaagatcaaggtcaagcgcatcaacctgaagtgcaagaagtccagctcctacttcgtgccggacgcccggagccgctgcacctccgtgcggcgctgccggtgggccggcgactgccagagcgggtgcccgccccacttcacctccaacagcttctccgacgactgggcgggcaagatggaccgcgccgggctcggcttcagcgggtgctccgacggctgcggcggggccgcctgcggctgcttcaacgcggcccccagctgcatcttctggcggaagtgggtcgagaacccccacgggatcatctggaaggtgtccccctgcgccgcctgggtgcccagcgccgtcatcgagctgaccatgccgtccggcgaggtgcgcacgttccaccccatgagcgggatccccacccaggtgttcaagggcgtctccgtgacctacctgggcagcgacatggaggtgtccgggctcaccgacctgtgcgagatcgaggagctcaagagcaagaagctggcgctggccccctgcaaccaggccggcatgggggtcgtgggcaaggtgggcgagatccagtgcagctccgaggagagcgcccggacgatcaagaaggacgggtgcatctggaacgccgacctggtcggcatcgagctgcgcgtggacgacgcggtgtgctactccaagatcaccagcgtcgaggccgtggccaactactccgccatcccgaccaccatcgggggcctccggttcgagcgcagccacgactcccaggggaagatcagcggcagccccctggacatcagcgccatccggggctccttcagcgtgaactaccgcgggctgcgcctctccctgagcgagatcacggcgacctgcaccggcgaggtcaccaacgtgtccgggtgctacagctgcatgaccggcgccaaggtgtccatcaagctgcacagctccaagaacagcacggcccacgtccggtgcaagggggacgagaccgccttcagcgtgctcgagggcgtgcactcctacatcgtcagcctgtccttcgaccacgcggtggtggacgagcagtgccagctgaactgcggcgggcacgagagccaggtcaccctcaagggcaacctgatcttcctggacgtgcccaagttcgtggacgggtcctacatgcagacctaccacagcacggtccccaccggcgccaacatcccgtcccccaccgactggctcaacgccctgttcgggaacggcctgagccgctggatcctcggcgtgatcggggtgctgctgggcgggctcgccctgttctccatgatcatgagcctgttcaagctcggcaccaagcaggtcttccggtcccgcacgaagctggcctga

SEQ ID NO: 13107 - RNA, 3222 nt, synthetic construct
  misc_feature 1..3222: note = derived and/or modified CDS sequence (opt1) from SFTSV(JS2013-46)__KR230774.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgaacgagcccgagcagcgcatcgggcagtgcaccggctgccacctcgagtgcatcagcgggggcgtgcggctgatcaccctgaccagcgagctcaagtccgcgacggtctgcgccagccacttctgctccagcgccacctccggcaagaagtccaccgagatccagttccactccgggagcctggtgggcaagaccgccatccacgtcaagggggccctggtggacggcacggagttcaccttcgagggctcctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggagctgggtcatcgcccccgtgaagctggtgttcgcgatcatcaagaagctcatgcgggccgtctcctgcctgatgggcaagctgatggaccgcggccgccaggtgatccacgaggagatcggggagaaccgggagggcaaccaggacgacgtgcggatcgagatggcccgcccccgccgggtccgccactggatgtacagccccgtgatcctcacgatcctggccatggggctggccgagggctgcgacgagatggtgcacgcggactccaagctcgtcagctgccggcaggggtccggcaacatgaaggagtgcgtgaccaccggccgcgccctgctgccggccgtgaaccccgggcaggaggcctgcctccacttcatggcccccggcagccccgactccaagtgcctgaagatcaaggtcaagcggatcaacctgaagtgcaagaagtccagcagctacttcgtgccggacgcgcgcagccggtgcacctccgtgcgccggtgccgctgggccggggactgccagagcggctgcccgccccacttcacgtccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtcgagaacccccacggcatcatctggaaggtgtccccctgcgccgcgtgggtgcccagcgccgtcatcgagctgaccatgccgtccggcgaggtgcggaccttccaccccatgagcgggatccccacccaggtgttcaagggcgtctccgtgacgtacctggggagcgacatggaggtgtccggcctcaccgacctgtgcgagatcgaggagctcaagagcaagaagctggccctggccccctgcaaccaggccggcatgggggtcgtgggcaaggtgggggagatccagtgctccagcgaggagagcgcgcgcaccatcaagaaggacggctgcatctggaacgccgacctggtcgggatcgagctgcgggtggacgacgccgtgtgctactccaagatcaccagcgtcgaggccgtggccaactactccgcgatcccgacgaccatcggcggcctccgcttcgagcggagccacgactcccaggggaagatcagcggcagccccctggacatcaccgccatccgcgggagcttctccatcaactaccggggcctgcgcctcagcctgtccgagatcagcgcgacctgcacgggggaggtgaccaacgtctccggctgctacagctgcatgaccggcgccaaggtgtccatcaagctgcacagctccaagaacagcaccgcccacgtgcgctgcaagggggacgagaccgccttctccgtcctcgagggcgtgcacagctacagcgtgtccctgagcttcgaccacgccgtcgtggacgagcagtgccagctgaactgcgggggccacgagtcccaggtgacgctccgggggaacctgatcttcctggacgtccccaagttcgtggacggcagctacatgcagacctaccactccaccgtgcccaccggcgccaacatcccgagccccacggactggctcaacgccctgttcgggaacggcctgtcccgctggatcctcggggtcatcggcgtgctgctgggcgggctcgcgctgttcttcctgatcatgagcctcttcaagctgggcaccaagcaggtcttccggtcccgcaccaagctggcctga

SEQ ID NO: 13108 - RNA, 3222 nt, synthetic construct
  misc_feature 1..3222: note = derived and/or modified CDS sequence (opt1) from SFTSV(JS2013-52)__KR230775.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatgttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgttcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccggggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcctgtcccggtggatcctgggggtgatcggcgtcctcctgggggtgctggccctcttcttcctgatcatgagcctgttcaagctcggcacgaagcaggtcttccgctcccggaccaagctggcgtga

SEQ ID NO: 13109 - RNA, 3222 nt, synthetic construct
  misc_feature 1..3222: note = derived and/or modified CDS sequence (opt1) from SFTSV(JS2013-69)__KR230776.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatcatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggggaggtcgtggtgagctacggcggcatgcgggtccgcccgaagtgctacgggttcagccggatgatggccaccctggaggtgaaccagcccgagcagcgcctgggccagtgcacggggtgccacctcgagtgcatcaacggcggggtgcggctgatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgctcgagagctcctgcatgttccccgacggctgcgacgcggtggactgcaccttctgccgcgagttcctgaagaacccccagtgctacccggccaagaagtggctgttcatcatcatcgtcatcctcctgggctacgccgggctgatgctcctgaccaacgtgctgaaggccatcggcatctgggggagctgggtgatcgcccccgtcaagctcatgttcgcgatcatcaagaagctgatgcggaccgtgtcctgcctgatgcgcaagctcatggaccggggccgccaggtgatccacgaggagatcggggagaaccgggagggcaaccaggacgacgtccgcatcgagatggcccgcccccggcgcgtgcggcactggatgtacagccccgtgatcctgacgatcctggccatcggcctcgccgagtcctgcgacgagatggtccacgccgacagcaagctggtgtcctgccgccaggggagcggcaacatgaaggagtgcgtgaccaccgggcgggcgctgctcccggccgtcaaccccggccaggaggcctgcctgcacttcaccgcccccgggagccccgactccaagtgcctgaagatcaaggtgaagcgcatcaacctcaagtgcaagaagtccagcagctacttcgtgccggacgcccggtcccgctgcacgagcgtccggcgctgccggtgggcgggcgactgccagtccggctgcccgccccacttcaccagcaactccttcagcgacgactgggccgggaagatggaccgcgccggcctggggttctccggctgcagcgacgggtgcggcggcgccgcgtgcgggtgcttcaacgccgccccctcctgcatcttctggcggaagtgggtggagaacccccacggcatcatctggaaggtgagcccctgcgccgcctgggtcccctccgcggtgatcgagctgaccatgccgagcggggaggtgcgcaccttccaccccatgtccggcatccccacgcaggtcttcaagggggtgagcgtgacctacctcggctccgacatggaggtcagcggcctgaccgacctgtgcgagatcgaggagctcaagagcaagaagctggccctggccccctgcaaccaggccgggatgggcgtggtggggaaggtcggcgagatccagtgctccagcgaggagtccgcccggaccatcaagaaggacggctgcatctggaacgcggacctggtggggatcgagctccgcgtggacgacgccgtctgctacagcaagatcacgtccgtggaggccgtggccaactacagcgccatcccgaccaccatcggcgggctgcggttcgagcgctcccacgacagccagggcaagatctccgggagccccctggacatcaccgcgatccggggctccttcagcgtcaactaccgcggcctccgcctgtccctgagcgagatcacggcgacctgcaccggggaggtgaccaacgtgtccggctgctacagctgcatgaccggggccaaggtctccatcaagctccacagctccaagaacagcacggcccacgtgcggtgcaagggcgacgagaccgccttcagcgtgctggagggggtccactcctacaccgtgagcctgtccttcgaccacgccgtggtcgacgagcagtgccagctcaactgcggcggccacgagagccaggtgaccctgaaggggaacctgatcttcctcgacgtgcccaagttcgtcgacggctcctacatgcagacgtaccacagctccgtgcccaccggggccaacatcccgagccccaccgactggctgaacgccctgttcggcaacgggctctcccgctggatcctgggcgtgatcggcgtcctgctcggggtgctggccctgttcttcctcatcatgagcctgttcaagctgggcaccaagcaggtcttccggtcccgcacgaagctcgcgtga

SEQ ID NO: 13110 - RNA, 3222 nt, synthetic construct
  misc_feature 1..3222: note = derived and/or modified CDS sequence (opt1) from SFTSV(JS2013-71)__KR230777.1__GP
  source 1..3222: mol_type = other RNA
atgatgaaggtgatctggttcagctccctgatctgcttcgtgatccagtgcggcggggacaccggccccatcatctgcgccgggccgatccacagcaacaagtccgccgacatcccccacctcctgggctacagcgagaagatctgccagatcgaccgcctgatccacgtgtccagctggctccggaaccactcccagttccaggggtacgtgggccagcgcggcgggcggagccaggtctcctactaccccgcggagaacagctactcccgctggagcggcctgctgtccccctgcgacgccgactggctcgggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctgtgctccagcgacagcgggacctccagcggcctcctgccctccgaccgggtcctgtggatcggggacgtggcctgccagccgatgacccccatccccgaggagaccttcctcgagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctcgtgcacaagcccggcgaggtcgtggtgagctacggcgggatgcgggtccgcccgaagtgctacggcttctcccggatgatggccacgctggaggtgaaccagcccgagcagcgcatcgggcagtgcaccggctgccacctggagtgcatcaacgggggcgtgcggctcatcaccctgaccagcgagctcaagagcgcgacggtctgcgcctcccacttctgcagctccgccaccagcggcaagaagtccaccgagatccagttccacagcgggtccctcgtgggcaagaccgccatccacgtcaagggggccctggtggacggcacggagttcaccttcgagggcagctgcatgttccccgacgggtgcgacgcggtggactgcaccttctgccgcgagttcctgaagaacccccagtgctacccggccaagaagtggctgttcatcatcatcgtcatcctgctgggctacgccgggctcatgctgctgaccaacgtgctcaaggccatcggcgtgtgggggtcctgggtcatcgcccccgtgaagctggtgttcgcgatcatcaagaagctgatgcgggccgtcagctgcctcatgggcaagctgatggaccgcggccgccaggtgatccacgaggagatcggggagaaccgggagggcaaccaggacgacgtgcggatcgagatggcccgcccccgccgggtccgccactggatgtactcccccgtgatcctgacgatcctcgccatcgggctggccgagggctgcgacgagatggtgcacgcggacagcaagctggtctcctgccggcaggggagcggcaacatgaaggagtgcgtgaccaccggccgcgccctcctgccggccgtgaaccccgggcaggaggcctgcctgcacttcaccgcccccggctcccccgacagcaagtgcctcaagatcaaggtcaagcggatcaacctgaagtgcaagaagtccagcagctacttcgtgccggacgcgcgctcccggtgcacgagcgtgcgccggtgccgctgggccggggactgccagtccggctgcccgccccacttcaccagcaactccttcagcgacgactgggccgggaagatggaccgggccggcctgggcttctccgggtgcagcgacggctgcgggggcgcggcctgcgggtgcttcaacgccgccccctcctgcatcttctggcgcaagtgggtcgagaacccccacggcatcatctggaaggtgagcccctgcgccgcgtgggtgccctccgccgtcatcgagctcaccatgccgagcggcgaggtgcggaccttccaccccatgtccgggatccccacccaggtgttcaagggcgtcagcgtgacctacctggggtccgacatggaggtgagcggcctgaccgacctctgcgagatcgaggagctgaagtccaagaagctggccctggccccctgcaaccaggccggcatgggggtcgtgggcaaggtgggggagatccagtgcagctccgaggagagcgcgcgcaccatcaagaaggacggctgcatctggaacgccgacctcgtcgggatcgagctgcgggtggacgacgccgtgtgctacagcaagatcacgtccgtcgaggccgtggccaactacagcgcgatcccgaccaccatcggcggcctgcgcttcgagcggtcccacgacagccaggggaagatctccggcagccccctcgacatcaccgccatccgcgggtccttcagcgtgaactaccggggcctgcgcctgtccctcagcgagatcacggccacgtgcaccggggaggtcaccaacgtgtccggctgctacagctgcatgaccggcgccaaggtgtccatcaagctgcacagctccaagaacagcacggcgcacgtccgctgcaagggggacgagaccgccttctccgtgctggagggcgtgcacagctactccgtcagcctcagcttcgaccacgccgtggtggacgagcagtgccagctgaactgcgggggccacgagtcccacgtcaccctgcgggggaacctcatcttcctggacgtgcccaagttcgtggacggcagctacatgcagacctaccactccacggtccccaccggcgccaacatcccgagccccaccgactggctgaacgccctcttcgggaacggcctgtcccgctggatcctgggggtgatcggcgtcctcctgggcgggctggcgctgttcttcctgatcatgagcctgttcaagctcggcaccaagcaggtcttccggtcccgcacgaagctggcctga

SEQ ID NO: 13111 - RNA, 3222 nt, synthetic construct
  misc_feature 1..3222: note = derived and/or modified CDS sequence (opt1) from SFTSV(JS2014-03)__KR230778.1__GP
  source 1..3222: mol_type = other RNA
atgatgaaggtgatctggttcagctccctgatctacttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcggatccgcccgaagtgctacgggttcagccggatgatggccaccctggaggtcaaccagcccgagcagcgcatcggccagtgcacggggtgccacctggagtgcatcaacggcggggtgcggctcatcaccctgacctccgagctcaagagcgcgaccgtgtgcgcctcccacttctgcagctccgccacgagcggcaagaagtccaccgagatccagttccacagcggctccctcgtcgggaagaccgccatccacgtgaagggcgccctggtcgacgggaccgagttcacgttcgagggcagctgcatgttccccgacggctgcgacgcggtggactgcaccttctgccgcgagttcctgaagaacccccagtgctacccggccaagaagtggctgttcatcatcatcgtgatcctgctggggtacgccggcctcatgctgctgaccaacgtcctcaaggccatcgggatctggggctcctgggtgatcgcccccgtgaagctgatgttcgcgatcatcaagaagctgatgcggaccgtcagctgcctcatggggaagctgatggaccgcggccgccaggtgatccacgaggagatcggcgagaaccgggaggggaaccaggacgacgtgcggatcgagatggcccgcccccgccgggtccgccactggatgtactcccccgtgatcctgacgttcctcgccatcggcctggccgagagctgcgacgagatggtgcacgccgactccaagctggtcagctgccggcaggggtccggcaacatgaaggagtgcgtgaccaccgggcgcgcgctcctgccggccgtgaaccccggccaggaggcctgcctgcacttcaccgcccccggcagccccgacagcaagtgcctcaagatcaaggtcaagcggatcaacctgaagtgcaagaagtccagctcctacttcgtgccggacgcccgcagccggtgcacgtccgtgcgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtcgagaacccccacggcatcatctggaaggtgtccccctgcgccgcctgggtgcccagcgcggtcatcgagctcaccatgccgtccggggaggtgcggaccttccaccccatgagcggcatccccacccaggtgttcaagggcgtctccgtgacctacctggggagcgacatggaggtgtccggcctgaccgacctctgcgagatcgaggagctcaagagcaagaagctggccctggccccctgcaaccaggccgggatgggcgtcgtgggccgcgtgggggagatccagtgcagctccgaggagagcgcccggaccatcaagaaggacggctgcatctggaacgcggacctggtcgggatcgagctgcgcgtggacgacgccgtgtgctactccaagatcacgagcgtcgaggccgtggccaactactccgccatcccgaccaccatcggcgggctgcggttcgagcgcagccacgactcccagggcaagatcagcggcagccccctcgacatcaccgcgatccgggggagcttctccgtgaactaccgcggcctgcgcctgagcctctccgagatcacggccacgtgcaccggggaggtcaccaacgtgagcggctgctactcctgcatgaccggggccaaggtgagcatcaagctgcactccagcaagaactccacggcccacgtccggtgcaagggcgacgagaccgcgttcagcgtgctggagggcgtgcacagctacaccgtctccctcagcttcgaccacgccgtggtggacgagcagtgccagctgaactgcgggggccacgagtcccaggtcaccctgaaggggaacctcatcttcctggacgtgcccaagttcgtggacggcagctacatgcagacgtaccactccaccgtccccaccggggccaacatcccgagccccaccgactggctgaacgccctcttcggcaacggcctgtcccgctggatcctgggggtgatcggcgtgctcctcgggggcctggccctgttcttcatgatcatgagcctgttcaagctgggcacgaagcaggtcttccggtcccgcaccaagctcgcgtga

SEQ ID NO: 13112 - RNA, 3222 nt, synthetic construct
  misc_feature 1..3222: note = derived and/or modified CDS sequence (opt1) from SFTSV(JS2014-16)__KR230780.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaaggtggacgggatcgtcttcaaccagtgcgacagcgagtccctcccgcagcccatcgacgtggcctggatggacgtgggccacagccacaagatcatcatgcgcgagcacaagacgaagtgggtccaggagtccagctccaaggacttcgtgtgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtccacaagcccggcgaggtggtggtcagctacgggggcatgcgggtgcgcccgaagtgctacggcttcagccggatgatggccacgctggaggtgaacccgcccgagcagcgcatcgggcagtgcaccggctgccacctcgagtgcatcaacgggggcgtccggctgatcaccctgacctccgagctcaagagcgcgacggtgtgcgcctcccacttctgcagctccgccaccagcgggaagaagtccaccgagatccagttccacagcggctccctggtcggcaaggccgccatccacgtgaagggggcgctggtggacggcaccgagttcacgttcgaggggagctgcatgttccccgacggctgcgacgccgtcgactgcaccttctgccgcgagttcctcaagaacccccagtgctaccccgccaagaagtggctgttcatcatcatcgtgatcctgctcggctacgccgggctgatgctgctcaccaacgtgctgaaggccatcggcgtctgggggtcctgggtgatggcgcccgtgaagctgatgttcgccatcatcaagaagctcatgcggagcgtctcctgcatgatgggcaagctgatggaccgcgggcgccaggtgatccacgaggagatcggcgagaaccgggagggcaaccaggacgacgtgcggatcgagatggcccgcccccgccgggtccgccactggatgtacagcccggtgatcctgaccatcctcgccatcgggctggccgagggctgcgacgagatggtgcacgcggactccaagctggtcctctgccggcaggggagcggcaacatgaaggagtgcgtgacgaccgggcgcgccctgctgcccgccgtgaaccccggccaggaggcctgcctccacttcaccgcccccggctccccggacagcaagtgcctgaagatcaaggtcaagcggatcaacctgaagtgcaagaagtcctccagctacttcgtgcccgacgcgcgctcccggtgcaccagcgtgcgccggtgccgctgggccggggactgccagtccggctgccccagccacttcacgtccaacagcttctccgacgactgggccgggaagatggaccgggccggcctcgggttcagcggctgctccgacggctgcgggggcgcggcctgcgggtgcttcaacgccgccccgagctgcatcttctggcgcaagtgggtcgagaacccccacggcatcatctggaaggtgtccccctgcgccgcgtgggtgcccagcgccgtcatcgagctgaccatgccgtccggggaggtgcggaccttccaccccatgagcggcatccccacccaggtgttcaagggcgtctccgtgacgtacctggggagcgacatggaggtgtccggcctcaccgacctgtgcgagatcgaggagctcaagagcaagaagctggccctggccccctgcaaccaggccgggatgggcgtcgtgggcaaggtgggggagatccagtgcagctccgaggagagcgcgcgcaccatcaagaaggacggctgcatctggaacgccgacctggtcgggatcgagctgcgggtggacgacgccgtgtgctactccaagatcaccagcgtcgaggccgtggccaactactccgcgatcccgacgaccatcggcgggctccgcttcgagcggagccacgactcccagggcaagatcagcggcagccccctggacatcaccgccatccgcgggagcttctccgtgaactaccggggcctgcgcctcagcctgtccgagatcaccgccacgtgcaccggggaggtcaccaacgtgagcggctgctactcctgcatgaccggggccaaggtgagcatcaagctgcactccagcaagaactccaccgcgcacgtccgctgccggggcgacgagacggccttcagcgtgctcgagggcgtgcacagctacaccgtctccctgagcttcgaccacgccgtggtggacgagcagtgccagctgaactgcgggggccacgagtcccaggtcaccctcaaggggaacctgatcttcctggacgtgcccaagttcgtggacggcagctacatgcagacctaccactccagcgtccccacgggggccaacatcccgtcccccaccgactggctcaacgccctgttcggcaacggcctgagccgctggatcctcggggtgatcggcgtcctgctgggggtgctcgcgctgttcttcctgatcatgtccctcttcaagctgggcaccaagcaggtcttccggagccgcaccaagctggcctga

SEQ ID NO: 13113 - RNA, 3222 nt, synthetic construct
  misc_feature 1..3222: note = derived and/or modified CDS sequence (opt1) from SFTSV(JS2014-18)__KR230781.1__GP
  source 1..3222: mol_type = other RNA
atgatgaaggtgatctggttcagctccctgatctgcctcgtgatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgaccacccccatccccgaggagacgttcctggagctcaagagcttctcccagagcgagttccccgacgtgtgcaagatcgacggcatcgtcttcaaccagtgcgagggggagtccctgccgcagcccttcgacgtggcctggatggacgtgggccacagccacaagatcatcatgcgcgagcacaagaccaagtgggtccaggagtccagctccaaggacttcgtgtgctacaaggagggcaccgggccctgcagcgagtccgaggagaagacctgcaagacgagcggctcctgccgcggggacatgcagttctgcaaggtggcgggctgcgagcacggggaggaggccagcgaggccaagtgccggtgctccctggtccacaagcccggcgaggtggtggtcagctacggcgggatgcgggtgcgcccgaagtgctacggcttctcccggatgatggccaccctggaggtgaacccgcccgagcagcgcatcgggcagtgcaccggctgccacctcgagtgcatcaacgggggcgtccggctgatcaccctgacgagcgagctcaagagcgcgaccgtgtgcgcctcccacttctgcagctccgccaccagcggcaagaagtccaccgagatccagttccacagcgggtccctggtcggcaagacggccatccacgtgaagggggccctggtggacggcaccgagttcaccttcgagggcagctgcatgttccccgacgggtgcgacgcggtcgactgcaccttctgccgcgagttcctcaagaacccccagtgctaccccgccaagaagtggctgttcatcatcatcgtgatcctgctcggctacgccgggctgatgctgctcacgaacgtgctgaaggccatcggcgtctgggggtcctgggtgatcgcccccgtgaagctggtcttcgcgatcatcaagaagctcatgcgggccgtgagctgcctgatgggcaagctgatggaccgcggccgccaggtgatccacgaggagatcggggagaaccgggagggcaaccaggacgacgtccggatcgagatggcccgcccccgccgggtgcgccactggatgtactccccggtgatcctcaccatcctggccatcgggctggccgagggctgcgacgagatggtccacgcggacagcaagctcgtgtcctgccggcaggggagcggcaacatgaaggagtgcgtgaccaccggccgcgccctgctgcccgccgtcaaccccgggcaggaggcctgcctccacttcacggcccccggctccccggacagcaagtgcctgaagatcaaggtgaagcggatcaacctgaagtgcaagaagtccagcagctacttcgtgcccgacgcgcgctcccggtgcaccagcgtccgccggtgccgctgggccggggactgccagtccggctgcccgccccacttcaccagcaactccttcagcgacgactgggccgggaagatggaccgggccggcctcggcttctccgggtgcagcgacggctgcgggggcgcggcctgcgggtgcttcaacgccgccccctcctgcatcttctggcgcaagtgggtggagaacccccacggcatcatctggaaggtgagcccctgcgccgcgtgggtcccgtccgccgtgatcgagctgaccatgcccagcggcgaggtgcggacgttccaccccatgtccgggatccccacccaggtcttcaagggcgtgagcgtgacctacctggggtccgacatggaggtcagcggcctcaccgacctgtgcgagatcgaggagctgaagtccaagaagctggccctcgccccgtgcaaccaggccggcatgggggtggtgggcaaggtcggggagatccagtgcagctccgaggagagcgcgcgcacgatcaagaaggacggctgcatctggaacgccgacctggtggggatcgagctgcgggtggacgacgccgtctgctacagcaagatcacctccgtggaggccgtggccaactacagcgcgatccccaccaccatcggcggcctccgcttcgagcggtcccacgacagccaggggaagatctccggcagccccctggacatcacggccatccgcgggtccttcagcgtcaactaccggggcctgcgcctctccctgagcgagatcaccgcgacctgcaccggggaggtgaccaacgtgtccggctgctacagctgcatgacgggcgccaaggtctccatcaagctgcacagctccaagaacagcaccgcccacgtgcgctgcaagggggacgagaccgccttctccgtgctcgagggcgtccacagctactccgtgagcctgagcttcgaccacgccgtggtcgacgagcagtgccagctgaactgcgggggccacgagtcccaggtgaccctccgggggaacctgatcttcctggacgtgcccaagttcgtcgacggcagctacatgcagacgtaccactccaccgtgccgaccggcgccaacatccccagccccaccgactggctcaacgccctgttcgggaacggcctgtcccgctggatcctcggggtcatcggcgtgctgctgggcgggctcgcgctgttcttcctgatcatgagcctcttcaagctgggcacgaagcaggtcttccggtcccgcaccaagctggcctga

SEQ ID NO: 13114 - RNA, 3222 nt, synthetic construct
  misc_feature 1..3222: note = derived and/or modified CDS sequence (opt1) from SFTSV(JS2014-31)__KR230782.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcggatccgcccgaagtgctacgggttcagccggatgatggccaccctggaggtcaaccagcccgagcagcgcctgggccagtgcacggggtgccacctcgagtgcatcaacggcggggtgcggctgatcaccctgacctccgagctcaagagcgcgaccgtgtgcgcctcccacttctgcagctccgccacgagcggcaagaagtccaccgagatccagttccacagcggctccctggtcgggaagaccgccatccacgtgaagggcgccctggtcgacgggaccgagttcacgttcgagggcagctgcatgttccccgacggctgcgacgcggtggactgcaccttctgccgcgagttcctcaagaacccccagtgctacccggccaagaagtggctgttcatcatcatcgtgatcctgctcgggtacgccggcctgatgctgctcaccaacgtcctgaaggccatcgggatctggggctcctgggtgatcgcccccgtgaagctgatgttcgcgatcatcaagaagctcatgcggaccgtcagctgcctgatgcgcaagctgatggaccgggggcgccaggtgatccacgaggagatcggcgagaaccgggagggcaaccaggacgacgtgcgcatcgagatggcccgcccccggcgcgtccggcactggatgtactcccccgtgatcctcacgatcctggccatcgggctggccgagagctgcgacgagatggtgcacgccgactccaagctcgtcagctgccgccagggctccgggaacatgaaggagtgcgtgaccaccggccgggcgctgctgccggccgtgaaccccgggcaggaggcctgcctccacttcaccgcccccggcagccccgacagcaagtgcctgaagatcaaggtcaagcgcatcaacctgaagtgcaagaagtccagctcctacttcgtgccggacgcccggagccgctgcacgtccgtgcggcgctgccggtgggcgggcgactgccagagcgggtgcccgccccacttcacctccaacagcttctccgacgactgggccggcaagatggaccgcgccgggctcggcttcagcgggtgctccgacggctgcggcggggccgcgtgcggctgcttcaacgccgcccccagctgcatcttctggcggaagtgggtcgagaacccccacgggatcatctggaaggtgtccccctgcgccgcctgggtgcccagcgcggtcatcgagctgaccatgccgtccggcgaggtgcgcaccttccaccccatgagcgggatccccacccaggtgttcaagggcgtctccgtgacctacctgggcagcgacatggaggtgtccgggctcaccgacctgtgcgagatcgaggagctcaagagcaagaagctggccctggccccctgcaaccaggccggcatgggggtcgtgggcaaggtgggcgagatccagtgcagctccgaggagagcgcccggaccatcaagaaggacgggtgcatctggaacgcggacctggtcggcatcgagctgcgcgtggacgacgccgtgtgctactccaagatcacgagcgtcgaggccgtggccaactactccgccatcccgaccaccatcgggggcctccggttcgagcgcagccacgactcccaggggaagatcagcggcagccccctggacatcaccgcgatccggggcagcttctccgtgaactaccgcgggctgcgcctcagcctgtccgagatcacggccacgtgcaccggcgaggtcaccaacgtgagcgggtgctactcctgcatgaccggcgccaaggtgagcatcaagctgcactccagcaagaactccacggcccacgtccggtgcaagggggacgagaccgcgttcagcgtgctcgagggcgtgcacagctacaccgtctccctgagcttcgaccacgccgtggtggacgagcagtgccagctgaactgcggcgggcacgagtcccaggtcaccctcaagggcaacctgatcttcctggacgtgcccaagttcgtggacgggagctacatgcagacgtaccactccaccgtccccaccggcgccaacatcccgagccccaccgactggctcaacgccctgttcgggaacggcctgtcccgctggatcctcggcgtgatcggggtgctgctgggcgtcctcgccctgttcttcctgatcatgagcctcttcaagctggggacgaagcaggtcttccggtcccgcaccaagctggcgtga

SEQ ID NO: 13115 - RNA, 3222 nt, synthetic construct
  misc_feature 1..3222: note = derived and/or modified CDS sequence (opt1) from SFTSV(JS2014-33)__KR230783.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcaactgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggcagctgggtgatcgcccccgtcaagctgatcttcgcgatcatcaagaagctgatgcgggccgtggggtgcctcatgggcaagctgatggaccgcggccgccaggtgatccacgaggagatcggggagaaccgggagggcaaccaggacgacgtccggatcgagatggcccgcccccgccgggtgcgccactggatgtactcccccgtgatcctgaccatcctcgccatcgggctggccgagagctgcgacgagatggtccacgcggactccaagctggtgagctgccggcagggcgggggcaacatgaaggagtgcgtgacgaccggccgcgccctcctgccggccgtcaaccccgggcaggaggcctgcctgcacttcaccgcccccggctcccccgacagcaagtgcctcaagatcaaggtgaagcggatcaacctgaagtgcaagaagtccagcagctacttcgtgccggacgcgcgctcccggtgcaccagcgtccgccggtgccgctgggccggggactgccagtccggctgcccgccccacttcacgagcaactccttcagcgacgactgggccgggaagatggaccgggccggcctgggcttctccgggtgcagcgacggctgcgggggcgcggcctgcgggtgcttcaacgccgccccctcctgcatcttctggcgcaagtgggtggagaacccccacggcatcatctggaaggtgagcccctgcgccgcgtgggtcccctccgccgtgatcgagctcaccatgccgagcggcgaggtgcggaccttccaccccatgtccgggatccccacccaggtcttcaagggcgtgagcgtgacgtacctggggtccgacatggaggtcagcggcctgaccgacctctgcgagatcgaggagctgaagtccaagaagctggccctggccccctgcaaccaggccggcatgggggtggtgggcaaggtcggggagatccagtgcagctccgaggagagcgcgcgcaccatcaagaaggacggctgcatctggaacgccgacctcgtggggatcgagctgcgggtggacgacgccgtctgctacagcaagatcacctccgtggaggccgtggccaactacagcgcgatcccgacgaccatcggcggcctgcgcttcgagcggtcccacgacagccaggggaagatctccggcagccccctcgacatcaccgccatccgcgggtccttcagcgtcaactaccggggcctgcgcctgtccctcagcgagatcaccgccacgtgcaccggggaggtgaccaacgtgtccggctgctacagctgcatgaccggcgccaaggtctccatcaagctgcacagctccaagaacagcaccgcgcacgtgcgctgcaagggggacgagacggccttctccgtgctggagggcgtccacagctacaccgtgtccctcagcttcgaccacgccgtggtcgacgagcagtgccagctgaactgcgggggccacgagagccaggtgaccctgaaggggaacctcatcttcctggacgtgcccaagttcgtcgacggctcctacatgcagacctaccacagcgccgtgcccacgggcgccaacatcccgtcccccaccgactggctgaacgcgctgttcgggaacggcctgagccggtggatcctgggggtgatcggcgtcctcctgggcgggctggccctcttcttcatgatcatgtccctgttcaagctgggcaccaagcaggccttccgcagccggaccaagctcgcctga

SEQ ID NO: 13116 - RNA, 3222 nt, synthetic construct
  misc_feature 1..3222: note = derived and/or modified CDS sequence (opt1) from SFTSV(JS2014-39)__KR230784.1__GP
  source 1..3222: mol_type = other RNA
atgatgaaggtgatctggttcagctccctgacctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcacggagagcggcgagctgtgcagctccgacagcggcacctccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagacgaagtgggtgcaggagtccagctccaaggacttcgtctgctacaaggagggcaccggcccctgcagcgagtccgaggagaagacctgcaagaccagcgggtcctgccggggcgacatgcagttctgcaaggtggcggggtgcgagcacggcgaggagacgagcgaggccaagtgccgctgctccctcgtgcacaagcccggggaggtcgtggtgagctacggcggcatgcggatccgcccgaagtgctacgggttcagccggatgatggccaccctggaggtcaaccagcccgagcagcgcctgggccagtgcaccgggtgccacctcgagtgcatcaacggcggggtgcggctgatcaccctgacgtccgagctcaagagcgccaccgtgtgcgcgtcccacttctgcagctccgccaccagcggcaagaagtccaccgagatccagttccacagcggctccctggtcgggaagacggccatccacgtgaagggcgccctggtcgacgggaccgagttcaccttcgagggcagctgcatgttccccgacggctgcgacgccgtggactgcaccttctgccgcgagttcctcaagaacccccagtgctacccggcgaagaagtggctgttcatcatcatcgtgatcctgctcgggtacgccggcctgatgctgctcacgaacgtcctgaaggccatcgggatctggggctcctgggtgatcgcccccgtgaagctgatgttcgccatcatcaagaagctcatgcggaccgtcagctgcctgatgcgcaagctgatggaccgggggcgccaggtgatccacgaggagatcggcgagaaccgggagggcaaccaggacgacgtgcgcatcgagatggcgcgcccccggcgcgtccggcactggatgtactcccccgtgatcctcaccatcctggccatcgggctggccgagagctgcgacgagatggtgcacgccgactccaagctcgtcagctgccgccagggctccgggaacatgaaggagtgcgtgaccacgggccgggccctgctgccggcggtgaaccccgggcaggaggcctgcctccacttcaccgcccccggcagccccgacagcaagtgcctgaagatcaaggtcaagcgcatcaacctgaagtgcaagaagtccagctcctacttcgtgccggacgcccggagccgctgcacctccgtgcggcgctgccggtgggccggcgactgccagagcgggtgcccgccccacttcacctccaacagcttctccgacgactgggcgggcaagatggaccgcgccgggctcggcttcagcgggtgctccgacggctgcggcggggccgcctgcggctgcttcaacgcggcccccagctgcatcttctggcggaagtgggtcgagaacccccacgggatcatctggaaggtgtccccctgcgccgcctgggtgcccagcgccgtcatcgagctgacgatgccgtccggcgaggtgcgcaccttccaccccatgagcgggatccccacccaggtgttcaagggcgtctccgtgacctacctgggcagcgacatggaggtgtccgggctcacggacctgtgcgagatcgaggagctcaagagcaagaagctggcgctggccccctgcaaccaggccggcatgggggtcgtgggcaaggtgggcgagatccagtgcagctccgaggagagcgcccggaccatcaagaaggacgggtgcatctggaacgccgacctggtcggcatcgagctgcgcgtggacgacgcggtgtgctactccaagatcaccagcgtcgaggccgtggccaactactccgccatcccgaccacgatcgggggcctccggttcgagcgcagccacgactcccaggggaagatcagcggcagccccctggacatcagcgccatccggggctccttcagcgtgaactaccgcgggctgcgcctctccctgagcgagatcaccgcgacctgcaccggcgaggtcaccaacgtgtccgggtgctacagctgcatgacgggcgccaaggtgtccatcaagctgcacagctccaagaacagcaccgcccacgtccggtgcaagggggacgagaccgccttcagcgtgctcgagggcgtgcactcctacatcgtcagcctgtccttcgaccacgcggtggtggacgagcagtgccagctgaactgcggcgggcacgagagccaggtcaccctcaagggcaacctgatcttcctggacgtgcccaagttcgtggacgggtcctacatgcagacgtaccacagcaccgtccccaccggcgccaacatcccgtcccccaccgactggctcaacgccctgttcgggaacggcctgagccgctggatcctcggcgtgatcggggtgctgctgggcgggctcgccctgttctccatgatcatgagcctgttcaagctcggcacgaagcaggtcttccggtcccgcaccaagctggcctga

SEQ ID NO: 13117 - RNA, 3222 nt, synthetic construct
  misc_feature 1..3222: note = derived and/or modified CDS sequence (opt1) from SFTSV(JS2014-H.longicornis-02)__KR230786.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgtggaggccttcctcgagctcaagagcttctcccagagcgagttccccgacatctgcaagatcgacgggatcgtcttcaaccagtgcgagggcgagtccctgccgcagcccttcgacgtggcgtggatggacgtggggcacagccacaagatcatcatgcgcgagcacaagaccaagtgggtccaggagtccagctccaaggacttcgtgtgctacaaggagggcaccggcccctgccccgagagcgaggagaagacgtgcaagacctccgggagctgccggggcgacatgcagttctgcaaggtggccgggtgcgagcacggcgaggaggcctccgaggccaagtgccgctgcagcctggtccacaagccgggggaggtggtggtctcctacggcggcatgcggatccgccccaagtgctacgggttcagccggatgatggcgaccctggaggtgaaccagcccgagcagcgcctgggccagtgcaccgggtgccacctcgagtgcatcaacggcggggtgcggctgatcacgctgaccagcgagctcaagtccgccaccgtctgcgccagccacttctgctccagcgccacctccggcaagaagtccacggagatccagttccacagcggcagcctggtggggaagaccgccatccacgtcaagggcgcgctggtggacgggaccgagttcaccttcgagggctcctgcatgttccccgacggctgcgacgccgtggactgcacgttctgccgcgagttcctcaagaacccgcagtgctaccccgccaagaagtggctgttcatcatcatcgtcatcctgctcgggtacgccggcctgatgctgctcaccaacgtgctgaaggccatcgggatctggggcagctgggtgatcgcgcccgtcaagctgatgttcgccatcatcaagaagctcatgcggaccgtgtcctgcctgatgcgcaagctgatggaccgggggcgccaggtgatccacgaggagatcggcgagaaccgggagggcaaccaggacgacgtccgcatcgagatggcccgcccccggcgcgtgcggcactggatgtacagcccggtgatcctcaccatcctggccatcgggctggccgagtcctgcgacgagatggtccacgcggacagcaagctcgtgtcctgccgccagggcagcgggaacatgaaggagtgcgtgacgaccggccgggccctgctgcccgccgtcaaccccgggcaggaggcctgcctccacttcaccgcccccggctccccggacagcaagtgcctgaagatcaaggtgaagcgcatcaacctgaagtgcaagaagtccagcagctacttcgtgcccgacgcgcggtcccgctgcaccagcgtccggcgctgccggtgggccggcgactgccagtccgggtgcccgccccacttcacgagcaactccttcagcgacgactgggccggcaagatggaccgcgccgggctcggcttctccgggtgcagcgacggctgcggcggggcggcctgcggctgcttcaacgccgccccctcctgcatcttctggcggaagtgggtggagaacccccacgggatcatctggaaggtgagcccctgcgccgcgtgggtcccgtccgccgtgatcgagctgaccatgcccagcggcgaggtgcgcaccttccaccccatgtccgggatccccacccaggtcttcaagggcgtgagcgtgacgtacctgggctccgacatggaggtcagcgggctcaccgacctgtgcgagatcgaggagctgaagtccaagaagctggccctcgccccgtgcaaccaggccggcatgggggtggtgggcaaggtcggcgagatccagtgcagcagcgaggagtccgcgcggaccatcaagaaggacgggtgcatctggaacgccgacctggtgggcatcgagctgcgcgtggacgacgccgtctgctacagcaagatcacctccgtggaggccgtggccaactacagcgcgatccccacgaccatcgggggcctccggttcgagcgctcccacgacagccaggggaagatctccggcagccccctggacatcaccgccatccggggctccttcagcgtcaactaccgcgggctgcgcctctccctgagcgagatcaccgccacgtgcaccggcgaggtgaccaacgtgtccgggtgctacagctgcatgaccggcgccaaggtctccatcaagctgcacagctccaagaacagcaccgcgcacgtgcggtgcaagggggacgagacggccttctccgtgctcgagggcgtccacagctacaccgtgagcctgtccttcgaccacgccgtggtcgacgagcagtgccagctgaactgcggcgggcacgagagccaggtgaccctcaagggcaacctgatcttcctggacgtgcccaagttcgtcgacgggtcctacatgcagacctaccacagcacggtgccgaccggcgccaacatcccctcccccaccgactggctcaacgccctgttcgggaacggcctgagccgctggatcctcggcgtgatcggggtcctgctgggcgggctcgcgctgttcttcatgatcatgtccctgttcaagctcggcaccaagcaggtcttccggagccgcacgaagctggcctga

SEQ ID NO: 13118 - RNA, 3222 nt, synthetic construct
  misc_feature 1..3222: note = derived and/or modified CDS sequence (opt1) from SFTSV(JS2014-H.longicornis-03)__KR230787.1__GP
  source 1..3222: mol_type = other RNA
atgatgaaggtgatctggttcagctccctgacctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcacggagagcggcgagctgtgcagctccgacagcggcacctccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagacgaagtgggtgcaggagtccagctccaaggacttcgtctgctacaaggagggcaccggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcggatccgcccgaagtgctacgggttcagccggatgatggccacgctggaggtcaaccagcccgagcagcgcatcggccagtgcaccgggtgccacctggagtgcatcaacggcggggtgcggctcatcaccctgacctccgagctcaagagcgcgacggtgtgcgcctcccacttctgcagctccgccaccagcggcaagaagtccaccgagatccagttccacagcggctccctcgtcgggaagaccgccatccacgtgaagggcgccctggtcgacgggacggagttcaccttcgagggcagctgcatgttccccgacggctgcgacgcggtggactgcaccttctgccgcgagttcctgaagaacccccagtgctacccggccaagaagtggctgttcatcatcatcgtgatcctgctggggtacgccggcctcatgctgctgaccaacgtcctcaaggccatcgggatctggggctcctgggtgatcgcccccgtgaagctgatgttcgcgatcatcaagaagctgatgcggacggtcagctgcctcatggggaagctgatggaccgcggccgccaggtgatccacgaggagatcggcgagaaccgggaggggaaccaggacgacgtgcggatcgagatggcccgcccccgccgggtccgccactggatgtactcccccgtgatcctgaccttcctcgccatcggcctggccgagagctgcgacgagatggtgcacgccgactccaagctggtcagctgccggcaggggtccggcaacatgaaggagtgcgtgaccaccgggcgcgcgctcctgccggccgtgaaccccggccaggaggcctgcctgcacttcacggcccccggcagccccgacagcaagtgcctcaagatcaaggtcaagcggatcaacctgaagtgcaagaagtccagctcctacttcgtgccggacgcccgcagccggtgcacctccgtgcgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtcgagaacccccacggcatcatctggaaggtgtccccctgcgccgcctgggtgcccagcgcggtcatcgagctcaccatgccgtccggggaggtgcggacgttccaccccatgagcggcatccccacccaggtgttcaagggcgtctccgtgacctacctggggagcgacatggaggtgtccggcctgaccgacctctgcgagatcgaggagctcaagagcaagaagctggccctggccccctgcaaccaggccgggatgggcgtcgtgggcaaggtgggggagatccagtgcagctccgaggagagcgcccgcacgatcaagaaggacggctgcatctggaacgcggacctggtcgggatcgagctgcgggtggacgacgccgtgtgctactccaagatcaccagcgtcgaggccgtggccaactactccgccatcccgaccaccatcggcgggctgcgcttcgagcggagccacgactcccagggcaagatcagcggcagccccctcgacatcacggcgatccgcgggagcttctccgtgaactaccggggcctgcgcctgagcctctccgagatcaccgcgacctgcaccggggaggtcaccaacgtgagcggctgctactcctgcatgacgggggccaaggtgagcatcaagctgcactccagcaagaactccaccgcccacgtccgctgcaagggcgacgagaccgccttcagcgtgctggagggcgtgcacagctacaccgtctccctcagcttcgaccacgccgtggtggacgagcagtgccagctgaactgcgggggccacgagtcccaggtcacgctgaaggggaacctcatcttcctggacgtgcccaagttcgtggacggcagctacatgcagacctaccactccaccgtccccaccggggccaacatcccgagccccacggactggctgaacgccctcttcggcaacggcctgtcccggtggatcctgggggtgatcggcgtgctcctcgggggcctggccctgttcttcatgatcatgagcctgttcaagctgggcaccaagcaggtcttccgctcccggaccaagctcgcgtga

SEQ ID NO: 13119 - RNA, 3222 nt, synthetic construct
  misc_feature 1..3222: note = derived and/or modified CDS sequence (opt1) from SFTSV(JS2014-Hedgehog-02)__KR230789.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcggatccgcccgaagtgctacgggttcagccggatgatggccaccctggaggtcaaccagcccgagcagcgcatcggccagtgcacggggtgccacctggagtgcatcaacggcggggtgcggctcatcaccctgacctccgagctcaagagcgcgaccgtgtgcgcctcccacttctgcagctccgccacgagcggcaagaagtccaccgagatccagttccacagcggctccctcgtcgggaagaccgccatccacgtgaagggcgccctggtcgacgggaccgagttcacgttcgagggcagctgcatgttccccgacggctgcgacgcggtggactgcaccttctgccgcgagttcctgaagaacccccagtgctacccggccaagaagtggctgttcatcatcatcgtgatcctgctggggtacgccggcctcatgctgctgaccaacgtcctcaaggccatcgggatctggggctcctgggtgatcgcccccgtgaagctgatgttcgcgatcatcaagaagctgatgcggaccgtcagctgcctcatggggaagctgatggaccgcggccgccaggtgatccacgaggagatcggcgagaaccgggaggggaaccaggacgacgtgcggatcgagatggcccgcccccgccgggtccgccactggatgtactcccccgtgatcctgacgatcctcgccatcggcctggccgagagctgcgacgagatggtgcacgccgactccaagctggtcagctgccggcaggggtccggcaacatgaaggagtgcgtgaccaccgggcgcgcgctcctgccggccgtgaaccccggccaggaggcctgcctgcacttcaccgcccccggcagccccgacagcaagtgcctcaagatcaaggtcaagcggatcaacctgaagtgcaagaagtccagctcctacttcgtgccggacgcccgcagccggtgcacgtccgtgcgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtcgagaacccccacggcatcatctggaaggtgtccccctgcgccgcctgggtgcccagcgcggtcatcgagctcaccatgccgtccggggaggtgcggaccttccaccccatgagcggcatccccacccaggtgttcaagggcgtctccgtgacctacctggggagcgacatggaggtgtccggcctgaccgacctctgcgagatcgaggagctcaagagcaagaagctggccctggccccctgcaaccaggccgggatgggcgtcgtgggcaaggtgggggagatccagtgcagctccgaggagagcgcccgcaccatcaagaaggacggctgcatctggaacgcggacctggtcgggatcgagctgcgggtggacgacgccgtgtgctactccaagatcacgagcgtcgaggccgtggccaactactccgccatcccgaccaccatcggcgggctgcgcttcgagcggagccacgactcccagggcaagatcagcggcagccccctcgacatcaccgcgatccgcgggagcttctccgtgaactaccggggcctgcgcctgagcctctccgagatcacggccacgtgcaccggggaggtcaccaacgtgagcggctgctactcctgcatgaccggggccaaggtgagcatcaagctgcactccagcaagaactccacggcccacgtccgctgcaagggcgacgagaccgcgttcagcgtgctggagggcgtgcacagctacaccgtctccctcagcttcgaccacgccgtggtggacgagcagtgccagctgaactgcgggggccacgagtcccaggtcaccctgaaggggaacctcatcttcctggacgtgcccaagttcgtggacggcagctacatgcagacgtaccactccaccgtccccaccggggccaacatcccgagccccaccgactggctgaacgccctcttcggcaacggcctgtcccggtggatcctgggggtgatcggcgtgctcctcgggggcctggccctgttcttcatgatcatgagcctgttcaagctgggcacgaagcaggtcttccgctcccggaccaagctcgcgtga

SEQ ID NO: 13120 - RNA, 3222 nt, synthetic construct
  misc_feature 1..3222: note = derived and/or modified CDS sequence (opt1) from SFTSV(KACNH)__KU507558.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccagcatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcaccgagagcggggagctctgctccagcgactccggcacgagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagggcgagagcctcccgcagcccttcgacgtcgcctggatggacgtggggcactcccacaagatcatcatgcgcgagcacaagaccaagtgggtgcaggagagctccagcaaggacttcgtctgctacaaggagggcacgggcccctgctccgagagcgaggagaaggcgtgcaagacctccgggagctgccggggcgacatgcagttctgcaaggtggccgggtgcgagcacggcgaggaggcctccgacgccaagtgccgctgcagcctggtgcacaagcccggggaggtcgtggtgagctacggcggcatgcgggtccgcccgaagtgctacgggttctcccggatgatggcgaccctggaggtgaacccgcccgagcagcgcatcggccagtgcaccgggtgccacctcgagtgcatcaacggcggggtgcggctgatcacgctgaccagcgagctcaagtccgccaccgtctgcgccagccacttctgctccagcgccacctccggcaagaagtccacggagatccagttccactccggcagcctggtggggaagaccgccatccacgtcaagggcgcgctggtggacgggaccgagttcaccttcgagggctcctgcatgttccccgacggctgcgacgccgtggactgcacgttctgccgcgagttcctcaagaacccccagtgctaccccgccaagaagtggctgttcatcctgatcgtcatcctcctggggtacgccggcctgatgctcatcaccaacgtgctgaaggccatcggggtgtggggcagctgggtcatcgcgcccgtgaagctgatgttcgccatcatcaagaagctcatgcggaccgtgtcctgcctgatggggaagctgatggaccgcggccggcaggtcatccacgaggagatcggcgagaacggggagggcaaccaggacgacgtgcgcatcgagatggcccggccccgccgcgtgcggcactggatgtacagcccggtcatcctcaccatcctggccatcgggctggccgagggctgcgacgagatggtgcacgcggactccaagctcgtgagctgccgccaggggtccggcaacatgaaggagtgcgtcacgaccggccgggccctgctgcccgccgtgaaccccgggcaggaggcctgcctccacttcaccgcccccggcagcccggacagcaagtgcctgaagatcaaggtgaagcgcatcaacctgaagtgcaagaagtccagctcctacttcgtccccgacgcgcggagccgctgcacctccgtgcggcgctgccggtgggccggggactgccagagcggctgcccgccccacttcacgtccaacagcttctccgacgactgggccgggaagatggaccgcgccggcctcggcttcagcgggtgctccgacggctgcgggggcgcggcctgcgggtgcttcaacgccgcccccagctgcatcttctggcggaagtgggtggagaacccccacggcatcatctggaaggtctccccctgcgccgcgtgggtgccgagcgccgtgatcgagctgaccatgccctccggcgaggtccgcaccttccaccccatgagcgggatccccacccaggtgttcaagggcgtgtccgtcacgtacctggggagcgacatggaggtgtccggcctcaccgacctgtgcgagatcgaggagctcaagagcaagaagctggccctggccccgtgcaaccaggccggcatgggggtggtcggcaaggtgggggagatccagtgcagctccgaggagagcgcgcggaccatcaagaaggacggctgcatctggaacgccgacctggtggggatcgagctgcgcgtcgacgacgccgtgtgctactccaagatcaccagcgtggaggccgtcgccaactactccgcgatccccacgaccatcggcggcctccggttcgagcgcagccacgactcccaggggaagatcagcggcagccccctggacatcaccgccatccgggggagcttctccgtgaactaccgcggcctgcggctcagcctgtccgagatcaccgccacgtgcaccggggaggtgaccaacgtcagcggctgctactcctgcatgaccggcgccaaggtgagcatcaagctgcactccagcaagaactccaccgcgcacgtgcgctgcaagggggacgagacggccttcagcgtcctcgagggcgtgcacagctacaccgtgtccctgagcttcgaccacgccgtcgtggacgagcagtgccagctgaactgcgggggccacgagtcccaggtgaccctcaaggggaacctgatcttcctggacgtccccaagttcgtggacggcagctacatgcagacctaccactccacggtgccgaccggcgccaacatccccagccccaccgactggctcaacgccctgttcgggaacggcctgtcccgctggatcctcggggtcatcggcgtgctgctgggcgggctcgcgctgttcttcctgatcatgagcctcttcaagctgggcaccaagcaggtcttccggtcccgcacgaagctggcctga

SEQ ID NO: 13121 - RNA, 3222 nt, synthetic construct
  misc_feature 1..3222: note = derived and/or modified CDS sequence (opt1) from SFTSV(KACNH2)__KU507559.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctcatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcaaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagcggacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgcgtccggccgaagtgctacggcttcagccgcatgatggccacgctggaggtgaacccgcccgagcagcggatcgggcagtgcaccggctgccacatcgagtgcatcaacgggggcgtgcgcctcatcaccctgacctccgagctcaagagcgcgacggtctgcgcctcccacttctgcagctccgccaccagcgggaagaagtccaccgagatccagttccacagcggctccctggtgggcaaggccgccatccacgtcaagggggcgctggtggacggcaccgagttcacgttcgaggggagctgcatgttccccgacggctgcgacgccgtggactgcaccttctgccgggagttcctgaagaacccccagtgctaccccgccaagaagtggctgttcatcatcatcgtcatcctgctgggctacgccgggctcatgctgctgaccaacgtgctcaaggccatcggcgtgtgggggtcctgggtcatcgcgcccgtgaagctgatgttcgccatcatcaagaagctgatgcgcagcgtgtcctgcctcatgggcaagctgatggaccgggggcgccaggtcatccacgaggagatcggcgagaaccgggagggcaaccaggacgacgtgcgcatcgagatggcccgcccccggcgcgtgcggcactggatgtacagcccggtcatcctgaccatcctcgccatcgggctggccgagggctgcgacgagatggtgcacgcggactccaagctggtgagctgccgccagggcggcgggaacatgaaggagtgcgtcacgaccgggcgggccctcctgcccgccgtgaaccccggccaggaggcctgcctgcacttcaccgcccccgggtccccggacagcaagtgcctcaagatcaaggtgaagcgcatcaacctgaagtgcaagaagtcctccagctacttcgtccccgacgcgcggtcccgctgcaccagcgtgcggcgctgccggtgggccggcgactgccagtccgggtgccccagccacttcacgtccaacagcttctccgacgactgggccggcaagatggaccgcgccgggctgggcttcagcggctgctccgacgggtgcggcggggcggcctgcggctgcttcaacgccgccccgagctgcatcttctggcggaagtgggtggagaacccccacgggatcatctggaaggtctccccctgcgccgcgtgggtgcccagcgccgtgatcgagctcaccatgccgtccggcgaggtccgcaccttccaccccatgagcggcatccccacccaggtgttcaagggggtgtccgtcacgtacctgggcagcgacatggaggtgtccgggctgaccgacctctgcgagatcgaggagctcaagagcaagaagctggccctggccccctgcaaccaggccggcatgggcgtggtcgggaaggtgggcgagatccagtgcagctccgaggagagcgcgcggaccatcaagaaggacgggtgcatctggaacgccgacctggtgggcatcgagctgcgcgtcgacgacgccgtgtgctactccaagatcaccagcgtggaggccgtcgccaactactccgcgatcccgacgaccatcgggggcctgcggttcgagcgcagccacgactcccagggcaagatcagcgggagccccctcgacatcaccgccatccggggcagcttctccgtgaactaccgcgggctgcgcctgagcctctccgagatcaccgccacgtgcaccggcgaggtgaccaacgtcagcgggtgctactcctgcatgaccggcgccaaggtgagcatcaagctgcactccagcaagaactccaccgcgcacgtgcggtgcaagggcgacgagacggccttcagcgtcctggaggggatccacagctacaccgtgtccctcagcttcgaccacgccgtggtcgacgagcagtgccagctgaactgcggcgggcacgagtcccaggtgaccctgaagggcaacctcatcttcctggacgtgcccaagttcgtcgacgggagctacatgcagacctaccactccagcgtgcccacgggcgccaacatcccgtcccccaccgactggctgaacgccctcttcggcaacgggctgagccgctggatcctgggcgtgatcggggtcctcctgggcggcctggccctcttcttcctgatcatgtccctgttcaagctcgggaccaagcaggtcttccggagccgcaccaagctggcgtga

SEQ ID NO: 13122 - RNA, 3222 nt, synthetic construct
  misc_feature 1..3222: note = derived and/or modified CDS sequence (opt1) from SFTSV(KACNH3)__KP663744.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcggcgccaagtgccggtgctccctggtgcacaagcccggggaggtcgtggtgagctacggcggcatgcgggtccgcccgaagtgctacgggttcagccggatgatggccacgctggaggtgaacccgcccgagcagcgcatcggccagtgcaccgggtgccacctcgagtgcatcaacggcggggtgcggctgatcaccctgacctccgagctcaagagcgcgacggtctgcgcctcccacttctgcagctccgccaccagcggcaagaagtccaccgagatccagttccacagcggctccctggtggggaagaccgccatccacgtcaagggcgccctggtggacgggacggagttcaccttcgagggcagctgcatgttccccgacggctgcgacgcggtggactgcaccttctgccgcgagttcctcaagaacccccagtgctaccccgccaagaagtggctgttcatcatcatcgtcatcctgctcgggtacgccggcctgatgctgctcaccaacgtgctgaaggccatcggggtgtggggctcctgggtcatcgcccccgtgaagctgatgttcgcgatcatcaagaagctcatgcggagcgtgtcctgcctgatggggaagctgatggaccgcggccggcaggtcatccacgaggagatcggcgagaaccgcgaggggaaccaggacgacgtgcggatcgagatggcccgcccccgccgggtgcgccactggatgtacagcccggtcatcctcacgatcctggccatcggcctggccgaggggtgcgacgagatggtgcacgccgactccaagctcgtgagctgcaagcagggctccgggaacatgaaggagtgcgtcaccaccggccgggcgctgctgcccgccgtgaaccccggccaggaggcctgcctccacttcaccgcccccgggagcccggacagcaagtgcctgaagatcaaggtgaagcgcatcaacctgaagtgcaagaagtccagctcctacttcgtccccgacgcccggagccgctgcacgtccgtgcggcgctgccggtgggcgggcgactgccagagcgggtgcccctcccacttcaccagcaactccttcagcgacgactgggccggcaagatggaccgcgccgggctcggcttctccggctgcagcgacgggtgcggcggggccgcgtgcggctgcttcaacgccgccccgtcctgcatcttctggcggaagtgggtggagaacccccacgggatcatctggaaggtcagcccctgcgccgcctgggtgccctccgcggtgatcgagctgaccatgccgagcggcgaggtccgcaccttccaccccatgtccggcatccccacccaggtgttcaagggggtgagcgtcacctacctgggctccgacatggaggtgagcgggctcaccgacctgtgcgagatcgaggagctcaagagcaagaagctggccctggccccctgcaaccaggccggcatgggcgtggtcgggaaggtgggcgagatccagtgctccagcgaggagtccgcccggaccatcaagaaggacgggtgcatctggaacgcggacctggtgggcatcgagctgcgcgtcgacgacgccgtgtgctacagcaagatcacgtccgtggaggccgtcgccaactacagcgccatcccgaccaccatcgggggcctccggttcgagcgctcccacgacagccagggcaagatctccgggagccccctggacatcaccgcgatccggggctccttcagcgtgaactaccgcgggctgcggctctccctgagcgaggtgacggccacgtgcaccggcgaggtcaccaacgtgtccgggtgctacagctgcatgaccggcgccaaggtgtccatcaagctgcacagctccaagaacagcacggcccacgtccgctgcaagggcgacgagaccgcgttcagcgtgctcgagggggtgcactcctacaccgtcagcctgtccttcgaccacgccgtggtggacgagcagtgccagctgaactgcggcgggcacgagagccaggtcaccctcaagggcaacctgatcttcctggacgtgcccaagttcgtggacgggtcctacatgcagacgtaccacagctccgtccccaccggcgccaacatcccgagccccaccgactggctcaacgccctgttcggcaacgggctgtcccgctggatcctcggcgtgatcggggtcctgctgggcggcctcgccctgttcttcctgatcatgagcctcttcaagctggggaccaagcaggtcttccggtcccgcacgaagctggcgtga

SEQ ID NO: 13123 - RNA, 3222 nt, synthetic construct
  misc_feature 1..3222: note = derived and/or modified CDS sequence (opt1) from SFTSV(KADGH)__KU507548.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcgcccagccgttcgacgtcgcgtggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggccggctgcgagcacggggaggagacgagcgtggccaagtgccggtgctccctggtccacaagcccggcgaggtggtggtcagctacgggggcatgcgggtgcgccccaagtgctacggcttcagccggatgatggccaccctggaggtgaacccgcccgagcagcgcatcgggcagtgcaccggctgccacctcgagtgcatctccgggggcgtccggctgatcaccctgacgagcgagctcaagtccgcgaccgtgtgcgccagccacttctgctccagcgccacctccgggaagaagtccaccgagatccagttccacagcggcagcctggtcggcaaggccgccatccacgtgaagggggtgctggtcgacggcacggagttcaccttcgaggggtcctgcatgttccccgacggctgcgacgcggtggactgcaccttctgccgcgagttcctcaagaacccccagtgctacccggccaagaagtggctgttcatcatcatcgtgatcctgctcggctacgccgggctgatgctgctcaccaacgtcctgaaggccatcggcgtgtgggggagctgggtgatcgcccccgtcaagctgatgttcgcgatcatcaagaagctcatgcggtccgtgagctgcctgatgggcaagctgatggaccgcgggcgccaggtgatccacgaggagatcggcgagaaccgggagggcaaccaggacgacgtccggatcgagatggcccgcccccgccgggtgcgccactggatgtactcccccgtgatcctcacgatcctggccatcgggctggccgagggctgcgacgagatggtccacgccgacagcaagctcgtgtcctgccggcaggggagcggcaacatgaaggagtgcgtgaccaccgggcgcgcgctgctgccggccgtcaaccccggccaggaggcctgcctccacttcaccgcccccggcagccccgactccaagtgcctgaagatcaaggtgaagcggatcaacctgaagtgcaagaagtccagcagctacttcgtgccggacgcccgctcccggtgcacgagcgtccgccggtgccgctgggcgggggactgccagtccggctgccccagccacttcacctccaacagcttctccgacgactgggccgggaagatggaccgggccggcctcgggttcagcggctgctccgacggctgcgggggcgccgcgtgcgggtgcttcaacgccgcccccagctgcatcttctggcgcaagtgggtggagaacccgcacggcatcatctggaaggtgtccccctgcgccgcctgggtccccagcgcggtgatcgagctgaccatgccctccggggaggtgcggaccttccacccgatgagcggcatccccacgcaggtcttcaagggcgtgtccgtgacctacctggggagcgacatggaggtcagcggcctcaccgacctgtgcgagatcgaggagctgaagtccaagaagctggccctcgccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatccccaccaccatcggcgggctccgcttcgagcggagccacgactcccagggcaagatcagcggctccccgctggacatcaccgcgatccgcgggagcttctccgtcaactaccggggcctgcgcctcagcctgtccgagatcacggcgacctgcaccggggaggtgaccaacgtgagcggctgctactcctgcatgaccggggccaaggtcagcatccgcctgcactccagcaagaacagcacggcccacgtgcggtgcaaggaggacgagaccgccttctccgtgctcgagggcgtccacagctacaccgtgtccctgagcttcgaccacgccgtggtcgacgagcagtgccagctgaactgcggcgggcacgagtcccaggtgaccctcaagggcaacctgatcttcctggacgtgcccaagttcgtcgacgggagctacatgcagacgtaccactccagcgtgcccaccggcgccaacatcccctccccgaccgactggctcaacgccctgttcgggaacggcctgagccgctggatcctcggcgtcatcggggtgctgctgggcgggctcgccctgttcttcctgatcatgtccctcttcaagctgggcaccaagcaggtcttccggagccgcacgaagctggcgtga

SEQ ID NO: 13124 - RNA, 3222 nt, synthetic construct
  misc_feature 1..3222: note = derived and/or modified CDS sequence (opt1) from SFTSV(KAGBH)__KU507560.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaagaccgccatccacgtcaagggggccctggtggacggcacggagttcaccttcgaggggagctgcatgttccccgacggctgcgacgcggtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcccccgtgaagctgatgttcgcgatcatcaagaagctcatccggagcgtgtcctgcctgatgggcaagctgatggaccgcgggcggcaggtcatccacgaggagatcggcgagaaccgcgagggcaaccaggacgacgtgcggatcgagatggcccgcccccgccgggtgcgccactggatgtacagcccggtcatcctcacgatcctggccatcgggctggccgagggctgcgacgagatggtgcacgccgactccaagctcgtgagctgcaagcaggggtccggcaacatgaaggagtgcgtcaccaccgggcgggcgctgctgcccgccgtgaaccccggccaggaggcctgcctccacttcaccgcccccggcagcccggacagcaagtgcctgaagatcaaggtgaagcgcatcaacctgaagtgcaagaagtccagctcctacttcgtccccgacgcccggagccgctgcacgtccgtgcggcgctgccggtgggcgggggactgccagagcggctgcccctcccacttcaccagcaactccttcagcgacgactgggccgggaagatggaccgcgccggcctcgggttctccggctgcagcgacggctgcgggggcgccgcgtgcgggtgcttcaacgccgccccgtcctgcatcttctggcggaagtgggtggagaacccccacggcatcatctggaaggtcagcccctgcgccgcctgggtgccctccgcggtgatcgagctgaccatgccgagcggggaggtccgcaccttccaccccatgtccggcatccccacccaggtgttcaagggcgtgagcgtcacctacctggggtccgacatggaggtgagcggcctcaccgacctgtgcgagatcgaggagctcaagagcaagaagctggccctggccccctgcaaccaggccgggatgggcgtggtcggcaaggtgggggagatccagtgctccagcgaggagtccgcccggaccatcaagaaggacggctgcatctggaacgcggacctggtggggatcgagctgcgcgtcgacgacgccgtgtgctacagcaagatcacgtccgtggaggccgtcgccaactacagcgccatcccgaccaccatcggcgggctccggttcgagcgctcccacgacagccagggcaagatctccggcagccccctggacatcaccgcgatccgggggtccttcagcgtgaactaccgcggcctgcggctctccctgagcgagatcacggccacgtgcaccggggaggtgaccaacgtctccggctgctacagctgcatgaccggggccaaggtgtccatcaagctgcacagctccaagaacagcacggcccacgtgcgctgcaagggcgacgagaccgcgttcagcgtcctcgagggcgtgcactcctacaccgtgagcctgtccttcgaccacgccgtcgtggacgagcagtgccagctgaactgcgggggccacgagagccaggtgaccctcaaggggaacctgatcttcctggacgtccccaagttcgtggacggctcctacatgcagacgtaccacagctccgtgcccaccggggccaacatcccgagccccaccgactggctcaacgccctgttcggcaacggcctgtcccgctggatcctcggggtcatcggcgtgctgctcgggggcctggccctgttcttcctgatcatgagcctcttcaagctgggcaccaagcaggtcttccggtcccgcacgaagctggcgtga

SEQ ID NO: 13125 - RNA, 3222 nt, synthetic construct
  misc_feature 1..3222: note = derived and/or modified CDS sequence (opt1) from SFTSV(KAGBH3)__KU507561.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctcatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcaaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggagacgagcgaggccaagtgccggtgctccctggtgcacaagcccggcgaggtcgtggtgagctacgggggcatgcgggtccgcccgaagtgctacggcttcagccggatgatggccaccctggaggtgaacccgcccgagcagcgcatcgggcagtgcaccggctgccacctcgagtgcatcaacgggggcgtgcggatcatcaccctgacgtccgagctcaagagcgccaccgtctgcgcgtcccacttctgcagctccgccaccagcgggaagaagtccaccgagatccagttccacagcggctccctggtgggcaagacggccatccacgtcaagggggccctggtggacggcaccgagttcaccttcgaggggagctgcatgttccccgacggctgcgacgccgtggactgcaccttctgccgcgagttcctgaagaacccccagtgctaccccgcgaagaagtggctgttcatcatcatcgtcatcctgctgggctacgccgggctcatgctgctgacgaacgtgctcaaggccatcggcgtgtgggggtcctgggtcatcgcccccgtgaagctgatgttcgccatcatcaagaagctgatgcggagcgtgtcctgcctcatgggcaagctgatggaccgcgggcggcaggtcatccacgaggagatcggcgagaaccgcgagggcaaccaggacgacgtgcggatcgagatggcgcgcccccgccgggtgcgccactggatgtacagcccggtcatcctgaccatcctcgccatcgggctggccgagggctgcgacgagatggtgcacgccgactccaagctggtgctctgcaagcaggggagcggcaacatgaaggagtgcgtcaccaccgggcgggccctgctgcccgcggtgaaccccggccaggaggcctgcctccacttcacggcccccggctccccggacagcaagtgcctgaagatcaaggtgaagcgcatcaacctgaagtgcaagaagtcctccagctacttcgtccccgacgcccggtcccgctgcaccagcgtgcggcgctgccggtgggccggggactgccagtccggctgccccagccacttcacctccaacagcttctccgacgactgggcggggaagatggaccgcgccggcctcgggttcagcggctgctccgacggctgcgggggcgccgcctgcgggtgcttcaacgcggccccgagctgcatcttctggcggaagtgggtggagaacccccacggcatcatctggaaggtctccccctgcgccgcctgggtgcccagcgccgtgatcgagctgaccatgccgtccggggaggtccgcacgttccaccccatgagcggcatccccacccaggtgttcaagggcgtgtccgtcacctacctggggagcgacatggaggtgtccggcctcaccgacctgtgcgagatcgaggagctcaagagcaagaagctggcgctggccccctgcaaccaggccgggatgggcgtggtcggcaaggtgggggagatccagtgcagctccgaggagagcgcccggacgatcaagaaggacggctgcatctggaacgccgacctggtggggatcgagctgcgcgtcgacgacgcggtgtgctactccaagatcaccagcgtggaggccgtcgccaactactccgccatcccgaccaccatcggcgggctccggttcgagcgcagccacgactcccagggcaagatcagcggcagccccctggacatcacggccatccgggggagcttctccgtgaactaccgcggcctgcggctcagcctgtccgagatcaccgcgacctgcaccggggaggtgaccaacgtcagcggctgctactcctgcatgacgggggccaaggtgagcatcaagctgcactccagcaagaactccaccgcccacgtgcgctgcaagggcgacgagaccgccttcagcgtcctcgagggcgtgcacagctacgcggtgtccctgagcttcgaccacgccgtcgtggacgagcagtgccagctgaactgcgggggccacgagtcccaggtgaccctcaaggggaacctgatcttcctggacgtccccaagttcgtggacggcagctacatgcagacgtaccactccagcgtgcccaccggggccaacatcccgtcccccaccgactggctcaacgccctgttcggcaacggcctgagccgctggatcctcggggtcatcggcgtgctgctcgggggcctggccctgttcttcctgatcatgtccctcttcaagctgggcaccaagcaggtcttccggagccgcacgaagctggcgtga

SEQ ID NO: 13126 - RNA, 3222 nt, synthetic construct
  misc_feature 1..3222: note = derived and/or modified CDS sequence (opt1) from SFTSV(KAGBH4)__KU507562.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaagaccgccatccacgtcaagggggccctggtggacggcacggagttcaccttcgaggggagctgcatgttccccgacggctgcgacgcggtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcccccgtgaagctgatgttcgcgatcatcaagaagctcatgcggagcgtgtcctgcctgatgggcaagctgatggaccgcgggcggcaggtcatccacgaggagatcggcgagaaccgcgagggcaaccaggacgacgtgcggatcgagatggcccgcccccgccgggtgcgccactggatgtacagcccggtcatcctcacgatcctggccatcgggctggccgagggctgcgacgagatggtgcacgccgactccaagctcgtgagctgcaagcaggggtccggcaacatgaaggagtgcgtcaccaccgggcgggcgctgctgcccgccgtgaaccccggccaggaggcctgcctccacttcaccgcccccggcagcccggacagcaagtgcctgaagatcaaggtgaagcgcatcaacctgaagtgcaagaagtccagctcctacttcgtccccgacgcccggagccgctgcacgtccgtgcggcgctgccggtgggcgggggactgccagagcggctgcccctcccacttcaccagcaactccttcagcgacgactgggccgggaagatggaccgcgccggcctcgggttctccggctgcagcgacggctgcgggggcgccgcgtgcgggtgcttcaacgccgccccgtcctgcatcttctggcggaagtgggtggagaacccccacggcatcatctggaaggtcagcccctgcgccgcctgggtgccctccgcggtgatcgagctgaccatgccgagcggggaggtccgcaccttccaccccatgtccggcatccccacccaggtgttcaagggcgtgagcgtcacctacctggggtccgacatggaggtgagcggcctcaccgacctgtgcgagatcgaggagctcaagagcaagaagctggccctggccccctgcaaccaggccgggatgggcgtggtcggcaaggtgggggagatccagtgctccagcgaggagtccgcccggaccatcaagaaggacggctgcatctggaacgcggacctggtggggatcgagctgcgcgtcgacgacgccgtgtgctacagcaagatcacgtccgtggaggccgtcgccaactacagcgccatcccgaccaccatcggcgggctccggttcgagcgctcccacgacagccagggcaagatctccggcagccccctggacatcaccgcgatccgggggtccttcagcgtgaactaccgcggcctgcggctctccctgagcgagatcacggccacgtgcaccggggaggtgaccaacgtctccggctgctacagctgcatgaccggggccaaggtgtccatcaagctgcacagctccaagaacagcacggcccacgtgcgctgcaagggcgacgagaccgcgttcagcgtcctcgagggcgtgcactcctacaccgtgagcctgtccttcgaccacgccgtcgtggacgagcagtgccagctgaactgcgggggccacgagagccaggtgaccctcaaggggaacctgatcttcctggacgtccccaagttcgtggacggctcctacatgcagacgtaccacagctccgtgcccaccggggccaacatcccgagccccaccgactggctcaacgccctgttcggcaacggcctgtcccgctggatcctcggggtcatcggcgtgctgctcgggggcctggccctgttcttcctgatcatgagcctcttcaagctgggcaccaagcaggtcttccggtcccgcacgaagctggcgtga

SEQ ID NO: 13127 - RNA, 3222 nt, synthetic construct
  misc_feature 1..3222: note = derived and/or modified CDS sequence (opt1) from SFTSV(KAGBH5)__KP663738.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccctctacaaggggaaggtgttcttcgagcggcccaccttcgacggctacgtgggctgggggtgcggcagcgggaagtcccgcacggagagcggcgagctgtgctccagcgacagcggcacctccagcgggctgctcccctccgaccgggtcctgtggatcggcgacgtggcctgccagccgatgacccccatccccgaggagaccttcctggagctcaagagcttctcccagagcgagttccccgacatctgcaagatcgacgggatcgtgttcaaccagtgcgagtccgagagcctgccgcagcccttcgacgtcgcctggatggacgtgggccactcccacaagatcatcatgcgcgagcacaagacgaagtgggtgcaggagagctccagcaaggacttcgtctgctacaaggaggggaccggcccctgctccgagagcgaggagaagacctgcaagacctccggcagctgccgcggggacatgcagttctgcaaggtggcgggctgcgagcacggggaggagacgtccgaggccaagtgccggtgcagcctggtgcacaagcccggcgaggtcgtggtgtcctacgggggcatgcgggtccgcccgaagtgctacggcttcagccggatgatggccaccctcgaggtgaacccgcccgagcagcgcatcgggcagtgcaccggctgccacctggagtgcatcaacgggggcgtgcggctgatcaccctcacgagcgagctgaagtccgccaccgtctgcgcgagccacttctgctccagcgccacctccgggaagaagtccaccgagatccagttccacagcggcagcctggtgggcaagacggccatccacgtcaagggggccctcgtggacggcaccgagttcaccttcgaggggcgctgcatgttccccgacggctgcgacgccgtggactgcaccttctgccgggagttcctgaagaacccccagtgctaccccgcgaagaagtggctgttcatcatcatcgtcatcctcctgggctacgccgggctgatgctcctgacgaacgtgctgaaggccgtgggcgtctgggggtcctgggtgatcgcccccgtgaagctcatgttcgccatcatcaagaagctgatgcgcagcgtctcctgcctgatgggcaagctcatggaccgggggcgccaggtgatccacgaggagatcggcgagaaccgggagggcaaccaggacgacgtgcgcatcgagatggcgcgcccccggcgcgtccggcactggatgtacagcccggtgatcctggccatcctggccatcgggctcgccgagggctgcgacgagatggtgcacgccgactccaagctggtcagctgcaagcaggggtccggcaacatgaaggagtgcgtgaccaccgggcgcgcgctgctccccgccgtgaaccccggccaggaggcctgcctgcacttcaccgcccccggcagcccggactccaagtgcctgaagatcaaggtcaagcggatcaacctcaagtgcaagaagtccagcagctacttcgtgcccgacgcccgcagccggtgcacgtccgtgcgccggtgccgctgggcgggggactgccagagcggctgcccctcccacttcaccagcaactccttcagcgacgactgggccgggaagatggaccgggccggcctggggttctccggctgcagcgacggctgcgggggcgccgcgtgcgggtgcttcaacgccgccccgtcctgcatcttctggcgcaagtgggtcgagaacccccacggcatcatctggaaggtgagcccctgcgccgcctgggtgccctccgcggtcatcgagctgaccatgccgagcggggaggtgcggaccttccaccccatgtccggcatccccacccaggtgttcaagggcgtcagcgtgacctacctcgggtccgacatggaggtgagcggcctgaccgacctgtgcgagatcgaggagctgaagtccaagaagctcgccctggccccctgcaaccaggccgggatgggcgtcgtgggcaaggtgggggagatccagtgcagcagcgaggagtccgcccgcaccatcaagaaggacggctgcatctggaacgcggacctggtcgggatcgagctccgggtggacgacgccgtgtgctacagcaagatcacgtccgtcgaggccgtggccaactacagcgccatcccgaccaccatcggcgggctgcgcttcgagcggtcccacgacagccagggcaagatctccggcagccccctggacatcaccgcgatccgcgggtccttcagcgtgaactaccggggcctccgcctgtccctgagcgagatcacggccacgtgcaccggggaggtcaccaacgtgtccggctgctacagctgcatgaccggggccaaggtgtccatcaagctccacagctccaagaacagcacggcccacgtccgctgcaagggcgacgagaccgcgttctccgtgctggagggcgtgcacagctacaccgtcagcctgtccttcgaccacgccgtggtggacgagcagtgccagctcaactgcgggggccacgagagccaggtcaccctgaaggggaacctgatcttcctcgacgtgcccaagttcgtggacggctcctacatgcagacgtaccacagctccgtccccaccggggccaacatcccgagccccaccgactggctgaacgccctgttcggcaacggcctctcccggtggatcctgggggtgatcggcgtcctgctcgggggcctggccctgttcttcctcatcatgagcctgttcaagctgggcaccaagcaggtcttccgctcccggacgaagctcgcgtga

SEQ ID NO: 13128 - RNA, 3222 nt, synthetic construct
  misc_feature 1..3222: note = derived and/or modified CDS sequence (opt1) from SFTSV(KAGBH6)__KP663741.1__GP
  source 1..3222: mol_type = other RNA
atgatcaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaagaccgccatccacgtcaagggggccctggtggacggcacggagttcaccttcgaggggagctgcatgttccccgacggctgcgacgcggtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcccccgtgaagctgatgttcgcgatcatcaagaagctcatccggagcgtgtcctgcctgatgggcaagctgatggaccgcgggcggcaggtcatccacgaggagatcggcgagaaccgcgagggcaaccaggacgacgtgcggatcgagatggcccgcccccgccgggtgcgccactggatgtacagcccggtcatcctcacgatcctggccatcgggctggccgagggctgcgacgagatggtgcacgccgactccaagctcgtgagctgcaagcaggggtccggcaacatgaaggagtgcgtcaccaccgggcgggcgctgctgcccgccgtgaaccccggccaggaggcctgcctccacttcaccgcccccggcagcccggacagcaagtgcctgaagatcaaggtgaagcgcatcaacctgaagtgcaagaagtccagctcctacttcgtccccgacgcccggagccgctgcacgtccgtgcggcgctgccggtgggcgggggactgccagagcggctgcccctcccacttcaccagcaactccttcagcgacgactgggccgggaagatggaccgcgccggcctcgggttctccggctgcagcgacggctgcgggggcgccgcgtgcgggtgcttcaacgccgccccgtcctgcatcttctggcggaagtgggtggagaacccccacggcatcatctggaaggtcagcccctgcgccgcctgggtgccctccgcggtgatcgagctgaccatgccgagcggggaggtccgcaccttccaccccatgtccggcatccccacccaggtgttcaagggcgtgagcgtcacgtacctggggtccgacatggaggtgagcggcctcaccgacctgtgcgagatcgaggagctcaagagcaagaagctggccctggccccctgcaaccaggccgggatgggcgtggtcggcaaggtgggggagatccagtgctccagcgaggagtccgcccggaccatcaagaaggacggctgcatctggaacgcggacctggtggggatcgagctgcgcgtcgacgacgccgtgtgctacagcaagatcacgtccgtggaggccgtcgccaactacagcgccatcccgaccaccatcggcgggctccggttcgagcgctcccacgacagccagggcaagatctccggcagccccctggacatcaccgcgatccgggggtccttcagcgtgaactaccgcggcctgcggctctccctgagcgagatctccgccacgtgcaccggggaggtgaccaacgtcagcggctgctactcctgcatgaccggggccaaggtgagcatcaagctgcactccagcaagaacagcaccgcccacgtgcgctgcaagggcgacgagacggcgttctccgtcctcgagggcgtgcacagctacaccgtgtccctgagcttcgaccacgccgtcgtggacgagcagtgccagctgaactgcgggggccacgagtcccaggtgaccctcaaggggaacctgatcttcctggacgtccccaagttcgtggacggcagctacatgcagacctaccactccagcgtgcccacgggggccaacatcccgtcccccaccgactggctcaacgccctgttcggcaacggcctgagccgctggatcctcggggtcatcggcgtgctgctcgggggcctggccctgttcttcctgatcatgtccctcttcaagctgggcaccaagcaggcgttccggagccgcaccaagctggcctga

SEQ ID NO: 13129 - RNA, 3222 nt, synthetic construct
  misc_feature 1..3222: note = derived and/or modified CDS sequence (opt1) from SFTSV(KAGNH)__KU507550.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcgccggggcggccgctcccaggtcagctacttccccgcggagaactcctacagccggtggtccgggctgctcagcccctgcgacgccgactggctgggcatgctggtggtgaagaaggccaaggggtccgacatgatcgtcccgggccccagctacaaggggaaggtgttcttcgagcgccccaccttcgacggctacgtgggctgggggtgcggctccggcaagagccggacggagtccggggagctctgcagcagcgactccggcaccagctccgggctgctgcccagcgaccgcgtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgggagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgcgtccggccgaagtgctacggcttcagccgcatgatggccacgctggaggtgaacccgcccgagcagcggatcgggcagtgcaccggctgccacctcgagtgcatcaacgggggcgtgcgcctgatcaccctgacctccgagctcaagagcgcgacggtctgcgcctcccacttctgcagctccgccaccagcgggaagaagtccaccgagatccagttccacagcggctccctggtgggcaagaccgccatccacgtcaagggggccctggtggacggcacggagttcaccttcgaggggagctgcatgttccccgacggctgcgacgcggtggactgcaccttctgccgggagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcccccgtgaagctgatgttcgcgatcatcaagaagctcatccgcagcgtgtcctgcctgatgggcaagctgatggaccgggggcgccaggtcatccacgaggagatcggcgagaaccgggagggcaaccaggacgacgtgcgcatcgagatggcccgcccccggcgcgtgcggcactggatgtacagcccggtcatcctcacgatcctggccatcgggctggccgagggctgcgacgagatggtgcacgccgactccaagctcgtgagctgcaagcaggggtccggcaacatgaaggagtgcgtcaccaccgggcgcgcgctgctgcccgccgtgaaccccggccaggaggcctgcctccacttcaccgcccccggcagcccggacagcaagtgcctgaagatcaaggtgaagcggatcaacctgaagtgcaagaagtccagctcctacttcgtccccgacgcccgcagccggtgcacgtccgtgcgccggtgccgctgggcgggggactgccagagcggctgcccctcccacttcaccagcaactccttcagcgacgactgggccgggaagatggaccgggccggcctcgggttctccggctgcagcgacggctgcgggggcgccgcgtgcgggtgcttcaacgccgccccgtcctgcatcttctggcgcaagtgggtggagaacccccacggcatcatctggaaggtcagcccctgcgccgcctgggtgccctccgcggtgatcgagctgaccatgccgagcggggaggtccggaccttccaccccatgtccggcatccccacccaggtgttcaagggcgtgagcgtcacctacctggggtccgacatggaggtgagcggcctcaccgacctgtgcgagatcgaggagctcaagagcaagaagctggccctggccccctgcaaccaggccgggatgggcgtggtcggcaaggtgggggagatccagtgctccagcgaggagtccgcccgcaccatcaagaaggacggctgcatctggaacgcggacctggtggggatcgagctgcgggtcgacgacgccgtgtgctacagcaagatcacgtccgtggaggccgtcgccaactacagcgccatcccgaccaccatcggcgggctccgcttcgagcggtcccacgacagccagggcaagatctccggcagccccctggacatcaccgcgatccgcgggtccttcagcgtgaactaccggggcctgcgcctctccctgagcgagatcacggccacgtgcaccggggaggtgaccaacgtctccggctgctacagctgcatgaccggggccaagatctccatcaagctgcacagctccaagaacagcacggcccacgtgcgctgcaagggcgacgagaccgcgttcagcgtgctcgagggcgtccactcctacaccgtgagcctgtccttcgaccacgccgtggtcgacgagcagtgccagctgaactgcgggggccacgagagccaggtgaccctcaaggggaacctgatcttcctggacgtgcccaagttcgtcgacggctcctacatgcagacgtaccacagctccgtgcccaccggggccaacatcccgagccccaccgactggctcaacgccctgttcggcaacggcctgtcccggtggatcctcggggtgatcggcgtcctgctcgggggcctggccctgttcttcctgatcatgagcctcttcaagctgggcaccaaccaggtgttccgctcccggacgaagctggcgtga

SEQ ID NO: 13130 - RNA, 3222 nt, synthetic construct
  misc_feature 1..3222: note = derived and/or modified CDS sequence (opt1) from SFTSV(KAGNH4)__KU507551.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcggatccgcccgaagtgctacggcttcagccggatgatggccacgctggaggtcaacccgcccgagcagcgcatcgggcagtgcaccggctgccacctcgagtgcatcaacgggggcgtgcggctgatcaccctgacctccgagctcaagagcgcgacggtgtgcgcctcccacttctgcagctccgccaccagcgggaagaagtccaccgagatccagttccacagcggctccctggtcggcaagaccgccatccacgtgaagggggccctggtcgacggcacggagttcaccttcgaggggagctgcatgttccccgacggctgcgacgcggtggactgcaccttctgccgcgagttcctcaagaacccccagtgctaccccgccaagaagtggctgttcatcatcatcgtgatcctgctcggctacgccgggctgatgctgctcaccaacgtcctgaaggccatcggcgtgtgggggtcctgggtgatcgcccccgtcaagctgatgttcgcgatcatcaagaagctcatgcggagcgtgtcctgcctgatgggcaagctgatggaccgcgggcgccaggtgatccacgaggagatcggcgagaaccgggagggcaaccaggacgacgtccggatcgagatggcccgcccccgccgggtgcgccactggatgtacagcccggtgatcctcacgatcctggccatcgggctggccggcgggtgcgacgagatggtccacgccgactccaagctcgtgagctgccggcagggctccgggaacatgaaggagtgcgtgaccaccggccgcgcgctgctgcccgccgtcaaccccggccaggaggcctgcctccacttcaccgcccccgggagcccggacagcaagtgcctgaagatccgggtgaagcgcatcaacctgaagtgcaagaagtccagctcctacttcgtgcccgacgcccggagccgctgcacgtccgtccggcgctgccggtgggcgggcgactgccagagcgggtgcccctcccacttcaccagcaactccttcagcgacgactgggccggcaagatggaccgcgccgggctcggcttctccggctgcagcgacgggtgcggcggggccgcgtgcggctgcttcaacgccgccccgtcctgcatcttctggcggaagtgggtggagaacccccacgggatcatctggaaggtgagcccctgcgccgcctgggtcccctccgcggtgatcgagctgaccatgccgagcggcgaggtgcgcaccttccaccccatgtccggcatccccacgcaggtcttcaagggggtgagcgtgacctacctgggctccgacatggaggtcagcgggctcaccgacctgtgcgagatcgaggagctcaagagccggaagctggccctggccccctgcaaccaggccggcatgggcgtggtggggaaggtcggcgagatccagtgctccagcgaggagtccgcccgcaccatcaagaaggacgggtgcatctggaacgcggacctggtgggcatcgagctgcgggtggacgacgccgtctgctacagcaagatcacgtccgtggaggccgtggccaactacagcgccatcccgaccaccatcgggggcctccgcttcgagcggtcccacgacagccagggcaagatctccgggagccccctggacatcaccgcgatccgcggctccttcagcgtcaactaccgcgggctgcggctctccctgagcgagatcacggcgacctgcaccggcgaggtgaccaacgtgtccgggtgctacagctgcatgaccggcgccaaggtctccatcaagctgcacagctccaagaacagcacggcccacgtgcgctgcaagggcgacgagaccgccttcagcgtgctcgagggggtccactcctacaccgtgagcctgtccttcgaccacgccgtggtcgacgagcagtgccagctgaactgcggcgggcacgagagccaggtgaccctcaagggcaacctgatcttcctggacgtgcccaagttcgtcgacgggtcctacatgcagacgtaccacagctccgtgcccaccggcgccaacatcccgagccccaccgactggctcaacgccctgttcggcaacgggctgtcccggtggatcctcggcgtgatcggggtcctgctgggcggcctcgccctgttcctgctcatcatgagcctgttcaagctggggaccaagcaggtcttccgctcccggacgaagctcgcgtga

SEQ ID NO: 13131 - RNA, 3222 nt, synthetic construct
  misc_feature 1..3222: note = derived and/or modified CDS sequence (opt1) from SFTSV(KAGWH2)__KU507564.1__GP
  source 1..3222: mol_type = other RNA
atgatgaaggtgatctggttcagctccctgatctgcctcgtgatccagtgcggcggggacaccggccccatcatctgcgccgggccgatccacagcaacaagtccgccggcatcccccacctcctggggtacagcgagaagatctgccagatcgaccgcctgatccacgtgtccagctggctgcggaaccactcccagttccagggctacgtgggccagcgcgggggccggagccaggtctcctactaccccgcggagaacagctactcccgctggagcgggctgctctccccctgcgacgccgactggctgggcatgctggtggtgaagaaggccaaggggagcgacatgatcgtcccgggcccctcctacaagggcaaggtgttcttcgagcggcccaccttcgacgggtacgtgggctgggggtgcggcagcggcaagtcccgcacggagagcggggagctctgctccagcgacagcggcacctccagcgggctgctgccctccgaccgggtcctctggatcggcgacgtggcctgccagccgatgacccccatccccgaggagaccttcctggagctcaagagcttctcccagagcgagttccccgacgtgtgcaagatcgacgggatcgtcttcaaccagtgcgagggcgagtccctgccgcagcccttcgacgtggcctggatggacgtgggccacagccacaagatcatcatgcgcgagcacaagacgaagtgggtccaggagtccagctccaaggacttcgtgtgctacaaggaggggaccggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtccacaagcccggcgaggtggtggtcagctacgggggcatgcgggtgcgcccgaagtgctacgggttctcccggatgatggccacgctggaggtgaacccgcccgagcagcgcatcggccagtgcaccgggtgccacctcgagtgcatcaacggcggcgtccggctgatcaccctgaccagcgagctcaagagcgcgacggtgtgcgcctcccacttctgcagctccgccaccagcgggaagaagtccaccgagatccagttccacagcggctccctggtcgggaagaccgccatccacgtgaagggcgccctggtggacggcacggagttcaccttcgaggggagctgcatgttccccgacggctgcgacgcggtcgactgcaccttctgccgcgagttcctcaagaacccccagtgctaccccgccaagaagtggctgttcatcatcatcgtgatcctgctcgggtacgccggcctgatgctgctcaccaacgtgctgaaggccatcggggtctggggctcctgggtgatcgcccccgtgaagctggtcttcgcgatcatcaagaagctcatgcgggccgtgagctgcctgatgggcaagctgatggaccgcgggcgccaggtgatccacgaggagatcggcgagaaccgggaggggaaccaggacgacgtccggatcgagatggcccgcccccgccgggtgcgccactggatgtactccccggtgatcctcacgatcctggccatcggcctggccgaggggtgcgacgagatggtccacgcggacagcaagctcgtgtcctgccggcagggcagcggcaacatgaaggagtgcgtgaccaccgggcgcgccctgctgcccgccgtcaaccccggccaggaggcctgcctccacttcaccgcccccgggtccccggacagcaagtgcctgaagatcaaggtgaagcggatcaacctgaagtgcaagaagtccagcagctacttcgtgcccgacgcgcgctcccggtgcacgagcgtccgccggtgccgctgggccggcgactgccagtccgggtgcccgccccacttcaccagcaactccttcagcgacgactgggccggcaagatggaccgggccggcctcgggttctccggctgcagcgacgggtgcggcggggcggcctgcggctgcttcaacgccgccccctcctgcatcttctggcgcaagtgggtggagaacccccacggcatcatctggaaggtgagcccctgcgccgcgtgggtcccgtccgccgtgatcgagctgaccatgcccagcggggaggtgcggaccttccaccccatgtccggcatccccacgcaggtcttcaagggggtgagcgtgacctacctgggctccgacatggaggtcagcggcctcaccgacctgtgcgagatcgaggagctgaagtccaagaagctggccctcgccccgtgcaaccaggccgggatgggcgtggtggggaaggtcggcgagatccagtgcagctccgaggagagcgcgcgcaccatcaagaaggacgggtgcatctggaacgccgacctggtgggcatcgagctgcgggtggacgacgccgtctgctacagcaagatcacgtccgtggaggccgtggccaactacagcgcgatccccaccaccatcggcgggctccgcttcgagcggtcccacgacagccagggcaagatctccgggagccccctggacatcaccgccatccgcggctccttcagcgtcaactaccgggggctgcgcctctccctgagcgagatcacggcgacctgcaccggcgaggtgaccaacgtgtccggctgctacagctgcatgaccggggccaaggtctccatcaagctgcacagctccaagaacagcacggcccacgtgcgctgcaagggcgacgagaccgccttctccgtgctcgagggggtccacagctactccgtgagcctgagcttcgaccacgccgtggtcgacgagcagtgccagctgaactgcggcgggcacgagtcccaggtgaccctccggggcaacctgatcttcctggacgtgcccaagttcgtcgacggcagctacatgcagacctaccactccacggtgccgaccggggccaacatccccagccccaccgactggctcaacgccctgttcggcaacgggctgtcccgctggatcctcggcgtcatcggcgtgctgctcgggggcctggcgctgttcttcctgatcatgagcctcttcaagctggggaccaagcaggtcttccggtcccgcacgaagctggcctga

SEQ ID NO: 13132 - RNA, 3222 nt, synthetic construct
  misc_feature 1..3222: note = derived and/or modified CDS sequence (opt1) from SFTSV(KAGWH3)__KP663735.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctgatcgtgaagaaggccaaggggtccgacatgatcgtgccgggccccagctacaaggggaaggtcttcttcgagcggcccaccttcgacggctacgtgggctgggggtgcggctccggcaagagccgcacggagtccggggagctctgcagcagcgactccggcaccagctccgggctgctgcccagcgaccgggtgctctggatcggcgacgtcgcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtggcctggatggacgtcggccacagccacaagatcatcatgcgcgagcacaagacgaagtgggtgcaggagtccagctccaaggacttcgtgtgctacaaggaggggaccggcccctgcagcgagtccgaggagaagacctgcaagaccagcggctcctgccgcggggacatgcagttctgcaaggtcgcgggctgcgagcacggggaggaggccagcgaggccaagtgccggtgctccctggtgcacaagcccggcgaggtggtcgtgagctacgggggcatgcgggtgcgcccgaagtgctacggcttcagccggatgatggccacgctggaggtcaacccgcccgagcagcgcatcgggcagtgcaccggctgccacctcgagtgcatcaacgggggcgtgcggctgatcaccctgacctccgagctcaagagcgcgacggtgtgcgcctcccacttctgcagctccgccaccagcgggaagaagtccaccgagatccagttccacagcggctccctggtcggcaagaccgccatccacgtgaagggggccctggtcgacggcacggagttcaccttcgaggggagctgcatgttccccgacggctgcgacgcggtggactgcaccttctgccgcgagttcctcaagaacccccagtgctaccccgccaagaagtggctgttcatcatcatcgtgatcctgctcggctacgccgggctgatgctgctcaccaacgtcctgaaggccatcggcgtgtgggggtcctgggtgatcgcccccgtcaagctgatgttcgcgatcatcaagaagctcatgcggagcgtgtcctgcctgatgggcaagctgatggaccgcgggcgccaggtgatccacgaggagatcggcgaggtccgggagggcaaccaggacgacgtgcggatcgagatggcccgcccccgccgggtgcgccactggatgtacagcccggtcatcctcacgatcctggccatcgggctggccgagggctgcgacgagatggtgcacgccgactccaagctcgtgagctgcaagcaggggtccggcaacatgaaggagtgcgtcaccaccgggcgggcgctgctgcccgccgtgaaccccggccaggaggcctgcctccacttcaccgcccccggcagcccggacagcaagtgcctgaagatcaaggtgaagcgcatcaacctgaagtgcaagaagtccagctcctacttcgtccccgacgcccggagccgctgcacgtccgtgcggcgctgccggtgggcgggggactgccagagcggctgcccctcccacttcaccagcaactccttcagcgacgactgggccgggaagatggaccgcgccggcctcgggttctccggctgcagcgacggctgcgggggcgccgcgtgcgggtgcttcaacgccgccccgtcctgcatcttctggcggaagtgggtggagaacccccacggcatcatctggaaggtcagcccctgcgccgcctgggtgccctccgcggtgatcgagctgaccatgccgagcggggaggtccgcaccttccaccccatgtccggcatccccacccaggtgttcaagggcgtgagcgtcacctacctggggtccgacatggaggtgagcggcctcaccgacctgtgcgagatcgaggagctcaagagcaagaagctggccctggccccctgcaaccaggccgggatgggcgtggtcggcaaggtgggggagatccagtgctccagcgaggagtccgcccggaccatcaagaaggacggctgcatctggaacgcggacctggtggggatcgagctgcgcgtcgacgacgccgtgtgctacagcaagatcacgtccgtggaggccgtcgccaactacagcgccatcccgaccaccatcggcgggctccggttcgagcgctcccacgacagccagggcaagatctccggcagccccctggacatcaccgcgatccgggggtccttcagcgtgaactaccgcggcctgcggctctccctgagcgagatcacggccacgtgcaccggggaggtgaccaacgtctccggctgctacagctgcatgaccggggccaaggtgtccatcaagctgcacagctccaagaacagcacggcccacgtgcgctgcaagggcgacgagaccgcgttcagcgtcctcgagggcgtgcactcctacaccgtgagcctgtccttcgaccacgccgtcgtggacgagcagtgccagctgaactgcgggggccacgagagccaggtgaccctcaaggggaacctgatcttcctggacgtccccaagttcgtggacggctcctacatgcagacgtaccacagctccgtgcccaccggggccaacatcccgagccccaccgactggctcaacgccctgttcggcaacggcctgtcccgctggatcctcggggtcatcggcgtgctgctcgggggcctggccctgttcttcctgatcatgagcctcttccggctgggcaccaagcaggtcttccgctcccggacgaagctggcgtga

SEQ ID NO: 13133 - RNA, 3222 nt, synthetic construct
  misc_feature 1..3222: note = derived and/or modified CDS sequence (opt1) from SFTSV(KAICH)__KU507565.1__GP
  source 1..3222: mol_type = other RNA
atgatgaaggtgatctggttcagctccctgatctgcctcgtgatccagtgcggcggggacaccagccccatcatctgcgccggcccgatccactccaacaagagcgccgacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagggcgagagcctcccgcagcccttcgacgtcgcctggatggacgtggggcactcccacaagatcatcatgcgcgagcacaagacgaagtgggtgcaggagagctccagcaaggacttcgtctgctacaaggagggcaccggcccctgctccgagagcgaggagaagacctgcaagacctccgggagctgccggggcgacatgcagttctgcaaggtggcggggtgcgagcacggcgaggaggcctccgaggccaagtgccgctgcagcctggtgcacaagcccggggaggtcgtggtgtcctacggcggcatgcgggtccgcccgaagtgctacgggttcagccggatgatggccacgctggaggtgaaccagcccgagcagcgcatcggccagtgcaccgggtgccacctcgagtgcatcagcggcggggtgcggctgatcaccctgacctccgagctcaagagcgcgacggtctgcgcctcccacttctgcagctccgccaccagcggcaagaagtccaccgagatccagttccacagcggctccctggtggggaagaccgccatccacgtcaagggcgccctggtggacgggacggagttcaccttcgagggcagctgcatgttccccgacggctgcgacgcggtggactgcaccttctgccgcgagttcctcaagaacccccagtgctacccggccaagaagtggctgttcatcatcatcgtcatcctgctcgggtacgccggcctgatgctgctcaccaacgtgctgaaggccatcggggtgtggggctcctgggtcatcgcccccgtgaagctggtgttcgcgatcatcaagaagctcatgcgggccgtcagctgcctgatggggaagctgatggaccgcggccgccaggtgatccacgaggagatcggcgagaaccgggaggggaaccaggacgacgtgcggatcgagatggcccgcccccgccgggtccgccactggatgtactcccccgtgatcctcacgatcctggccatcggcctggccgaggggtgcgacgagatggtgcacgcggacagcaagctcgtctcctgccggcagggcagcgggaacatgaaggagtgcgtgaccaccggccgcgccctgctgccggccgtgaaccccggccaggaggcctgcctccacttcaccgcccccgggtcccccgacagcaagtgcctgaagatcaaggtcaagcggatcaacctgaagtgcaagaagtccagcagctacttcgtgccggacgcgcgctcccggtgcacgagcgtgcgccggtgccgctgggccggcgactgccagtccgggtgcccgccccacttcaccagcaactccttcagcgacgactgggccggcaagatggaccgggccgggctcggcttctccggctgcagcgacgggtgcggcggggcggcctgcggctgcttcaacgccgccccctcctgcatcttctggcgcaagtgggtcgagaacccccacgggatcatctggaaggtgagcccctgcgccgcgtgggtgccctccgccgtcatcgagctgaccatgccgagcggcgaggtgcggaccttccaccccatgtccggcatccccacccaggtgttcaagggggtcagcgtgacctacctgggctccgacatggaggtgagcgggctcaccgacctgtgcgagatggaggagctgaagtccaagaagctggccctcgccccctgcaaccaggccggcatgggcgtcgtggggaaggtgggcgagatccagtgcagcagcgaggagtccgcgcgcaccatcaagaaggacgggtgcatctggaacgccgacctggtcggcatcgagctgcgggtggacgacgccgtgtgctacagcaagatcacgtccgtcgaggccgtgaccaactacagcgccatcccgaccaccatcgggggcctccgcttcgagcggtcccacgacagccagggcaagatctccgggagccccctggacatcacggcgatccgcggctccttcagcgtgaactaccgggggctgcgcctctccctgagcgagatcaccgccacgtgcaccggcgaggtcaccaacgtgtccgggtgctacagctgcatgacgggcgccaaggtgtccatcaagctgcacagctccaagaacagcaccgcccacgtccgctgcaagggcgacgagaccgcgttctccgtgctcgagggggtgcacagctacagcgtctccctgagcttcgaccacgccgtggtggacgagcagtgccagctgaactgcggcgggcacgagtccaaggtcaccctccggggcaacctgatcttcctggacgtgcccaagttcgtggacgggagctacatgcagacgtaccactccaccgtccccaccggcgccaacatcccgagccccaccgactggctcaacgccctgttcggcaacgggctgtcccgctggttcctcggcgtgatcggggtcctgctgggcggcctcgccctgttcttcctgatcatgagcctcttcaagctggggacgaagcaggtcttccggtcccgcagcaagctggcgtga

SEQ ID NO: 13134 - RNA, 3222 nt, synthetic construct
  misc_feature 1..3222: note = derived and/or modified CDS sequence (opt1) from SFTSV(KAJJH)__KU507566.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctcatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcaaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagcggacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgcgtccggccgaagtgctacggcttcagccgcatgatggccacgctggaggtgaacccgcccgagcagcggatcgggcagtgcaccggctgccacatcgagtgcatcaacgggggcgtgcgcctcatcaccctgacctccgagctcaagagcgcgacggtctgcgcctcccacttctgcagctccgccaccagcgggaagaagtccaccgagatccagttccacagcggctccctggtgggcaaggccgccatccacgtcaagggggcgctggtggacggcaccgagttcacgttcgaggggagctgcatgttccccgacggctgcgacgccgtggactgcaccttctgccgggagttcctgaagaacccccagtgctaccccgccaagaagtggctgttcatcatcatcgtcatcctgctgggctacgccgggctcatgctgctgaccaacgtgctcaaggccatcggcgtgtgggggtcctgggtcatcgcgcccgtgaagctgatgttcgccatcatcaagaagctgatgcgcagcgtgtcctgcctcatgggcaagctgatggaccgggggcgccaggtcatccacgaggagatcggcgagaaccgggagggcaaccaggacgacgtgcgcatcgagatggcccgcccccggcgcgtgcggcactggatgtacagcccggtcatcctgaccatcctcgccatcgggctggccgagggctgcgacgagatggtgcacgcggactccaagctggtgagctgccgccagggcggcgggaacatgaaggagtgcgtcacgaccgggcgggccctcctgcccgccgtgaaccccggccaggaggcctgcctgcacttcaccgcccccgggtccccggacagcaagtgcctcaagatcaaggtgaagcgcatcaacctgaagtgcaagaagtcctccagctacttcgtccccgacgcgcggtcccgctgcaccagcgtgcggcgctgccggtgggccggcgactgccagtccgggtgccccagccacttcacgtccaacagcttctccgacgactgggccggcaagatggaccgcgccgggctgggcttcagcggctgctccgacgggtgcggcggggcggcctgcggctgcttcaacgccgccccgagctgcatcttctggcggaagtgggtggagaacccccacgggatcatctggaaggtctccccctgcgccgcgtgggtgcccagcgccgtgatcgagctcaccatgccgtccggcgaggtccgcaccttccaccccatgagcggcatccccacccaggtgttcaagggggtgtccgtcacgtacctgggcagcgacatggaggtgtccgggctgaccgacctctgcgagatcgaggagctcaagagcaagaagctggccctggccccctgcaaccaggccggcatgggcgtggtcgggaaggtgggcgagatccagtgcagctccgaggagagcgcgcggaccatcaagaaggacgggtgcatctggaacgccgacctggtgggcatcgagctgcgcgtcgacgacgccgtgtgctactccaagatcaccagcgtggaggccgtcgccaactactccgcgatcccgacgaccatcgggggcctgcggttcgagcgcagccacgactcccagggcaagatcagcgggagccccctcgacatcaccgccatccggggcagcttctccgtgaactaccgcgggctgcgcctgagcctctccgagatcaccgccacgtgcaccggcgaggtgaccaacgtcagcgggtgctactcctgcatgaccggcgccaaggtgagcatcaagctgcactccagcaagaactccaccgcgcacgtgcggtgcaagggcgacgagacggccttcagcgtcctggagggggtgcacagctacaccgtgtccctcagcttcgaccacgccgtcgtggacgagcagtgccagctgaactgcggcgggcacgagtcccaggtgaccctgaagggcaacctcatcttcctggacgtccccaagttcgtggacgggagctacatgcagacctaccactccagcgtgcccacgggcgccaacatcccgtcccccaccgactggctgaacgccctcttcggcaacgggctgagccgctggatcctgggcgtcatcggggtgctcctgggcggcctggccctcttcttcctgatcatgtccctgttcaagctcgggaccaagcaggtcttccggagccgcaccaagctggcgtga

SEQ ID NO: 13135 - RNA, 3222 nt, synthetic construct
  misc_feature 1..3222: note = derived and/or modified CDS sequence (opt1) from SFTSV(KAJNH2)__KU507552.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtgctcaagaaggccaaggagtccgacatgatcgtgccggggcccagctacaagggcaaggtcttcttcgagcggcccaccttcgacgggtacgtgggctggggctgcgggtccggcaagagccgcacggagtccggggagctgtgcagcagcgactccggcaccagctccggcctgctccccagcgaccgggtgctgtggatcggggacgtcgcctgccagccgatgacccccatccccgaggagaccttcctggagctcaagtccttcagccagtccgagttccccgacatctgcaagatcgacggcatcgtgttcaaccagtgcgagagcgagtccctgccgcagcccttcgacgtggcctggatggacgtcgggcacagccacaagatcatcatgcgcgagcacaagacgaagtgggtgcaggagtccagctccaaggacttcgtgtgctacaaggagggcaccgggccctgcagcgagtccgaggagaagacctgcaagaccagcggctcctgccggggcgacatgcagttctgcaaggtcgcggggtgcgagcacggcgaggaggccagcgaggccaagtgccgctgctccctggtgcacaagcccggggaggtggtcgtgagctacggcgggatgcgggtgcgcccgaagtgctacggcttcagccggatgatggccacgctcgaggtcaacccgcccgagcagcgcatcggccagtgcaccgggtgccacctggagtgcatcaacggcggggtgcggctgatcaccctcacctccgagctcaagagcgcgacggtgtgcgcctcccacttctgcagctccgccaccagcggcaagaagtccaccgagatccagttccacagcgggtccctggtcggcaaggccgccatccacgtgaagggcgcgctggtcgacgggaccgagttcacgttcgagggcagctgcatgttccccgacgggtgcgacgccgtggactgcaccttctgccgcgagttcctgaagaacccccagtgctaccccgccaagaagtggctgttcatcatcatcgtgatcctcctgggctacgccggcctgatgctcctgaccaacgtcctgaaggccatcggggtgtggggctcctgggtgatcgcgcccgtcaagctcatgttcgccatcatcaagaagctgatgcggagcgtgtcctgcctgatggggaagctcatggaccgcggccgccaggtgatccacgaggagatcggggagaaccgggagggcaaccgggacgacgtccgcatcgagatggcccgcccccggcgcgtgcggcactggatgtacagcccggtgatcctgaccatcctggccatcggcctcgccgaggggtgcgacgagatggtccacgcggactccaagctggtgagctgccgccagggctccgggaacatgaaggagtgcgtgacgaccggccgggccctgctccccgccgtcaaccccgggcaggaggcctgcctgcacttcaccgcccccggcagcccggacagcaagtgcctgaagatcaaggtgaagcgcatcaacctcaagtgcaagaagtccagctcctacttcgtgcccgacgcgcggagccgctgcacctccgtccggcgctgccggtgggccggcgactgccagagcgggtgcccctcccacttcacgagcaactccttcagcgacgactgggccggcaagatggaccgcgccgggctgggcttctccgggtgcagcgacggctgcggcggggcggcctgcggctgcttcaacgccgccccgtcctgcatcttctggcggaagtgggtggagaacccccacgggatcatctggaaggtgagcccctgcgccgcgtgggtcccctccgccgtgatcgagctgaccatgccgagcggcgaggtgcgcaccttccaccccatgtccgggatccccacccaggtcttcaagggcgtgagcgtgacgtacctcggctccgacatggaggtcagcgggctgaccgacctgtgcgagatcgaggagctcaagagcaagaagctggccctggccccctgcaaccaggccggcatgggggtggtgggcaaggtcggcgagatccagtgctccagcgaggagtccgcgcggaccatcaagaaggacgggtgcatctggaacgccgacctggtgggcatcgagctccgcgtggacgacgccgtctgctacagcaagatcacctccgtggaggccgtggccaactacagcgcgatcccgacgaccatcgggggcctgcggttcgagcgctcccacgacagccaggggaagatctccggcagccccctggacatcaccgccatccggggctccttcagcgtcaactaccgcgggctccgcctgtccctgagcgagatcaccgccacgtgcaccggcgaggtgaccaacgtgtccgggtgctacagctgcatgaccggcgccaaggtctccatcaagctccacagctccaagaacagcaccgcgcacgtgcggtgcaagggggacgagacggccttcagcgtgctggagggcgtccactcctacaccgtgagcctgtccttcgaccacgccgtggtcgacgagcagtgccagctcaactgcggcgggcacgagagccaggtgaccctgaagggcaacctgatcttcctcgacgtgcccaagttcgtcgacgggtcctacatgcagacctaccacagctccgtgcccacgggcgccaacatcccgagccccaccgactggctgaacgccctgttcgggaacggcctctcccgctggatcctgggcgtgatcggggtcctgctcggcgggctggcgctgttcttcctcatcatgagcctgttcaagctgggcaccaagcaggtcttccggtcccgcgccaagctcgcctga

SEQ ID NO: 13136 - RNA, 3222 nt, synthetic construct
  misc_feature 1..3222: note = derived and/or modified CDS sequence (opt1) from SFTSV(ZL13-32)__KU361342.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccggggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcctgtcccggtggatcctgggggtgatcggcgtcctcctcgggggcctggccctgttcttcatgatcatgagcctgttcaagctgggcacgaagcaggtcttccgctcccggaccaagctcgcgtga

SEQ ID NO: 13137 - RNA, 3222 nt, synthetic construct
  misc_feature 1..3222: note = derived and/or modified CDS sequence (opt1) from SFTSV(AHL/China/2011)__JQ670930.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccgacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagggcgagagcctcccgcagcccttcgacgtcgcctggatggacgtggggcactcccacaagatcatcatgcgcgagcacaagacgaagtgggtgcaggagagctccagcaaggacttcgtctgctacaaggagggcaccggcccctgctccgagagcgaggagaagacctgcaagacctccgggagctgccggggcgacatgcagttctgcaaggtggcggggtgcgagcacggcgaggaggcctccgaggccaagtgccgctgcagcctggtgcacaagcccggggaggtcgtggtgtcctacggcggcatgcggatccgcccgaagtgctacgggttcagccggatgatggccacgctggaggtcaacccgcccgagcagcgcatcggccagtgcaccgggtgccacctcgagtgcatcaacggcggggtgcggctgatcaccctgaccagcgagctcaagtccgcgacggtgtgcgccagccacttctgctccagcgccacctccggcaagaagaacaccgagatccagttccacagcggctccctggtcgggaagaccgccatccacgtgaagggcgccctggtcgacgggacggacttcaccttcgagggcagctgcatgttccccgacggctgcgacgcggtggactgcaccttctgccgcgagttcctcaagaacccccagtgctaccccgccaagaagtggctgttcatcatcatcgtgatcctgctcgggtacgccggcctgatgctgctcaccaacgtcctgaaggccatcggggtgtggggctcctgggtgatcgcccccgtcaagctgatgttcgcgatcatgaagaagctcatgcggagcgtgtcctgcctgatggggaagctgatggaccgcggccgccaggtgatccacgaggagatcggcgagaaccgggaggggaaccaggacgacgtccggatcgagatggcccgcccccgccgggtgcgccactggatgtacagcccggtgatcctcacgatcctggccaccggcctggccgaggggtgcgacgagatggtccacgccgactccaagctcgtgagctgccggcagggctccgggaacatgaaggagtgcgtgaccaccggccgcgcgctgctgcccgccgtcaaccccggccaggaggcctgcctccacttcacggcccccgggagcccggactccaagtgcctgaagatcaaggtgaagcggatcaacctgaagtgcaagaagtccagctcctacttcgtgcccgacgcccgcagccggtgcacctccgtccgccggtgccgctgggcgggcgactgccagagcgggtgcccgccccacttcacctccaacagcttctccgacgactgggccggcaagatggaccgggccgggctcggcttcagcggctgctccgacgggtgcggcggggccgcgtgcggctgcttcaacgccgcccccagctgcatcttctggcgcaagtgggtggagaacccccacgggatcatctggaaggtgtccccctgcgccgcctgggtcccgagcgcggtgatcgagctgaccatgccctccggcgaggtgcggacgttccaccccatgagcggcatccccacccaggtcttcaagggggtgtccgtgacctacctgggcagcgacatggaggtctccgggctcaccgacctgtgcgagatcgaggagctcaagagcaagaagctggccctggccccgtgcaaccaggccggcatgggcgtggtggggaaggtcggcgagatccagtgctccagcgaggagagcgcccgcacgatcaagaaggacgggtgcatctggaacgcggacctggtgggcatcgagctgcgggtggacgacgccgtctgctactccaagatcaccagcgtggaggccgtggccaactactccgccatccccaccaccatcgggggcctccgcttcgagcggagccacgactcccagggcaagatcagcgggagccccctggacatcacggcgatccgcggcagcttctccgtcaactaccgggggctgcgcctcagcctgtccgagatcaccgcgacctgcaccggcgaggtgaccaacgtgagcgggtgctactcctgcatgacgggcgccaaggtcagcgtgaagctgcactccagcaagaactccaccgcccacgtgcgctgcaagggcgacgagaccgccttcagcgtcctcgagggggtgcactcctacaccgtgagcctgagcttcgaccacgccgtcgtggacgagcagtgccagctgaactgcggcgggcacgagtcccaggtgacgctcaagggcaacctgatcttcctggacgtccccaagttcgtggacgggagctacatgcagacctaccactccaccgtgccgaccggcgccaacatccccagccccacggactggctcaacgccctgttcggcaacgggctgtcccggtggatcctcggcgtcatcggggtgctgctgggcggcctcgccctgttcttcctgatcatgagcctcttcaagctggggaccaagcaggtcttccgctcccggaccaagctggcgtga

SEQ ID NO: 13138 - RNA, 3222 nt, synthetic construct
  misc_feature 1..3222: note = derived and/or modified CDS sequence (opt1) from SFTSV(AH-YTY/China/05/2012)__KR017849.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcgggccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgaccatcctcgccatcggcctggccgagagctgcgacgagatggtccacgcggactccaagctggtgagctgccggcaggggtccggcaacatgaaggagtgcgtgacgaccgggcgcgccctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcgcgcagccggtgcacctccgtccgccggtgccgctgggccggggactgccagagcggctgcccgccccacttcacgtccaacagcttctccgacgactgggccgggaagatggaccgggccggcctggggttcagcggctgctccgacggctgcgggggcgcggcctgcgggtgcttcaacgccgcccccagctgcatcttctggcgcaagtgggtggagaacccccacggcatcatctggaaggtgtccccctgcgccgcgtgggtccccagcgccgtgatcgagctcaccatgccgtccggggaggtgcggaccttccaccccatgagcggcatccccacccaggtcttcaagggcgtgtccgtgacgtacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcgcgcaccatcaagaaggacggctgcatctggaacgccgacctcgtggggatcgagctgcgggtggacgacgccgtctgctactccaagatcaccagcgtggaggccgtggccaactactccgcgatcccgacgaccatcggcgggctgcgcttcgagcggagccacgactcccagggcaagatcagcggcagccccctcgacatcaccgccatccgcgggagcttctccgtcaactaccggggcctgcgcctgagcctctccgagatcaccgccacgtgcaccggggaggtgaccaacgtgagcggctgctactcctgcatgaccggggccaaggtcagcatcaagctgcactccagcaagaactccaccgcgcacgtgcgctgcaagggcgacgagacggccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacctaccactccacggtgcccaccggggccaacatcccgagccccaccgactggctgaacgccctcttcggcaacggcctgtcccggtggatcctgggggtgatcggcgtcctcctcgggggcctggcgctgttcttcatgatcatgagcctgttcaagctgggcaccaagcaggtcttccgctcccggacgaagctggcctga

SEQ ID NO: 13139 - RNA, 3222 nt, synthetic construct
  misc_feature 1..3222: note = derived and/or modified CDS sequence (opt1) from SFTSV(AHZ/China/2011)__JQ670931.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatcctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaagatcgcggggtgcgagcacggcgaggaggccagcgaggccaagtgccgctgctccctcgtgcacaagcccggggaggtggtcgtgagctacggcggcatgcgggtgcgcccgaagtgctacgggttcagccggatgatggccaccctggaggtcaaccagcccgagcagcgcatcggccagtgcacggggtgccacctggagtgcatcaacggcggggtgcggctcatcaccctgacctccgagctcaagagcgcgaccgtgtgcgcctcccacttctgcagctccgccacgagcggcaagaagtccaccgagatccagttccacagcggctccctcgtcgggaagaccgccatccacgtgaagggcgccctggtcgacgggaccgagttcacgttcgagggcagctgcatgttccccgacggctgcgacgcggtggactgcaccttctgccgcgagttcctgaagaacccccagtgctacccggccaagaagtggctgttcatcatcatcgtgatcctgctggggtacgccggcctcatgctgctgaccaacgtcctcaaggccatcgggatctggggctcctgggtgatcgcccccgtgaagctgatcttcgcgatcatcaagaagctgatgcggaccgtcagctgcctcatggggaagctgatggaccgcggccgccaggtgatccacgaggagatcggcgagaaccgggaggggaaccaggacgacgtgcggatcgagatggcccgcccccgccgggtccgccactggatgtactcccccgtgatcctgacgatcctcgccatcggcctggccgagagctgcgacgagatggtgcacgccgactccaagctggtcagctgccggcaggggtccggcaacatgaaggagtgcgtgaccaccgggcgcgcgctcctgccggccgtgaaccccggccaggaggcctgcctgcacttcaccgcccccggcagccccgacagcaagtgcctcaagatcaaggtcaagtggatcaacctgaagtgcaagaagtccagctcctacttcgtgccggacgcccggagccgctgcacgtccgtgcggcgctgccggtgggcgggggactgccagagcggctgcccgccccacttcacctccaacagcttctccgacgactgggccgggaagatggaccgcgccggcctggggttcagcggctgctccgacggctgcgggggcgccgcgtgcgggtgcttcaacgccgcccccagctgcatcttctggcggaagtgggtcgagaacccccacggcatcatctggaaggtgtccccctgcgccgcctgggtgcccagcgcggtcatcgagctctccatgccgagcggggaggtgcgcaccttccaccccatgtccggcatccccacccaggtgttcaagggcgtcagcgtgacgtacctggggtccgacatggaggtgagcggcctgaccgggctctgcgagatcgaggagctcaagagcaagaagctggccctggccccctgcaaccaggccggcatgggcgtcgtggggaaggtgggcgagatccagtgctccagcgaggagtccgcccggaccatcaagaaggacgggtgcatctggaacgcggacctggtcggcatcgagctgcgcgtggacgacgccgtgtgctacagcaagatcacctccgtcgagagcgtggccaactactccgccatcccgacgaccatcgggggcctgcggttcgagcgcagccacgactcccagggcaagatcagcgggagccccctcgacatcaccgccatccggggcagcttctccgtgaactaccgcgggctgcggctgagcctctccgagatcaccgcgacgtgcaccggcgaggtcaccaacgtgagcgggtgctactcctgcatgaccggcgccaaggtgagcatcaagctgcactccagcaagaacagcaccgcccacgtccgctgcaagggcgacgagacggccttctccgtgctggagggggtgcacagctacaccgtctccctcagcttcgaccacgcggtggtggacgagcagtgccagctgaactgcggcgggcacgagtcccaggtcaccctgaagggcaacctcatcttcctggacgtgcccaagttcgtggacgggagctacatgcagacctaccactccacggtccccaccggcgccaacatcccgagccccaccgactggctgaacgccctcttcggcaacgggctgtcccgctggatcctgggcctcatcggggtgctgctgggcggcctcgccctgttcttcatgatcatgagcctgttcaagctcgggaccaagcaggtcttccggtcccgcacgaagctggcctga

SEQ ID NO: 13140 - RNA, 3222 nt, synthetic construct
  misc_feature 1..3222: note = derived and/or modified CDS sequence (opt1) from SFTSV(DS02/CHN/2013)__KR698332.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctggtcaccctgacctccgagctcaagagcgcgacggtgtgcgcctcccacttctgcagctccgccaccagcgggaagaagtccaccgagatccagttccacagcggctccctggtcggcaaggccgccatccacgtgaagggggcgctggtggacggcaccgagttcacgttcgaggggagctgcatgttccccgacggctgcgacgccgtcgactgcaccttctgccgcgagttcctcaagaacctgcagtgctaccccgccaagaagtggctgttcatcatcatcgtgatcctcctgggctacgccgggctgatgctcctgaccaacgtgctgaaggccatcggcgtctgggggtcctgggtgatcgcgcccgtgaagctcatgttcgccatcatcaagaagctgatgcggagcgtctcctgcctgatgggcaagctcatggaccgcgggcgccaggtgatccacgaggagatcggcgagaaccgggagggcaaccaggacgacgtgcggatcgagatggtccgcccccgccgggtgcgccactggatgtacagccccgtgatcctgaccatcctggccatcgggctcacggagggctgcgacgagatggtccacgccgactccaagctggtgagctgccggcaggggtccggcaacatgaaggagtgcgtgaccaccgggcgcgccctgctcccggcggtcaaccccggccaggaggcctgcctgcacttcaccgcccccggcagccccgacagcaagtgcctgaagatcaaggtgaagcggatcaacctcaagtgcaagaagtccagctcctacttcgtgccggacgcccgcagccggtgcacgtccgtccgccggtgccgctgggccggggactgccagagcggctgcccctcccacttcaccagcaactccttcagcgacgactgggcggggaagatggaccgggccggcctggggttctccggctgcagcgacggctgcgggggcgccgcctgcgggtgcttcaacgcggccccctcctgcatcttctggcgcaagtgggtggagaacccgcacggcatcatctggaaggtgagcccctgcgccgcctgggtcccctccgccgtgatcgagctgaccatgcccagcggggaggtgcggaccttccacccgatgtccggcatccccacgcaggtcttcaagggcgtgagcgtgacctacctcgggtccgacatggaggtcagcggcctgaccgacctgtgcgagatcgaggagctcaagagcaagaagctggcgctggccccctgcaaccaggccgggatgggcgtggtgggcaaggtcggggagatccagtgctccagcgaggagtccgcccgcaccatcaagaaggacggctgcatctggaacgccgacctggtggggatcgagctccgggtggacgacgcggtctgctacagcaagatcacgtccgtggaggccgtggccaactacagcgccatccccaccaccatcggcgggctgcgcttcgagcggtcccacgacagccagggcaagatctccggcagcccgctggacatcaccgccatccgcgggtccttcagcgtcaactaccggggcctccgcctgtccctgagcgagatcacggcgacctgcaccggggaggtgaccaacgtgtccggctgctacagctgcatgaccggggccaaggtctccatcaagctccacagctccaagaacagcacggcccacgtgcgctgcaagggcgacgagaccgccttcagcgtgctggagggcgtccactcctacaccgtgagcctgtccttcgaccacgcggtggtcgacgagcagtgccagctcaactgcgggggccacgagagccaggtgaccctgaaggggaacctgatcttcctcgacgtgcccaagttcgtcgacggctcctacatgcagacgtaccacagctccgtgcccaccggggccaacatccccagcccgaccgactggctgaacgccctgttcggcaacggcctctcccggtggatcctgggggtcatcggcgtgctgctcgggggcctggccctgttcttcctcatcatgagcctgttcaagctgggcaccaagcaggtcttccgctcccggacgaagctcgcctga

SEQ ID NO: 13141 - RNA, 3222 nt, synthetic construct
  misc_feature 1..3222: note = derived and/or modified CDS sequence (opt1) from SFTSV(DS03/CHN/2013)__KR698333.1__GP
  source 1..3222: mol_type = other RNA
atgatgaaggtgatctggttcagctccctgatctacctcgtcatccagtgcagcggcgactccgggcccatcatctgcgccggcccgatccacagcaacaagtccgccaacatcccccacctcctggggtacagcgagaagatctgccagatcgaccgcctgatccacgtgtccagctggctgcggaaccactcccagttccagggctacgtggggcagcgcggcggccggagccaggtctcctactaccccgcggagaacagctactcccgctggagcgggctgctctccccctgcgacgccgactggctgggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagcgcgagtccctgccgcagcccttcgacgtcgcctggatggacgtgggccacagccacaagatcatcatgcgggagcacaagaccaagtgggtgcaggagtccagctccaaggacttcgtctgctacaaggaggggacgggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgcgtccggccgaagtgctacggcttcagccgcatgatggccaccctggaggtgaacccgcccgagcagcggatcgggcagtgcacgggctgccacctcgagtgcatcaacgggggcgtgcgcctgatcaccctgacctccgagctcaagagcgcgaccgtctgcgcctcccacttctgcagctccgccacgagcgggaagaagtccaccgagatccagttccacagcggctccctggtgggccggaccgccatccacgtcaagggggccctggtggacggcaccgagttcacgttcgaggggagctgcatgttccccgacggctgcgacgcggtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcccccgtgaagctgatgttcgcgatcatcaagaagctcatgcggagcgtgtcctgcctgatgggcaagctgatggaccgcgggcggcaggtcatccacgaggagatcggcgagaaccgcgagggcaaccaggacgacatccgcatcgagatggcccggccccgccgggtgcgccactggatgtacagcccggtgatcctcaccatcctggccgtcgggctggccgagggctgcgacgagatggtgcacgccgactccaagctcgtgagctgcaagcaggggtccggcaacatgaaggagtgcgtcacgaccgggcgggcgctgctgcccgccgtgaaccccggccaggaggcctgcctccacttcaccgcccccggcagcccggacagcaagtgcctgaagatcaaggtgaagcgcatcaacctgaagtgcaagaagtccagctcctacttcgtccccgacgcccggagccgctgcacctccgtgcggcgctgccggtgggcgggggactgccagagcggctgcccctcccacttcacgagcaactccttcagcgacgactgggccgggaagatggaccgcgccggcctcgggttctccggctgcagcgacggctgcgggggcgccgcgtgcgggtgcttcaacgccgccccgtcctgcatcttctggcggaagtgggtggagaacccccacggcatcatctggaaggtcagcccctgcgccgcctgggtgccctccgcggtgatcgagctgaccatgccgagcggggaggtccgcaccttccaccccatgtccggcatccccacccaggtgttcaagggcgtgagcgtcacgtacctggggtccgacatggaggtgagcggcctcaccgacctgtgcgagatcgaggagctcaagagcaagaagctggccctggccccctgcaaccaggccgggatgggcgtggtcggcaaggtgggggagatccagtgctccagcgaggagtccgcccggaccatcaagaaggacggctgcatctggaacgcggacctggtggggatcgagctgcgcgtcgacgacgccgtgtgctacagcaagatcacctccgtggaggccgtcgccaactacagcgccatcccgacgaccatcggcgggctccggttcgagcgctcccacgacagccagggcaagatctccggcagccccctggacatcaccgcgatccgggggtccttcagcgtgaactaccgcggcctgcgcctctccctgagcgagatcaccgccacgtgcaccggggaggtgaccaacgtctccggctgctacagctgcatgaccggggccaaggtgtccatcaagctgcacagctccaagaacagcaccgcccacgtgcggtgcaagggcgacgagacggcgttcagcgtcctcgagggcgtgcactcctacaccgtgagcctgtccttcgaccacgccgtcgtggacgagcagtgccagctgaactgcgggggccacgagagccaggtgaccctcaaggggaacctgatcttcctggacgtccccaagttcgtggacggctcctacatgcagacctaccacagctccgtgcccacgggggccaacatcccgagccccaccgactggctcaacgccctgttcggcaacggcctgtcccgctggatcctcggggtcatcggcgtgctgctcgggggcctggccctgttcttcctgatcatgagcctcttcaagctgggcaccaagcaggtcttccggtcccgcaccaagctggcgtga

SEQ ID NO: 13142 - RNA, 3222 nt, synthetic construct
  misc_feature 1..3222: note = derived and/or modified CDS sequence (opt1) from SFTSV(DS04/CHN/2013)__KR698334.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaaggccgccatccacgtcaagggggcgctggtggacggcaccgagttcacgttcgaggggagctgcatgttccccgacggctgcgacgccgtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcgcccgtgaagctgatgttcgccatcatcaagaagctcatgcggagcgtgtcctgcctgatgggcaagctgatggaccgcgggcggcaggtcatccacgaggagatcggcgagaaccgcgagggcaaccaggacgacgtgcggatcgagatggtgcgcccccgccgggtccgccactggatgtacagcccggtgatcctcaccatcctggccatcgggctgacggagggctgcgacgagatggtgcacgccgactccaagctcgtcagctgccggcaggggtccggcaacatgaaggagtgcgtgaccaccgggcgcgccctgctgcccgcggtgaaccccggccaggaggcctgcctccacttcaccgcccccggcagcccggacagcaagtgcctgaagatcaaggtcaagcggatcaacctgaagtgcaagaagtccagctcctacttcgtgcccgacgcccgcagccggtgcacgtccgtgcgccggtgccgctgggccggggactgccagagcggctgcccctcccacttcaccagcaactccttcagcgacgactgggcggggaagatggaccgggccggcctcgggttctccggctgcagcgacggctgcgggggcgccgcctgcgggtgcttcaacgcggccccgtcctgcatcttctggcgcaagtgggtcgagaacccccacggcatcatctggaaggtgagcccctgcgccgcctgggtgccctccgccgtcatcgagctgaccatgccgagcggggaggtgcggaccttccgccccatgtccggcatccccacccaggtgttcaagggcgtcagcgtgacctacctggggtccgacatggaggtgagcggcctcaccgacctgtgcgagatcgaggagctcaagagcaagaagctggcgctggccccctgcaaccaggccgggatgggcgtcgtgggcaaggtgggggagatccagtgctccagcgaggagtccgcccggaccatcaagaaggacggctgcatctggaacgccgacctggtcgggatcgagctgcgcgtggacgacgcggtgtgctacagcaagatcacgtccgtcgaggccgtggtgaactacagcgccatcccgaccaccatcggcgggctccggttcgagcgctcccacgacagccagggcaagatctccggcagccccctggacatcaccgccatccgggggtccttcagcgtcaactaccgcggcctgcgcctctccctgagcgagatcacggccacgtgcaccggggaggtgaccaacgtgtccggctgctacagctgcatgaccggggcgaaggtctccatcaagctgcacagctccaagaacagcacggcccacgtgcggtgcaagggcgacgagaccgccttcagcgtgctcgagggcgtccactcctacaccgtgagcctgtccttcgaccacgccgtggtcgacgagcagtgccagctgaactgcgggggccacgagagccaggtgaccctcaaggggaacctgatcttcctggacgtgcccaagttcgtcgacggctcctacatgcagacgtaccacagctccgtgcccaccggggcgaacatcccgagccccaccgactggctcaacgccctgttcggcaacggcctgtcccgctggatcctcggggtcatcggcgtgctgctcgggggcctggccctgttcttcctgatcatgagcctcttcaagctgggcaccaagcaggtcttccggtcccgcacgaagctggcctga

SEQ ID NO: 13143 - RNA, 3222 nt, synthetic construct
  misc_feature 1..3222: note = derived and/or modified CDS sequence (opt1) from SFTSV(DS05/CHN/2013)__KR698335.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgccacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaaggccgccatccacgtcaagggggcgctggtggacggcaccgagttcacgttcgaggggagctgcatgttccccgacggctgcgacgccgtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcgcccgtgaagctgatgttcgccatcatcaagaagctcatgcggagcgtgtcctgcctgatgggcaagctgatggaccgcgggcggcaggtcatccacgaggagatcggcgagaaccgcgagggcaaccaggacgacgtgcggatcgagatggtgcgcccccgccgggtccgccactggatgtacagcccggtgatcctcaccatcctggccatcgggctgacggagggctgcgacgagatggtgcacgccgactccaagctcgtcagctgccggcaggggtccggcaacatgaaggagtgcgtgaccaccgggcgcgccctgctgcccgcggtgaaccccggccaggaggcctgcctccacttcaccgcccccggcagcccggacagcaagtgcctgaagatcaaggtcaagcggatcaacctgaagtgcaagaagtccagctcctacttcgtgcccgacgcccgcagccggtgcacgtccgtgcgccggtgccgctgggccggggactgccagagcggctgcccctcccacttcaccagcaactccttcagcgacgactgggcggggaagatggaccgggccggcctcgggttctccggctgcagcgacggctgcgggggcgccgcctgcgggtgcttcaacgcggccccgtcctgcatcttctggcgcaagtgggtcgagaacccccacggcatcatctggaaggtgagcccctgcgccgcctgggtgccctccgccgtcatcgagctgaccatgccgagcggggaggtgcggaccttccaccccatgtccggcatccccacccaggtgttcaagggcgtcagcgtgacgtacctggggtccgacatggaggtgagcggcctcaccgacctgtgcgagatcgaggagctcaagagcaagaagctggcgctggccccctgcaaccaggccgggatgggcgtcgtgggcaaggtgggggagatccagtgctccagcgaggagtccgcccgcaccatcaagaaggacggctgcatctggaacgccgacctggtcgggatcgagctgcgggtggacgacgcggtgtgctacagcaagatcacgtccgtcgaggccgtggccaactacagcgccatcccgaccaccatcggcgggctccgcttcgagcggtcccacgacagccagggcaagatctccggcagccccctggacatcaccgccatccgcgggtccttcagcgtgaactaccggggcctgcgcctctccctgagcgagatcacggcgacctgcaccggggaggtcaccaacgtgtccggctgctacagctgcatgaccggggccaaggtgtccatcaagctgcacagctccaagaacagcacggcccacgtccgctgcaagggcgacgagaccgccttcagcgtgctcgagggcgtgcactcctacaccgtcagcctgtccttcgaccacgcggtggtggacgagcagtgccagctgaactgcgggggccacgagagccaggtcaccctcaaggggaacctgatcttcctggacgtgcccaagttcgtggacggctcctacatgcagacgtaccacagctccgtccccaccggggccaacatcccgagccccaccgactggctcaacgccctgttcggcaacggcctgtcccggtggatcctcggggtgatcggcgtcctgctcgggggcctggccctgttcttcctgatcatgagcctcttcaagctgggcaccaagcaggtcttccgctcccggacgaagctggcctga

SEQ ID NO: 13144 - RNA, 3222 nt, synthetic construct
  misc_feature 1..3222: note = derived and/or modified CDS sequence (opt1) from SFTSV(HB154/China/2011)__JQ733560.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcatgcgggtccgcccgaagtgctacgggttcagccggatgatggcgaccctggaggtgaacccgcccgagcagcgcatcggccagtgcaccgggtgccacctcgagtgcatcaacggcggggtgcggctgatcacgctgacctccgagctccgcagcgccaccgtctgcgcctcccacttctgcagctccgccaccagcggcaagaagtccacggagatccacttccacagcggctccctggtggggaagaccgccatccacgtcaagggcgcgctggtggacgggaccgagttcaccttcgagggcagctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctgctcaccaacgtgctgaaggccatcggggtgtggggctcctgggtcatcgcgcccgtgaagctgatgttcgccatcatcaagaagctcatgcgcaccgtgagctgcctggtcgggaagctgatggaccggggccgccaggtgatcaacgaggagatcggcgagaacggggagggcaaccaggacgacgtgcggatcgagatggcccgcccccgccgggtccgccactggatgtactccccggtgatcctcaccatcctggccatcgggctggccgagggctgcgacgagatggtgcacgcggacagcaagctcgtctcctgccggcaggggagcggcaacatgaaggagtgcatcacgaccggccgcgccctgctgcccgccgtgaaccccgggcaggaggcctgcctccacttcaccgcccccggctccccggacagcaagtgcctgaagatcaaggtgaagcggatcaacctgaagtgcaagaagtccagcagctacttcgtccccgacgcgcgctcccggtgcaccagcgtgcgccggtgccgctgggccggggactgccagtccggctgcccgccccacttcacgagcaactccttcagcgacgactgggccgggaagatggaccgggccggcctcggcttctccgggtgcagcgacggctgcgggggcgcggcctgcgggtgcttcaacgccgccccctcctgcatcttctggcgcaagtgggtggagaacccccacggcatcatctggaaggtcagcccctgcgccgcgtgggtgccgtccgccgtgatcgagctgaccatgcccagcggcgaggtccggaccttccaccccatgtccgggatccccacccaggtgttcaagggcgtgagcgtcacgtacctggggtccgacatggaggtgagcggcctcaccgacctgtgcgagatcgaggagctgaagtccaagaagctggccctcgccccgtgcaaccaggccggcatgggggtggtcggcaaggtgggggagatccagtgcagcagcgaggagtccgcgcgcaccatcaagaaggacggctgcatctggaacgccgacctggtggggatcgagctgcgggtcgacgacgccgtgtgctacagcaagatcacctccgtggaggccgtcgccaactacagcgcgatccccacgaccatcggcggcctccgcttcgagcggtcccacgacagccaggggaagatctccggcagccccctggacatcaccgccatccgcgggtccttcagcgtgaactaccggggcctgcgcctctccctgagcgagatcaccgccacgtgcaccggggaggtgaccaacgtctccggctgctacagctgcatgaccggcgccaaggtgtccatcaagctgcacagctccaagaacagcaccgcgcacgtgcgctgcaagggggacgagacggccttctccgtcctcgagggcgtgcacagctacatcgtgagcctgtccttcgaccacgccgtcgtggacgagcagtgccagctgaactgcgggggccacgagagccaggtgaccctcaaggggaacctgatcttcctggacgtccccaagttcgtggacggctcctacatgcagacctaccacagcaccgtgccgacgggcgccaacatcccctcccccaccgactggctcaacgccctgttcgggaacggcctgagccggtggatcctcggggtcatcggcgtgctgctgggcgggctcgcgctgttctccctgatcatgttcctcctgaagctgggcaccaagcaggtcttccgcagccggaccaagctcgcctga

SEQ ID NO: 13145 - RNA, 3222 nt, synthetic construct
  misc_feature 1..3222: note = derived and/or modified CDS sequence (opt1) from SFTSV(HB155/China/2011)__JQ733563.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcatgcgggtccgcccgaagtgctacgggttcagccggatgatggcgaccctggaggtgaacccgcccgagcagcgcatcggccagtgcaccgggtgccacctcgagtgcatcaacggcggggtgcggctgatcacgctgacctccgagctccgcagcgccaccgtctgcgcctcccacttctgcagctccgccaccagcggcaagaagtccacggagatccacttccacagcggctccctggtggggaagaccgccatccacgtcaagggcgcgctggtggacgggaccgagttcaccttcgagggcagctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctgctcaccaacgtgctgaaggccatcggggtgtggggctcctgggtcatcgcgcccgtgaagctgatgttcgccatcatcaagaagctcatgcgcaccgtgagctgcctggtcgggaagctgatggaccggggccgccaggtgatccacgaggagatcggcgagaacggggagggcaaccaggacgacgtgcggatcgagatggcccgcccccgccgggtccgccactggatgtactccccggtgatcctcaccatcctggccatcgggctggccgagggctgcgacgagatggtgcacgcggacagcaagctcgtctcctgccggcaggggagcggcaacatgaaggagtgcatcacgaccggccgcgccctgctgcccgccgtgaaccccgggcaggaggcctgcctccacttcaccgcccccggctccccggacagcaagtgcctgaagatcaaggtgaagcggatcaacctgaagtgcaagaagtccagcagctacttcgtccccgacgcgcgctcccggtgcaccagcgtgcgccggtgccgctgggccggggactgccagtccggctgcccgccccacttcacgagcaactccttcagcgacgactgggccgggaagatggaccgggccggcctcggcttctccgggtgcagcgacggctgcgggggcgcggcctgcgggtgcttcaacgccgccccctcctgcatcttctggcgcaagtgggtggagaacccccacggcatcatctggaaggtcagcccctgcgccgcgtgggtgccgtccgccgtgatcgagctgaccatgcccagcggcgaggtccggaccttccaccccatgtccgggatccccacccaggtgttcaagggcgtgagcgtcacgtacctggggtccgacatggaggtgagcggcctcaccgacctgtgcgagatcgaggagctgaagtccaagaagctggccctcgccccgtgcaaccaggccggcatgggggtggtcggcaaggtgggggagatccagtgcagcagcgaggagtccgcgcgcaccatcaagaaggacggctgcatctggaacgccgacctggtggggatcgagctgcgggtcgacgacgccgtgtgctacagcaagatcacctccgtggaggccgtcgccaactacagcgcgatccccacgaccatcggcggcctccgcttcgagcggtcccacgacagccaggggaagatctccggcagccccctggacatcaccgccatccgcgggtccttcagcgtgaactaccggggcctgcgcctctccctgagcgagatcaccgccacgtgcaccggggaggtgaccaacgtctccggctgctacagctgcatgaccggcgccaaggtgtccatcaagctgcacagctccaagaacagcaccgcgcacgtgcgctgcaagggggacgagacggccttctccgtcctcgagggcgtgcacagctacatcgtgagcctgtccttcgaccacgccgtcgtggacgagcagtgccagctgaactgcgggggccacgagagccaggtgaccctcaaggggaacctgatcttcctggacgtcccccggttcgtggacggctcctacatgcagacctaccacagcaccgtgccgacgggcgccaacatcccctcccccaccgactggctcaacgccctgttcgggaacggcctgagccgctggatcctcggggtcatcggcgtgctgctgggcgggctcgcgctgttcttcctgatcatgttcctcctgaagctgggcaccaagcaggtcttccggtcccgcaccaagctcgcctga

SEQ ID NO: 13146 - RNA, 3222 nt, synthetic construct
  misc_feature 1..3222: note = derived and/or modified CDS sequence (opt1) from SFTSV(HB156/China/2011)__JQ733566.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcatgcgggtccgcccgaagtgctacgggttcagccggatgatggcgaccctggaggtgaacccgcccgagcagcgcatcggccagtgcaccgggtgccacctcgagtgcatcaacggcggggtgcggctgatcacgctgacctccgagctccgcagcgccaccgtctgcgcctcccacttctgcagctccgccaccagcggcaagaagtccacggagatccacttccacagcggctccctggtggggaagaccgccatccacgtcaagggcgcgctggtggacgggaccgagttcaccttcgagggcagctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctgctcaccaacgtgctgaaggccatcggggtgtggggctcctgggtcatcgcgcccgtgaagctgatgttcgccatcatcaagaagctcatgcgcaccgtgagctgcctggtcgggaagctgatggaccggggccgccaggtgatccacgaggagatcggcgagaacggggagggcaaccaggacgacgtgcggatcgagatggcccgcccccgccgggtccgccactggatgtactccccggtgatcctcaccatcctggccatcgggctggccgagggctgcgacgagatggtgcacgcggacagcaagctcgtctcctgccggcaggggagcggcaacatgaaggagtgcatcacgaccggccgcgccctgctgcccgccgtgaaccccgggcaggaggcctgcctccacttcaccgcccccggctccccggacagcaagtgcctgaagatcaaggtgaagcggatcaacctgaagtgcaagaagtcctccagctacttcgtccccgacgcgcgctcccggtgcaccagcgtgcgccggtgccgctgggccggggactgccagtccggctgcccgccccacttcacgagcaactccttcagcgacgactgggccgggaagatggaccgggccggcctcggcttctccgggtgcagcgacggctgcgggggcgcggcctgcgggtgcttcaacgccgccccctcctgcatcttctggcgcaagtgggtggagaacccccacggcatcatctggaaggtcagcccctgcgccgcgtgggtgccgtccgccgtgatcgagctgaccatgcccagcggcgaggtccggaccttccaccccatgtccgggatccccacccaggtgttcaagggcgtgagcgtcacgtacctggggtccgacatggaggtgagcggcctcaccgacctgtgcgagatcgaggagctgaagtccaagaagctggccctcgccccgtgcaaccaggccggcatgggggtggtcggcaaggtgggggagatccagtgcagcagcgaggagtccgcgcgcaccatcaagaaggacggctgcatctggaacgccgacctggtggggatcgagctgcgggtcgacgacgccgtgtgctacagcaagatcacctccgtggaggccgtcgccaactacagcgcgatccccacgaccatcggcggcctccgcttcgagcggatccacgactcccaggggaagatcagcggcagccccctggacatcaccgccatccgcgggagcttctccgtgaactaccggggcctgcgcctcagcctgtccgagatcaccgccacgtgcaccggggaggtgaccaacgtcagcggctgctactcctgcatgaccggcgccaaggtgagcatcaagctgcactccagcaagaactccaccgcgcacgtgcgctgcaagggggacgagacggccttcagcgtcctcgagggcgtgcactcctacatcgtgagcctgagcttcgaccacgccgtcgtggacgagcagtgccagctgaactgcgggggccacgagtcccaggtgaccctcaaggggaacctgatcttcctggacgtccccaagttcgtggacggcagctacatgcagacctaccactccaccgtgccgacgggcgccaacatccccagccccaccgactggctcaacgccctgttcgggaacggcctgtcccggtggatcctcggggtcatcggcgtgctgctgggcgggctcgcgctgttcttcctgatcatgttcctcctgaagctgggcaccaagcaggtcttccgcagccggaccaagctcgcctga

SEQ ID NO: 13147 - RNA, 3222 nt, synthetic construct
  misc_feature 1..3222: note = derived and/or modified CDS sequence (opt1) from SFTSV(HB2014-04)__KR080475.1__GP
  source 1..3222: mol_type = other RNA
atgatgaaggtgatctggttccccagcctgatctgcttcgtgatccagtgctccggcgacagcgggccgatcatctgcgccggccccatccactccaacaagagcgccgacatcccccacctcctggggtactccgagaagatctgccagatcgaccgcctgatccacgtgagctcctggctccggaaccacagccagttccagggctacgtggggcagcgcggcggccggtcccacgtcagctactaccccgcggagaactcctacagccgctggtccgggctgctgagcccgtgcgacgccgactggctcggcatgctggtggtgaagaaggccaaggggtccgacatgatcgtccccggccccagctacaaggggaaggtgttcttcgagcggcccaccttcgacggctacgtgggctgggggtgcggctccggcaagagccgcaccgagtccggggagctgtgcagcagcgactccggcacgagctccgggctcctgccgagcgaccgggtcctgtggatcggcgacgtggcctgccagcccatgacccccatccccgaggagaccttcctcgagctgaagtccttcagccagtccgagttcccggacatctgcaagatcgacgggatcgtgttcaaccagtgcgagggcgagagcctgccccagcccttcgacgtcgcctggatggacgtggggcactcccacaagatcatcatgcgcgagcacaagaccaagtgggtgcaggagagctccagcaaggacttcgtctgctacaaggagggcacgggcccctgctccgagagcgaggagaagacctgcaagacctccgggagctgccggggcgacatgcagttctgcaaggtggcggggtgcgagcacggcgaggaggcctccgaggccaagtgccgctgcagcctcgtgcacaagccgggggaggtcgtggtgtcctacggcggcatgcgggtccgccccaagtgctacgggttcagccggatgatggccaccctggaggtgaaccagcccgagcagcgcatcggccagtgcacggggtgccacctggagtgcatcaacggcggggtgcggctcatcaccctgaccagcgagctgaagtccgcgaccgtctgcgccagccacttctgctccagcgccacgtccggcaagaagtccaccgagatccagttccacagcggcagcctcgtggggaagaccgccatccacgtcaagggcgccctggtggacgggaccgagttcacgttcgagggctcctgcatgttccccgacggctgcgacgcggtggactgcaccttctgccgcgagttcctgaagaacccgcagtgctaccccgccaagaagtggctgttcatcatcatcgtcatcctgctggggtacgccggcctcatgctgctgaccaacgtgctcaaggccatcgggatctggggcagctgggtgatcgcccccgtcaagctgatcttcgcgatcatcaagaagctgatgcggaccgtgtcctgcctcatggggaagctgatggaccgcggccgccaggtgatccacgaggagatcggcgagaaccgggaggggaaccaggacgacgtccggatcgagatggcccgcccccgccgggtgcgccactggatgtacagcccggtgatcctgacgatcctcgccatcggcctggccgagtcctgcgacgagatggtccacgccgacagcaagctggtgtcctgccggcaggggagcggcaacatgaaggagtgcgtgaccaccgggcgcgcgctcctgcccgccgtcaaccccggccaggaggcctgcctgcacttcaccgcccccggctccccggacagcaagtgcctcaagatcaaggtgaagcggatcaacctgaagtgcaagaagtccagcagctacttcgtgcccgacgcccgctcccggtgcacgagcgtccgccggtgccgctgggcgggggactgccagtccggctgcccgccccacttcaccagcaactccttcagcgacgactgggccgggaagatggaccgggccggcctggggttctccggctgcagcgacggctgcgggggcgccgcgtgcgggtgcttcaacgccgccccctcctgcatcttctggcgcaagtgggtggagaacccccacggcatcatctggaaggtgagcccctgcgccgcctgggtcccgtccgcggtgatcgagctcaccatgcccagcggggaggtgcggaccttccaccccatgtccggcatccccacgcaggtcttcaagggcgtgagcgtgacctacctggggtccgacatggaggtcagcggcctgaccgacctctgcgagatcgaggagctgaagtccaagaagctggccctggccccgtgcaaccaggccgggatgggcgtggtgggcaaggtcggggagatccagtgcagcagcgaggagtccgcccgcaccatcaagaaggacggctgcatctggaacgcggacctcgtggggatcgagctgcgggtggacgacgccgtctgctacagcaagatcacgtccgtggaggccgtggccaactacagcgccatccccaccaccatcggcgggctgcgcttcgagcggtcccacgacagccagggcaagatctccggcagccccctcgacatcaccgcgatccgcgggtccttcagcgtcaactaccggggcctgcgcctgtccctcagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttctccgtgctggagggcgtccacagctacaccgtgagcctctccttcgaccacgccgtggtcgacgagcagtgccagctgaactgcgggggccacgagagccaggtgaccctgaaggggaacctcatcttcctggacgtgcccaagttcgtcgacggctcctacatgcagacgtaccacagcaccgtgccgaccggggccaacatcccctcccccaccgactggctgaacgccctcttcggcaacggcctgagccggtggatcctgggggtgatcggcgtcctcctcgggggcctggccctcttcttcatgatcatgtccctgttcaagctgggcacgaagcaggtcttccgcagccggtccaagctcgcgtga

SEQ ID NO: 13148 - RNA, 3222 nt, synthetic construct
  misc_feature 1..3222: note = derived and/or modified CDS sequence (opt1) from SFTSV(HNXH)__KT254590.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgagccagcccgagcagcgcatcgggcagtgcaccggctgccacctcgagtgcatcaacgggggcgtgcggctgatcaccctgaccagcgagctcaagtccgcgacggtctgcgccagccacttctgctccagcgccacctccggcaagaagtccaccgagatccagttccactccgggagcctggtgggcaagaccgccatccacgtcaagggggccctggtggacggcacggagttcaccttcgagggctcctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggagctgggtcatcgcccccgtgaagctggtgttcgcgctcatcaagaagctgatgcgggccgtctcctgcctgatgggcaagctcatggaccgcggccgccaggtgatccacgaggagatcggggagaaccgggagggcaaccaggacgacgtgcggatcgagatggcccgcccccgccgggtccgccactggatgtacagccccgtgatcctgacgatcctggccatcgggctcgccgagggctgcgacgagatggtgcacgcggactccaagctggtcagctgccggcaggggtccggcaacatgaaggagtgcgtgaccaccggccgcgccctgctcccggccgtgaaccccgggcaggaggcctgcctgcacttcaccgcccccggcagccccgactccaagtgcctgaagatcaaggtcaagcggatcaacctcaagtgcaagaagtccagcagctacttcgtgccggacgcgcgcagccggtgcacgtccgtgcgccggtgccgctgggccggggactgccagagcggctgcccgccccacttcacctccaacagcttctccgacgactgggccgggaagatggaccgggccggcctgggcttcagcgggtgctccgacggctgcgggggcgcggcctgcgggtgcttcaacgccgcccccagctgcatcttctggcgcaagtgggtcgagaacccccacggcatcatctggaaggtgtccccctgcgccgcgtgggtgcccagcgccgtcatcgagctgaccatgccgtccggcgaggtgcggaccttccaccccatgagcgggatccccacccaggtgttcaagggcgtctccgtgacctacctcgggagcgacatggaggtgtccggcctgaccgacctgtgcgagatcgaggagctcaagagcaagaagctggccctggccccctgcaaccaggccggcatgggggtcgtgggcaaggtgggggagatccagtgctccagcgaggagagcgcgcgcaccatcaagaaggacggctgcatctggaacgccgacctggtcgggatcgagctccgggtggacgacgccgtgtgctactccaagatcacgagcgtcgaggccgtggccaactactccgcgatcccgaccaccatcggcggcctgcgcttcgagcggagccacgactcccaggggaagatcagcggcagccccctggacatcaccgccatccgcgggagcttctccgtgaactaccggggcctccgcctgagcctgtccgagatcacggccacgtgcaccggggaggtcaccaacgtgagcggctgctactcctgcatgaccggcgccaaggtgagcatcaagctccactccagcaagaactccacggcgcacgtccgctgcaagggggacgagaccgccttcagcgtgctggagggcgtgcactcctacagcgtcagcctgtccttcgaccacgccgtggtggacgagcagtgccagctcaactgcgggggccacgagagccaggtcaccctgcgggggaacctgatcttcctcgacgtgcccaagttcgtggacggctcctacatgcagacctaccacagcacggtccccaccggcgccaacatcccgtcccccaccgactggctgaacgccctgttcgggaacggcctcagccgctggatcctgggggtgaccggcgtcctgctcggcgggctggcgctgttcttcctcatcatgtccctgttcaagctgggcacgaagcagatcttccggagccgcaccaagctcgcctga

SEQ ID NO: 13149 - RNA, 3222 nt, synthetic construct
  misc_feature 1..3222: note = derived and/or modified CDS sequence (opt1) from SFTSV(JS2012-goat01)__KC473538.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcggatccgcccgaagtgctacgggttcagccggatgatggccaccctggaggtcaaccagcccgagcagcgcctgggccagtgcacggggtgccacctcgagtgcatcaacggcggggtgcggctgatcaccctgacctccgagctcaagagcgcgaccgtgtgcgcctcccacttctgcagctccgccacgagcggcaagaagtccaccgagatccagttccacagcggctccctggtcgggaagaccgccatccacgtgaagggcgccctggtcgacgggaccgagttcacgttcgagggcagctgcatgttccccgacggctgcgacgcggtggactgcaccttctgccgcgagttcctcaagaacccccagtgctacccggccaagaagtggctgttcatcatcatcgtgatcctgctcgggtacgccggcctgatgctgctcaccaacgtcctgaaggccatcgggatctggggctcctgggtgatcgcccccgtgaagctgatgttcgcgatcatcaagaagctcatgcggaccgtcagctgcctgatgcgcaagctgatggaccgggggcgccaggtgatccacgaggagatcggcgagaaccgggagggcaaccaggacgacgtgcgcatcgagatggcccgcccccggcgcgtccggcactggatgtactcccccgtgatcctcacgatcctggccatcgggctggccgagagctgcgacgagatggtgcacgccgactccaagctcgtcagctgccgccagggctccgggaacatgaaggagtgcgtgaccaccggccgggcgctgctgccggccgtgaaccccgggcaggaggcctgcctccacttcaccgcccccggcagccccgacagcaagtgcctgaagatcaaggtcaagcgcatcaacctgaagtgcaagaagtccagctcctacttcgtgccggacgcccggagccgctgcacgtccgtgcggcgctgccggtgggcgggcgactgccagagcgggtgcccgccccacttcacctccaacagcttctccgacgactgggccggcaagatggaccgcgccgggctcggcttcagcgggtgctccgacggctgcggcggggccgcgtgcggctgcttcaacgccgcccccagctgcatcttctggcggaagtgggtcgagaacccccacgggatcatctggaaggtgtccccctgcgccgcctgggtgcccagcgcggtcatcgagctgaccatgccgtccggcgaggtgcgcaccttccaccccatgagcgggatccccacccaggtgttcaagggcgtctccgtgacctacctgggcagcgacatggaggtgtccgggctcaccgacctgtgcgagatcgaggagctcaagagcaagaagctggccctggccccctgcaaccaggccggcatgggggtcgtgggcaaggtgggcgagatccagtgcagctccgaggagagcgcccggaccatcaagaaggacgggtgcatctggaacgcggacctggtcggcatcgagctgcgcgtggacgacgccgtgtgctactccaagatcacgagcgtcgaggccgtggccaactactccgccatcccgaccaccatcgggggcctccggttcgagcgcagcctggactcccaggggaagatcagcggcagccccctggacatcaccgcgatccggggcagcttctccgtgaactaccgcgggctccgcctgagcctgtccgagatcacggccacgtgcaccggcgaggtcaccaacgtgagcgggtgctactcctgcatgaccggcgccaaggtgagcatcaagctccactccagcaagaactccacggcccacgtccggtgcaagggggacgagaccgcgttcagcgtgctggagggcgtgcacagctacaccgtctccctgagcttcgaccacgccgtggtggacgagcagtgccagctcaactgcggcgggcacgagtcccaggtcaccctgaagggcaacctgatcttcctcgacgtgcccaagttcgtggacgggagctacatgcagacgtaccactccaccgtccccaccggcgccaacatcccgagccccaccgactggctgaacgccctgttcgggaacggcctctcccgctggatcctgggcgtgatcggggtgctgctcggcgggctggccctgttcttcatgatcatgagcctcttcaagctgggcacgaagcaggtcttccggtcccgcaccaagctggcgtga

SEQ ID NO: 13150 - RNA, 3222 nt, synthetic construct
  misc_feature 1..3222: note = derived and/or modified CDS sequence (opt1) from SFTSV(JS2012-tick01)__KC473541.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcctgggccagtgcacggggtgccacctcgagtgcatcaacggcggggtgcggctgatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgcgagttcctcaagaacccccagtgctacccggccaagaagtggctgttcatcatcatcgtcatcctgctcgggtacgccggcctgatgctgctcaccaacgtgctgaaggccatcgggatctggggctcctgggtgatcgcccccgtcaagctgatgttcgcgatcatcaagaagctcatgcggaccgtgagctgcctgatgcgcaagctgatggaccgggggcgccaggtgatccacgaggagatcggcgagaaccgggagggcaaccaggacgacgtccgcatcgagatggcccgcccccggcgcgtgcggcactggatgtactcccccgtgatcctcacgatcctggccatcgggctggccgagagctgcgacgagatggtccacgccgactccaagctcgtgagctgccgccagggctccgggaacatgaaggagtgcgtgaccaccggccgggcgctgctgccggccgtcaaccccgggcaggaggcctgcctccacttcaccgcccccggcagccccgacagcaagtgcctgaagatcaaggtgaagcgcatcaacctgaagtgcaagaagtccagctcctacttcgtgccggacgcccggagccgctgcacgtccgtccggcgctgccggtgggcgggcgactgccagagcgggtgcccgccccacttcacctccaacagcttctccgacgactgggccggcaagatggaccgcgccgggctcggcttcagcgggtgctccgacggctgcggcggggccgcgtgcggctgcttcaacgccgcccccagctgcatcttctggcggaagtgggtggagaacccccacgggatcatctggaaggtgtccccctgcgccgcctgggtccccagcgcggtgatcgagctgaccatgccgtccggcgaggtgcgcaccttccaccccatgagcgggatccccacgcaggtcttcaagggcgtgtccgtgacctacctgggcagcgacatggaggtctccgggctcaccgacctgtgcgagatcgaggagctcaagagcaagaagctggccctggccccctgcaaccaggccggcatgggggtggtgggcaaggtcggcgagatccagtgcagctccgaggagagcgcccggaccatcaagaaggacgggtgcatctggaacgcggacctggtgggcatcgagctgcgcgtggacgacgccgtctgctactccaagatcacgagcgtggaggccgtggccaactactccgccatcccgaccaccatcgggggcctccggttcgagcgcagccacgactcccaggggaagatcagcggcagccccctggacatcaccgcgatccggggcagcttctccgtcaactaccgcgggctgcgcctcagcctgtccgagatcacggcgacctgcaccggcgaggtgaccaacgtgagcgggtgctactcctgcatgaccggcgccaaggtcagcatcaagctgcactccagcaagaactccacggcccacgtgcggtgcaagggggacgagaccgccttcagcgtgctcgagggcgtccacagctacaccgtgtccctgagcttcgaccacgccgtggtcgacgagcagtgccagctgaactgcggcgggcacgagtcccaggtgaccctcaagggcaacctgatcttcctggacgtgcccaagttcgtcgacgggagctacatgcagacgtaccactccaccgtgcccaccggcgccaacatcccgagccccaccgactggctcaacgccctgttcgggaacggcctgtcccgctggatcctcggcgtgatcggggtcctgctgggcgggctcgccctgttcttcatgatcatgagcctgttcaagctcggcacgaagcaggtcttccggtcccgcaccaagctggcgtga

SEQ ID NO: 13151 - RNA, 3222 nt, synthetic construct
  misc_feature 1..3222: note = derived and/or modified CDS sequence (opt1) from SFTSV(LN2012-14)__KF887436.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtctggatcgagatggcccggccccgccgcgtgcggtactggatgtactcccccgtgatcctgacgatcctcgccgtcggcctggccgagagctgcgacgagatggtgcacgccgactccaagctggtgagctgccgccaggggtccggcaacatgaaggagtgcgtcaccaccgggcgggcgctcctgccggccgtgaaccccggccaggaggcctgcctgcacttcaccgcccccggcagccccgacagcaagtgcctcaagatccgcgtgaagcggatcaacctgaagtgcaagaagtccagctcctacttcgtcccggacgcccgcagccggtgcacgtccgtgcgccggtgccgctgggcgggggactgccagagcggctgcccgccccacttcacctccaacagcttctccgacgactgggtggggaagatggaccgggccggcctggggttcagcggctgctccgacggctgcgggggcgccgcctgcgggtgcttcaacgcggcccccagctgcatcttctggcgcaagtgggtcgagaacccccacggcatcatctggaaggtgtccccctgcgccgcctgggtgcccagcgccgtcatcgagctcaccatgccgtccggggaggtgcggaccttccaccccatgagcggcatccccacccaggtgttcaagggcgtctccgtgacgtacctggggagcgacatggaggtgtccggcctgaccgacctctgcgagatcgaggagctcaagagcaagaagctggcgctggccccctgcaaccaggccgggatgggcgtcgtgggcaaggtgggggagatccagtgcagctccgaggagagcgcccgcaccatcaagaaggacggctgcatctggaacgccgacctggtcgggatcgagctgcgggtggacgacgcggtgtgctactccaagatcacgagcgtcgaggccgtggccaactactccgccatcccgaccaccatcggcgggctgcgcttcgagcggagccacgactcccagggcaagatcagcggcagccccctcgacatcaccgccatccgcgggagcttctccgtgaactaccggggcctgcgcctgagcctctccgagatcacggcgacctgcaccggggaggtcaccaacgtgagcggctgctactcctgcatgaccggggccaaggtgagcatcaagctgcactccaacaagaacagcacggcccacgtccgctgcaagggcgacgagaccgccttctccgtgctggagggcgtgcacagctacaccgtcagcctctccttcgaccacgcggtggtggacgagcagtgccagctgaactgcgggggccacgagagccaggtcaccctgaaggggaacctcatcttcctggacgtgcccaagttcgtggacggctcctacatgcagacgtaccacagcaccgtccccaccggggccaacatcccgtcccccaccgactggctgaacgccctcttcggcaacggcctgagccggtggatcctgggggtgatcggcgtcctcctcgggggcctggccctgttcttcatgatcatgtccctgttcaagctgggcacgaagcaggtcttccgcagccggaccaagctcgcctga

SEQ ID NO: 13152 - RNA, 3222 nt, synthetic construct
  misc_feature 1..3222: note = derived and/or modified CDS sequence (opt1) from SFTSV(LN2012-34)__KF887437.1__GP
  source 1..3222: mol_type = other RNA
atgatgaaggtgatctggttcttcagcctgatctgcttcgtcatccagtgctccggcgacagcgggcccatcatctgcgccggcccgatccactccaacaagagcgccgacatcccccacctcctggggtactccgagaagatctgccagatcgaccgcctgatccacgtgagctcctggctccggaaccacagccagttccagggctacgtggggcagcgcggcggccggtcccaggtcagctactaccccgcggagaactcctacagccgctggtccgggctgctgagcccctgcgacgccgactggctcggcatgctggtggtgaagaaggccaaggggtccgacatgatcgtcccgggccccagctacaaggggaaggtgttcttcgagcggcccaccttcgacggctacgtgggctgggggtgcggctccggcaagagccgcaccgagtccggggagctgtgcagcagcgactccggcacgagctccgggctcctgcccagcgaccgggtcctgtggatcggcgacgtggcctgccagccgatgacccccatccccgaggagaccttcctcgagctgaagtccttcagccagtccgagttccccgacatctgcaagatcgacgggatcgtgttcaaccagtgcgagggcgagagcctgccgcagcccttcgacgtcgcctggatggacgtggggcactcccacaagatcatcatgcgcgagcacaagaccaagtgggtgcaggagagctccagcaaggacttcgtctgctacaaggagggcacgggcccctgctccgagagcgaggagaagacctgcaagacctccgggagctgccggggcgacatgcagttctgcaaggtggcggggtgcgagcacggcgaggaggcctccgaggccaagtgccgctgcagcctcgtgcacaagcccggggaggtcgtggtgtcctacggcggcatgcggatccgcccgaagtgctacgggttcagccggatgatggccaccctggaggtcaaccagcccgagcagcgcatcggccagtgcacggggtgccacctggagtgcatcaacggcggggtgcggctcatcaccctgaccagcgagctgaagtccgcgaccgtgtgcgccagccacttctgctccagcgccacgtccggcaagaagtccaccgagatccagttccacagcggcagcctcgtcgggaagaccgccatccacgtgaagggcgccctggtcgacgggaccgagttcacgttcgagggctcctgcatgttccccgacggctgcgacgcggtggactgcaccttctgccgcgagttcctgaagaacccccagtgctacccggccaagaagtggctgttcatcatcatcgtgatcctgctggggtacgccggcctcatgctgctgaccaacgtcctcaaggccatcgggatctggggcagctgggtgatcgcccccgtgaagctgatcttcgcgatcatcaagaagctgatgcggaccgtctcctgcctcatggggaagctgatggaccgcggccgccaggtgatccacgaggagatcggcgagaaccgggaggggaaccaggacgacgtgcggatcgagatggcccgcccccgccgggtccgccactggatgtacagccccgtgatcctgacgatcctcgccatcggcctggccgagtcctgcgacgagatggtgcacgccgacagcaagctggtctcctgccggcaggggagcggcaacgtgaaggagtgcgtgaccaccgggcgcgcgctcctgccggccgtcaaccccggccaggaggcctgcctgcacttcaccgcccccggctcccccgacagcaagtgcctcaagatccgggtgaagcgcatcaacctgaagtgcaagaagtccagcagctacttcgtgccggacgcccggtcccgctgcacgagcgtccggcgctgccggtgggcgggggactgccagtccggctgcccgccccacttcaccagcaactccttcagcgacgactgggccgggaagatggaccgcgccggcctggggttctccggctgcagcgacggctgcgggggcgccgcgtgcgggtgcttcaacgccgccccctcctgcatcttctggcggaagtgggtggagaacccccacggcatcatctggaaggtgagcccctgcgccgcctgggtcccctccgcggtgatcgagctcaccatgccgagcggggaggtgcgcaccttccaccccatgtccggcatccccacgcaggtcttcaagggcgtgagcatcacctacctggggtccgacatggaggtgagcggcctgaccgacctctgcgagatcgaggagctgaagtccaagaagctggccctggccccctgcaaccaggccgggatgggcgtcgtgggcaaggtgggggagatccagtgcagcagcgaggagtccgcccggaccatcaagaaggacggctgcatctggaacgcggacctcgtcgggatcgagctgcgcgtggacgacgccgtgtgctacagcaagatcacgtccgtcgaggccgtggccaactacagcgccatcccgaccaccatcggcgggctgcggttcgagcgctcccacgacagccagggcaagatctccggcagccccctcgacatcaccgcgatccgggggtccttcagcgtgaactaccgcggcctgcgcctgtccctcagcgagatcacggcgacctgcaccggggaggtcaccaacgtgtccggctgctacagctgcatgaccggggccaaggtgtccatcaagctgcacagcaacaagaactccacggcccacgtccggtgcaagggcgacgagaccgccttcagcgtgctggagggcgtgcactcctacaccgtcagcctcagcttcgaccacgccgtggtggacgagcagtgccagctgaactgcgggggccacgagtcccaggtcaccctgaaggggaacctcatcttcctggacgtgcccaagttcgtggacggcagctacatgcagacgtaccactccaccgtccccaccggggccaacatcccgagccccaccgactggctgaacgccctcttcggcaacggcctgtcccgctggatcctgggggtgatcggcgtgctcctcgggggcctggccctcttcttcatgatcatgagcctgttcaagctgggcacgaagcaggtcttccggtcccgcaccaagctcgcgtga

SEQ ID NO: 13153 - RNA, 3222 nt, synthetic construct
  misc_feature 1..3222: note = derived and/or modified CDS sequence (opt1) from SFTSV(LN2012-41)__KF887438.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacgtgaaggagtgcgtcaccaccgggcgcgcgctcctgccggccgtgaaccccggccaggaggcctgcctgcacttcaccgcccccggcagccccgacagcaagtgcctcaagatccgggtgaagcgcatcaacctgaagtgcaagaagtccagctcctacttcgtcccggacgcccggagccgctgcacgtccgtgcggcgctgccggtgggcgggggactgccagagcggctgcccgccccacttcacctccaacagcttctccgacgactgggccgggaagatggaccgcgccggcctggggttcagcggctgctccgacggctgcgggggcgccgcgtgcgggtgcttcaacgccgcccccagctgcatcttctggcggaagtgggtggagaacccccacggcatcatctggaaggtctccccctgcgccgcctgggtgcccagcgcggtgatcgagctcaccatgccgtccggggaggtccgcaccttccaccccatgagcggcatccccacccaggtgttcaagggcgtgtccgtcacgtacctggggagcgacatggaggtgtccggcctgaccgacctctgcgagatcgaggagctcaagagcaagaagctggccctggccccctgcaaccaggccgggatgggcgtggtcggcaaggtgggggagatccagtgcagctccgaggagagcgcccggaccatcaagaaggacggctgcatctggaacgcggacctggtggggatcgagctgcgcgtcgacgacgccgtgtgctactccaagatcacgagcgtggaggccgtcgtgaactactccgccatcccgaccaccatcggcgggctgcggttcgagcgcagccacgactcccagggcaagatcagcggcagccccctcgacatcaccgccatccgggggagcttctccgtgaactaccgcggcctgcgcctgagcctctccgagatcacggcgacctgcaccggggaggtcaccaacgtgagcggctgctactcctgcatgaccggggccaaggtgagcatcaagctgcactccaacaagaacagcacggcccacgtccggtgcaagggcgacgagaccgccttctccgtgctggagggcgtgcacagctacaccgtcagcctctccttcgaccacgcggtggtggacgagcagtgccagctgaactgcgggggccacgagagccaggtcaccctgaaggggaacctcatcttcctggacgtgcccaagttcgtggacggctcctacatgcagacgtaccacagcaccgtccccaccggggccaacatcccgtcccccaccgactggctgaacgccctcttcggcaacggcctgagccgctggatcctgggggtgatcggcgtcctcctcgggggcctggccctgttcttcatgatcatgtccctgttcaagctgggcacgaagcaggtcttccggagccgcaccaagctcgcctga

SEQ ID NO: 13154 - RNA, 3222 nt, synthetic construct
  misc_feature 1..3222: note = derived and/or modified CDS sequence (opt1) from SFTSV(LN2012-58)__KF887440.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgtgcagcgcatcggccagtgcacggggtgccacctggagtgcatcaacggcggggtccggctcatcaccctgacctccgagctcaagagcgcgaccgtgtgcgcctcccacttctgcagctccgccacgagcggcaagaagtccaccgagatccagttccacagcggctccctcgtcgggaagaccgccatccacgtgaagggcgccctggtggacgggaccgagttcacgttcgagggcagctgcatgttccccgacggctgcgacgcggtcgactgcaccttctgccgcgagttcctgaagaacccccagtgctacccggccaagaagtggctgttcatcatcatcgtgatcctgctggggtacgccggcctcatgctgctgaccaacgtgctcaaggccatcgggatctggggctcctgggtcatcgcccccgtgaagctgatcttcgcgatcatcaagaagctgatgcggaccgtgagctgcctcatggggaagctgatggaccgcggccggcaggtcatccacgaggagatcggcgagaaccgcgaggggaaccaggacgacgtgcggatcgagatggcccgcccccgccgggtgcgccactggatgtactcccccgtcatcctgacgatcctcgtgatgggcctggccgagagctgcgacgagatggtgcacgccgactccaagctggtcagctgccggcaggggtccggcaacatgaaggagtgcgtgaccaccgggcgcgccctcctgccggcggtgaaccccggccaggaggcctgcctgcacttcaccgcccccggcagccccgacagcaagtgcctcaagatcaaggtcaagcggatcaacctgaagtgcaagaagtccagctcctacttcgtgccggacgcccgcagccggtgcacgtccgtgcgccggtgccgctgggccggggactgccagagcggctgcccgccccacttcacctccaacagcttctccgacgactgggcggggaagatggaccgggccggcctggggttcagcggctgctccgacggctgcgggggcgccgcctgcgggtgcttcaacgcggcccccagctgcatcttctggcgcaagtgggtcgagaacccccacggcatcatctggaaggtgtccccctgcgccgcctgggtgcccagcgccgtcatcgagctcaccatgccgtccggggaggtgcggaccttccaccccatgagcggcatccccacccaggtgttcaagggcgtctccgtgacgtacctggggagcgacatggaggtgtccggcctgaccgacctctgcgagatcgaggagctcaagagcaagaagctggcgctggccccctgcaaccaggccgggatgggcgtcgtgggcaaggtgggggagatccagtgcagctccgaggagagcgcccgcaccatcaagaaggacggctgcatctggaacgccgacctggtcgggatcgagctgcgggtggacgacgcggtgtgctactccaagatcacgagcgtcgaggccgtggccaactactccgccatcccgaccaccatcggcgggctgcgcttcgagcggagccacgactcccagggcaagatcagcggcagccccctcgacatcaccgccatccgcgggagcttctccgtgaactaccggggcctgcgcctgagcctctccgagatcacggcgacctgcaccggggaggtcaccaacgtgagcggctgctactcctgcatgaccggggccaaggtgagcatcaagctgcactccagcaagaactccacggcccacgtccgctgcaagggcgacgagaccgccttcagcgtgctggagggcgtgcacagctacaccgtctccctcagcttcgaccacgcggtggtggacgagcagtgccagctgaactgcgggggccacgagtcccaggtcaccctgaaggggaacctcatcttcctggacgtgcccaagttcgtggacggcagctacatgcagacgtaccactccaccgtccccaccggggccaacatcccgagccccaccgactggctgaacgccctcttcggcaacggcctgtcccggtggatcctgggggtgatcggcgtcctcctcgggggcctggccctgttcttcatgatcatgagcctgttcaagctgggcacgaagcaggtcttccgctcccggaccaagctcgcctga

SEQ ID NO: 13155 - RNA, 3222 nt, synthetic construct
  misc_feature 1..3222: note = derived and/or modified CDS sequence (opt1) from SFTSV(NB24/CHN/2013)__KR698337.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccgacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcgtgaacgggggcgtccggctgatcaccctgacctccgagctcaagagcgcgacggtgtgcgcctcccacttctgcagctccgccaccagcgggaagaagtccaccgagatccagttccacagcggctccctggtcggcaagaccgccatccacgtgaagggggccctggtggacggcacggagttcaccttcgaggggagctgcatgttccccgacggctgcgacgcggtcgactgcaccttctgccgcgagttcctcaagaacccccagtgctaccccgccaagaagtggctgttcatcaacatcgtgatcctgctcggctacgccgggctgatgctgctcaccaacgtgctgaaggccatcggcgtctgggggtcctgggtgatcgcccccgtgaagctgatgttcgcgatcatcaagaagctcatgcggagcgtctcctgcctgatgggcaagctgatggaccgcgggcgccaggtgatccacgaggagatcggcgagaaccgggagggcaaccaggacgacgtgcggatcgagatggcccgcccccgccgggtccgccactggatgtacagcccggtgatcctcacgatcctggccgtggggctggccgagggctgcgacgagatggtccacgccgactccaagctcgtgagctgcaagcaggggtccggcaacatgaaggagtgcgtgaccaccgggcgggcgctgctgcccgccgtcaaccccggccaggaggcctgcctccacttcaccgcccccggcagcccggacagcaagtgcctgaagatcaaggtgaagaagatcaacctgaagtgcaagaagtccagctcctacttcgtgcccgacgcccgcagccggtgcacgtccgtccgccggtgccgctgggcgggggactgccagagcggctgcccctcccacttcaccagcaactccttcagcgacgactgggccgggaagatggaccgggccggcctcgggttctccggctgcagcgacggctgcgggggcgccgcgtgcgggtgcttcaacgccgccccgtcctgcatcttctggcgcaagtgggtggagaacccccacggcatcatctggaaggtgagcccctgcgccgcctgggtcccctccgcggtgatcgagctgaccatgccgagcggggaggtgcggaccttccaccccatgtccggcatccccacgcaggtcttcaagggcgtgagcgtgacctacctggggtccgacatggaggtcagcggcctcaccgacctgtgcgagatcgaggagctcaagagcaagaagctggccctggccccctgcaaccaggccgggatgggcgtggtgggcaaggtcggggagatccagtgctccagcgaggagtccgcccgcaccatcaagaaggacggctgcatctggaacgcggacctggtggggatcgagctgcgggtggacgacgccgtctgctacagcaagatcacgtccgtggaggccgtggccaactacagcgccatcccgaccaccatcggcgggctccgcttcgagcggtcccacgacagccagggcaagatctccggcagccccctggacatcaccgcgatccgcgggtccttcagcgtcaactaccggggcctgcgcctctccctgagcgagatcacggcgacctgcaccggggaggtgaccaacgtgtccggctgctacagctgcatgaccggggccaaggtctccatcaagctgcacagcaacaagaactccacggcccacgtgcggtgcaagggcgacgagaccgccttcagcgtgctcgagggcgtccacagctacaccgtgtccctgagcttcgaccacgccgtggtcgacgagcagtgccagctgaactgcgggggccacgagtcccaggtgaccctcaaggggaacctgatcttcctggacgtgcccaagttcgtcgacggcagctacatgcagacgtaccactccagcgtgcccaccggggccaacatcccgtcccccaccgactggctcaacgccctgttcggcaacggcctgagccgctggatcctcggggtcatcggcgtgctgctcgggggcctggccctgttcttcctgatcatgtccctcttcaagctgggcaccaagcaggtcttccgcagccggtccaagctggcgtga

SEQ ID NO: 13156 - RNA, 3222 nt, synthetic construct
  misc_feature 1..3222: note = derived and/or modified CDS sequence (opt1) from SFTSV(NB31/CHN/2013)__KR698338.1__GP
  source 1..3222: mol_type = other RNA
atgatgaaggtgatctggttcagctccctgatctgcttcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctccggaaccacagccagttccagggctacgtggggcagcgcggcggccggtcccaggtcagctactacccctccgagaacagcaactcccgctggagcgggctgctgtccccctgcgacgcggactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcacggagagcggcgagctgtgcagctccgacagcggcacctccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagtccgagagcctgccgcagcccttcgacgtcgcctggatggacgtgggccactcccacaagatcatcatgcgcgagcacaagacgaagtgggtgcaggagagctccagcaaggacttcgtctgctacaaggaggggaccggcccctgctccgagagcgaggagaagacctgcaagacctccggcagctgccgcggggacatgcagttctgcaaggtggccggctgcgagcacggggaggaggcgtccgaggccaagtgccggtgcagcctcgtgcacaagcccggcgaggtcgtggtgagctacgggggcatgcgggtccgcccgaagtgctacggcttctcccggatgatggccacgctggaggtgaacccgcccgagcagcgcatcgggcagtgcaccggctgccacctggagtgcatcaacgggggcgtgcggctcatcaccctgaccagcgagctgaagtccgccacggtctgcgcgagccacttctgctccagcgccacctccgggaagaagaacaccgagatccagttccacagcggctccctcgtgggcaagaccgtcatccacgtgaagggggccctggtggacggcacggagttcaccttcgaggggagctgcatgttccccgacggctgcgaggccgtcgactgcaccttctgccgcgagttcctgaagaacccccagtgctaccccgccaagaagtggctgttcatcatcatcgtgatcctgctgggctacgcggggctcatgctgctgaccaacgtgctcaaggccatcggcgtctgggggtcctgggtgatcgcccccgtgaagctgatgttcgccatcatcaagaagctgatgcggagcgtctcctgcctcatgggcaagctgatggaccgcgggcgccaggtgatccacgaggagatcggcgagaaccgggagggcaaccgggacgacgtgcgcatcgagatggcccgcccccggcgcgtccggcactggatgtacagcccggtgatcctgacgatcctcgcgatcgggctggccgagggctgcgacgagatggtgcacgccgactccaagctggtcagctgcaagcaggggtccggcaacatgaaggagtgcgtgaccaccgggcgcgtgctcctgcccgccgtcaaccccggccaggaggcctgcctgcacttcaccgcgcccggcagcccggacagcaagtgcctcaagatcaaggtgaagcggatcaacctgaagtgcaagaagtccagctcctacttcgtgcccgacgcccgcagccggtgcacgtccgtccgccggtgccgctgggccggggactgccagagcggctgcccctcccacttcaccagcaactccttcagcgacgactgggccgggaagatggaccgggccggcctggggttctccggctgcagcgacggctgcgggggcgcggcctgcgggtgcttcaacgccgccccgtcctgcatcttctggcgcaagtgggtggagaacccccacggcatcatctggaaggtgagcccctgcgcggcctgggtcccctccgccgtgatcgagctcaccatgccgagcggggaggtgcggaccttccaccccatgtccggcatccccacgcaggtcttcaagggcgtgagcgtgacctacctggggtccgacatggaggtcagcggcctgaccgacctctgcgagatcgaggagctcaagagcaagaagctggccctggccccctgcaaccaggcggggatgggcgtggtgggcaaggtcggggagatccagtgctccagcgaggagtccgcccgcaccatcaagaaggacggctgcatctggaacgccgacctggtggggatcgagctgcgggtggacgacgccgtctgctacagcaagatcacgtccgtggaggccgtggcgaactacagcgccatcccgaccaccatcggcgggctgcgcttcgagcggtcccacgacagccagggcaagatctccggcagccccctcgacatcaccgccatccgcgggtccttcagcgtcaactaccggggcctgcgcctgtccctcagcgagatcacggcgacctgcaccggggaggtgaccaacgtgtccggctgctacagctgcatgaccggggccaaggtctccatcaagctgcacagctccaagaacagcacggcgcacgtgcgctgcaagggcgacgagaccgccttcagcgtgctggagggcgtccactcctacaccgtgagcctctccttcgaccacgccgtggtcgacgagcagtgccagctgaactgcgggggccacgagagccaggtgaccctgaaggggaacctcatcttcctggacgtgcccaagttcgtcgacggctcctacatgcagacgtaccacagctccgtgcccaccggggccaacatcccgagccccaccgactggctgaacgccctcttcggcaacggcctgtcccggtggatcctgggggtcgtgggcgtgctcctcgggggcctggtcctgttcttcctgatcatgagcctgttcaagctcggcaccaagcaggtcttccgctcccggacgaagctggcctga

SEQ ID NO: 13157 - RNA, 3222 nt, synthetic construct
  misc_feature 1..3222: note = derived and/or modified CDS sequence (opt1) from SFTSV(NB38/CHN/2013)__KR698341.1__GP
  source 1..3222: mol_type = other RNA
atgatgaaggtgatctggttcagctccctgatctgcctcgtgatccagtgcggcggggacaccagccccatcatctgcgccggcccgatccactccaacaagagcgccgacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagggcgagagcctcccgcagcccttcgacgtcgcctggatggacgtggggcactcccacaagatcatcatgcgcgagcacaagacgaagtgggtgcaggagagctccagcaaggacttcgtctgctacaaggagggcaccggcccctgctccgagagcgaggagaagacctgcaagacctccgggagctgccggggcgacatgcagttctgcaaggtggcggggtgcgagcacgaggaggaggcctccgaggccaagtgccgctgcagcctggtgcacaagcccggcgaggtcgtggtgtcctacgggggcatgcgggtccgcccgaagtgctacggcttcagccggatgatggccacgctggaggtgaaccagcccgagcagcgcatcgggcagtgcaccggctgccacctcgagtgcatcagcgggggcgtgcggctgatcaccctgacctccgagctcaagagcgcgacggtctgcgcctcccacttctgcagctccgccaccagcgggaagaagtccaccgagatccagttccacagcggctccctggtgggcaagaccgccatccacgtcaagggggccctggtggacggcacggagttcaccttcgaggggagctgcatgttccccgacggctgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggtcctgggtcatcgcccccgtgaagctggtgttcgcgatcatcaagaagctcatgcgggccgtcagctgcctgatgggcaagctgatggaccgcgggcgccaggtgatccacgaggagatcggcgagaaccgggagggcaaccaggacgacgtgcggatcgagatggcccgcccccgccgggtccgccactggatgtactcccccgtgatcctcacgatcctggccatcgggctggccgagggctgcgacgagatggtgcacgcggacagcaagctcgtctcctgccggcaggggagcggcaacatgaaggagtgcgtgaccaccgggcgcgccctgctgccggccgtgaaccccggccaggaggcctgcctccacttcaccgcccccggctcccccgacagcaagtgcctgaagatcaaggtcaagcggatcaacctgaagtgcaagaagtccagcagctacttcgtgccggacgcgcgctcccggtgcacgagcgtgcgccggtgccgctgggccggggactgccagtccggctgcccgccccacttcaccagcaactccttcagcgacgactgggccgggaagatggaccgggccggcctcgggttctccggctgcagcgacggctgcgggggcgcggcctgcgggtgcttcaacgccgccccctcctgcatcttctggcgcaagtgggtcgagaacccccacggcatcatctggaaggtgagcccctgcgccgcgtgggtgccctccgccgtcatcgagctgaccatgccgagcggggaggtgcggaccttccaccccatgtccggcatccccacccaggtgttcaagggcgtcagcgtgacctacctggggtccgacatggaggtgagcggcctcaccgacctgtgcgagatggaggagctgaagtccaagaagctggccctcgccccctgcaaccaggccgggatgggcgtcgtgggcaaggtgggggagatccagtgcagcagcgaggagtccgcgcgcaccatcaagaaggacggctgcatctggaacgccgacctggtcgggatcgagctgcgggtggacgacgccgtgtgctacagcaagatcacgtccgtcgaggccgtggccaaccacagcgcgatcccgaccaccatcggcgggctccgcttcgagcggtcccacgacagccagggcaagatctccggcagccccctggacatcaccgccatccgcgggtccttcagcgtgaactaccggggcctgcgcctctccctgagcgagatcacggccacgtgcaccggggaggtcaccaacgtgtccggctgctacagctgcatgaccggggccaaggtgtccatcaagctgcacagctccaagaacagcacggcgcacgtccgctgcaagggcgacgagaccgccttctccgtgctcgagggcgtgcacagctacagcgtctccctgagcttcgaccacgccgtggtggacgagcagtgccagctgaactgcgggggccacgagtccaaggtcaccctccgggggaacctgatcttcctggacgtgcccaagttcgtggacggcagctacatgcagacctaccactccacggtccccaccggggccaacatcccgagccccaccgactggctcaacgccctgttcggcaacggcctgtcccgctggttcctcggggtgatcggcgtcctgctcgggggcctggcgctgttcttcctgatcatgagcctcttcaagctgggcaccaagcaggtcttccggtcccgcagcaagctggcctga

SEQ ID NO: 13158 - RNA, 3222 nt, synthetic construct
  misc_feature 1..3222: note = derived and/or modified CDS sequence (opt1) from SFTSV(NB39/CHN/2014)__KR698342.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccgacatcccccacctcctggggtactccgagaagatctgccagatcgaccgcctgatccacgtgagctcctggctgcggaaccacagccagttccagggctacgtggggcgccggggcggccgctcccaggtcagctactaccccgcggagaactcctacagccggtggtccgggctgctcagcccctgcgacgccgactggctgggcatgctggtggtgaagaaggccaaggggtccgacatgatcgtcccgggccccagctacaaggggaaggtgttcttcgagcgccccaccttcgacggctacgtgggctgggggtgcggctccggcaagagccggacggagtccggggagctctgcagcagcgactccggcaccagctccgggctgctgcccagcgaccgcgtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgggagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgcgtccggccgaagtgctacggcttcagccgcatgatggccacgctggaggtgaacccgcccgagcagcggatcgggcagtgcaccggctgccacctcgagtgcgtgaacgggggcgtccgcctgatcaccctgacctccgagctcaagagcgcgacggtgtgcgcctcccacttctgcagctccgccaccagcgggaagaagtccaccgagatccagttccacagcggctccctggtcggcaagaccgccatccacgtgaagggggccctggtggacggcacggagttcaccttcgaggggagctgcatgttccccgacggctgcgacgcggtcgactgcaccttctgccgggagttcctcaagaacccccagtgctaccccgccaagaagtggctgttcatcatcatcgtgatcctgctcggctacgccgggctgatgctgctcaccaacgtgctgaaggccatcggcgtctgggggtcctgggtgatcgcccccgtgaagctgatgttcgcgatcatcaagaagctcatgcgcagcgtctcctgcctgatgggcaagctgatggaccgggggcgccaggtgatccacgaggagatcggcgagaaccgggagggcaaccaggacgacgtgcgcatcgagatggcccgcccccggcgcgtccggcactggatgtacagcccggtgatcctcacgatcctggccgtggggctggccgagggctgcgacgagatggtccacgccgactccaagctcgtgagctgcaagcaggggtccggcaacatgaaggagtgcgtgaccaccgggcgcgcgctgctgcccgccgtcaaccccggccaggaggcctgcctccacttcaccgcccccggcagcccggacctgaagtgcctgaagatcaaggtgaagaagatcaacctcaagtgcaagaagtcctccagctacttcgtgcccgacgcccggtcccgctgcacgagcgtccggcgctgccggtgggcgggggactgccagtccggctgccccagccacttcacctccaacagcttctccgacgactgggccgggaagatggaccgcgccggcctggggttcagcggctgctccgacggctgcgggggcgccgcgtgcgggtgcttcaacgccgccccgagctgcatcttctggcggaagtgggtggagaacccccacggcatcatctggaaggtgtccccctgcgccgcctgggtccccagcgcggtgatcgagctgaccatgccgtccggggaggtgcgcaccttccaccccatgagcggcatccccacgcaggtcttcaagggcgtgtccgtgacctacctcgggagcgacatggaggtctccggcctgaccgacctgtgcgagatcgaggagctcaagagcaagaagctggccctggccccctgcaaccaggccgggatgggcgtggtgggcaaggtcggggagatccagtgcagctccgaggagagcgcccggaccatcaagaaggacggctgcatctggaacgcggacctggtggggatcgagctccgcgtggacgacgccgtctgctactccaagatcacgagcgtggaggccgtggccaactactccgccatcccgaccaccatcggcgggctgcggttcgagcgcagccacgactcccagggcaagatcagcggcagccccctggacatcaccgcgatccgggggagcttctccgtcaactaccgcggcctccggctgagcctgtccgagatcacggcgacctgcaccggggaggtgaccaacgtgagcggctgctactcctgcatgaccggggccaaggtcagcatcaagctccactccaacaagaacagcacggcccacgtgcgctgcaagggcgacgagaccgccttctccgtgctggagggcgtccacagctacaccgtgagcctgtccttcgaccacgccgtggtcgacgagcagtgccagctcaactgcgggggccacgagagccaggtgaccctgaaggggaacctgatcttcctcgacgtgcccaagttcgtcgacggctcctacatgcagacgtaccacagctccgtgcccaccggggccaacatcccgagccccaccgactggctgaacgccctgttcggcaacggcctctcccgctggatcctgggggtcatcggcgtgctgctcgggggcctggccctgttcttcctcatcatgagcctgttcaagctgggcaccaagcaggtcttccggtcccgcacgaagctcgcgtga

SEQ ID NO: 13159 - RNA, 3222 nt, synthetic construct
  misc_feature 1..3222: note = derived and/or modified CDS sequence (opt1) from SFTSV(QD7)__KR706566.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcggatccgcccgaagtgctacgggttcagccggatgatggccaccctggaggtcaaccagcccgagcagcgcatcggccagtgcacggggtgccacctggagtgcatcaacggcggggtgcggctcatcaccctgacctccgagctcaagagcgcgaccgtgtgcgcctcccacttctgcagctccgccacgagcggcaagaagtccaccgagatccagttccacagcggctccctcgtcgggaagaccgccatccacgtgaagggcgccctggtcgacgggaccgagttcacgttcgagggcagctgcatgttccccgacggctgcgacgcggtggactgcaccttctgccgcgagttcctgaagaacccccagtgctacccggccaagaagtggctgttcatcatcatcgtgatcctgctggggtacgccggcctcatgctgctgaccaacgtcctcaaggccatcgggatctggggctcctgggtgatcgcccccgtgaagctgatgttcgcgatcatcaagaagctgatgcggaccatgagctgcctcatggggaagctgatggaccgcggccggcaggtcatccacgaggagatcggcgagaaccgcgaggggaaccaggacgacgtgcggatcgagatggcccgcccccgccgggtgcgccactggatgtactcccccgtcatcctgacgttcctcgccatcggcctggccgagagctgcgacgagatggtgcacgccgactccaagctggcgagctgccggcaggggtccggcaacatgaaggagtgcgtgaccaccgggcgcgccctccacccggccgtcaaccccggccaggaggcctgcctgcacttcaccgcccccggcagccccgacagcaagtgcctgaagatcaaggtgaagcggatcaacctcaagtgcaagaagtccagctcctacttcgtgccggacgcgcgcagccggtgcacgtccgtccgccggtgccgctgggccggggactgccagagcggctgcccgccccacttcacctccaacagcttctccgacgactgggccgggaagatggaccgggccggcctggggttcagcggctgctccgacggctgcgggggcgcggcctgcgggtgcttcaacgccgcccccagctgcatcttctggcgcaagtgggtggagaacccccacggcatcatctggaaggtgtccccctgcgccgcgtgggtccccagcgccgtgatcgagctgaccatgccgtccggggaggtgcggaccttccaccccatgagcggcatccccacgcaggtcttcaagggcgtgtccgtgacctacctcgggagcgacatggaggtctccggcctgaccgacctgtgcgagatcgaggagctcaagagcaagaagctggccctggccccctgcaaccaggccgggatgggcgtggtgggcaaggtcggggagatccagtgcagctccgaggagagcgcgcgcaccatcaagaaggacggctgcatctggaacgccgacctggtggggatcgagctccgggtggacgacgccgtctgctactccaagatcacgagcgtggaggccgtggccaactactccgcgatcccgaccaccatcggcgggctgcgcttcgagcggagccacgactcccagggcaagatcagcggcagccccctggacatcaccgccatccgcgggagcttctccgtcaactaccggggcctccgcctgagcctgtccgagatcacggcgacctgcaccggggaggtgaccaacgtgagcggctgctactcctgcatgaccggggccaaggtcagcatcaagctccactccagcaagaactccacggcccacgtgcgctgcaagggcgacgagaccgccttcagcgtgctggagggcgtccacagctacaccgtgtccctgagcttcgaccacgccgtggtcgacgagcagtgccagctcaactgcgggggccacgagtcccaggtgaccctgaaggggaacctgatcttcctcgacgtgcccaagttcgtcgacggcagctacatgcagacgtaccactccaccgtgcccaccggggccaacatcccgagccccaccgactggctgaacgccctgttcggcaacggcctctcccggtggatcctgggggtgatcggcgtcctgctcgggggcctggcgctgttcttcatgatcatgagcctcttcaagctgggcacgaagcaggtcttccgctcccggaccaagctggcctga

SEQ ID NO: 13160 - RNA, 3222 nt, synthetic construct
  misc_feature 1..3222: note = derived and/or modified CDS sequence (opt1) from SFTSV(Rodent01/NB/CHN/2014)__KR698343.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccgacatcccccacctcctggggtactccgagaagatctgccagatcgaccgcctgatccacgtgagctcctggctgcggaaccacagccagttccagggctacgtggggcgccggggcggccgctcccaggtcagctactaccccgcggagaactcctacagccggtggtccgggctgctcagcccctgcgacgccgactggctgggcatgctggtggtgaagaaggccaaggggtccgacatgatcgtcccgggccccagctacaaggggaaggtgttcttcgagcgccccaccttcgacggctacgtgggctgggggtgcggctccggcaagagccggacggagtccggggagctctgcagcagcgactccggcaccagctccgggctgctgcccagcgaccgcgtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgggagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgcgtccggccgaagtgctacggcttcagccgcatgatggccacgctggaggtgaacccgcccgagcagcggatcgggcagtgcaccggctgccacctcgagtgcgtgaacgggggcgtccgcctgatcaccctgacctccgagctcaagagcgcgacggtgtgcgcctcccacttctgcagctccgccaccagcgggaagaagtccaccgagatccagttccacagcggctccctggtcggcaagaccgccatccacgtgaagggggccctggtggacggcacggagttcaccttcgaggggagctgcatgttccccgacggctgcgacgcggtcgactgcaccttctgccgggagttcctcaagaacccccagtgctaccccgccaagaagtggctgttcatcatcatcgtgatcctgctcggctacgccgggctgatgctgctcaccaacgtgctgaaggccatcggcgtctgggggtcctgggtgatcgcccccgtgaagctgatgttcgcgatcatcaagaagctcatgcgcagcgtctcctgcctgatgggcaagctgatggaccgggggcgccaggtgatccacgaggagatcggcgagaaccgggagggcaaccaggacgacgtgcgcatcgagatggcccgcccccggcgcgtccggcactggatgtacagcccggtgatcctcacgatcctggccgtggggctggccgagggctgcgacgagatggtccacgccgactccaagctcgtgagctgcaagcaggggtccggcaacatgaaggagtgcgtgaccaccgggcgcgcgctgctgcccgccgtcaaccccggccaggaggcctgcctccacttcaccgcccccggcagcccggacctgaagtgcctgaagatcaaggtgaagaagatcaacctcaagtgcaagaagtcctccagctacttcgtgcccgacgcccggtcccgctgcacgagcgtccggcgctgccggtgggcgggggactgccagtccggctgccccagccacttcacctccaacagcttctccgacgactgggccgggaagatggaccgcgccggcctggggttcagcggctgctccgacggctgcgggggcgccgcgtgcgggtgcttcaacgccgccccgagctgcatcttctggcggaagtgggtggagaacccccacggcatcatctggaaggtgtccccctgcgccgcctgggtccccagcgcggtgatcgagctgaccatgccgtccggggaggtgcgcaccttccaccccatgagcggcatccccacgcaggtcttcaagggcgtgtccgtgacctacctcgggagcgacatggaggtctccggcctgaccgacctgtgcgagatcgaggagctcaagagcaagaagctggccctggccccctgcaaccaggccgggatgggcgtggtgggcaaggtcggggagatccagtgcagctccgaggagagcgcccggaccatcaagaaggacggctgcatctggaacgcggacctggtggggatcgagctccgcgtggacgacgccgtctgctactccaagatcacgagcgtggaggccgtggccaactactccgccatcccgaccaccatcggcgggctgcggttcgagcgcagccacgactcccagggcaagatcagcggcagccccctggacatcaccgcgatccgggggagcttctccgtcaactaccgcggcctccggctgagcctgtccgagatcacggcgacctgcaccggggaggtgaccaacgtgagcggctgctactcctgcatgatcggggccaaggtcagcatcaagctccactccaacaagaacagcaccgcccacgtgcgctgcaagggcgacgagacggccttctccgtgctggagggcgtccacagctacaccgtgagcctgtccttcgaccacgccgtggtcgacgagcagtgccagctcaactgcgggggccacgagagccaggtgaccctgaaggggaacctgatcttcctcgacgtgcccaagttcgtcgacggctcctacatgcagacctaccacagctccgtgcccacgggggccaacatcccgagccccaccgactggctgaacgccctgttcggcaacggcctctcccgctggatcctgggggtcatcggcgtgctgctcgggggcctggccctgttcttcctcatcatgagcctgttcaagctgggcaccaagcaggtcttccggtcccgcaccaagctcgcgtga

SEQ ID NO: 13161 - RNA, 3222 nt, synthetic construct
  misc_feature 1..3222: note = derived and/or modified CDS sequence (opt1) from SFTSV(SDLZtick12/2010)__JQ684872.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcggatccgcccgaagtgctacgggttcagccggatgatggccaccctggaggtcaaccagcccgagcagcgcatcggccagtgcacggggtgccacctggagtgcatcaacggcggggtgcggctcatcaccctgacctccgagctcaagagcgcgaccgtgtgcgcctcccacttctgcagctccgccacgagcggcaagaagtccaccgagatccagttccacagcggctccctcgtcgggaagaccgccatccacgtgaagggcgccctggtcgacgggaccgagttcacgttcgagggcagctgcatgttccccgacggctgcgacgcggtggactgcaccttctgccgcgagttcctgaagaacccccagtgctacccggccaagaagtggctgttcatcatcatcgtgatcctgctggggtacgccggcctcatgctgctgaccaacgtcctcaaggccatcgggatctggggctcctgggtgatcgcccccgtgaagctgatgttcgcgatcatcaagaagctgatgcggaccgtcagctgcctcatggggaagctgatggaccgcggccgccaggtgatccacgaggagatcggcgagaaccgggaggggaaccaggacgacgtgcggatcgagatggcccgcccccgccgggtccgccactggatgtactcccccgtgatcctgacgttcctcgccatcggcctggccgagagctgcgacgagatggtgcacgccgactccaagctggtcagctgccggcaggggtccggcaacatgaaggagtgcgtgaccaccgggcgcgcgctcctgccggccgtgaaccccggccaggaggcctgcctgcacttcaccgcccccggcagccccgacagcaagtgcctcaagatcaaggtcaagcggatcaacctgaagtgcaagaagtccagctcctacttcgtgccggacgcccgcagccggtgcacgtccgtgcgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtcgagaacccccacggcatcatctggaaggtgtccccctgcgccgcctgggtgcccagcgcggtcatcgagctcaccatgccgtccggggaggtgcggaccttccaccccatgagcggcatccccacccaggtgttcaagggcgtctccgtgacctacctggggagcgacatggaggtgtccggcctgaccgacctctgcgagatcgaggagctcaagagcaagaagctggccctggccccctgcaaccaggccgggatgggcgtcgtgggcaaggtgggggagatccagtgcagctccgaggagagcgcccgcaccatcaagaaggacggctgcatctggaacgcggacctggtcgggatcgagctgcgggtggacgacgccgtgtgctactccaagatcacgagcgtcgaggccgtggccaactactccgccatcccgaccaccatcggcgggctgcgcttcgagcggagccacgactcccagggcaagatcagcggcagccccctcgacatcaccgcgatccgcgggagcttctccgtgaactaccggggcctgcgcctgagcctctccgagatcacggccacgtgcaccggggaggtcaccaacgtgagcggctgctactcctgcatgaccggggccaaggtgagcatcaagctgcactccagcaagaactccacggcccacgtccgctgcaagggcgacgagaccgcgttcagcgtgctggagggcgtgcacagctacaccgtctccctcagcttcgaccacgccgtggtggacgagcagtgccagctgaactgcgggggccacgagtcccaggtcaccctgaaggggaacctcatcttcctggacgtgcccaagttcgtggacggcagctacatgcagacgtaccactccaccgtccccaccggggccaacatcccgagccccaccgactggctgaacgccctcttcggcaacggcctgtcccggtggatcctgggggtgatcggcgtgctcctcgggggcctggccctgttcttcatgatcatgagcctgttcaagctgggcacgaagcaggtcttccgctcccggaccaagctcgcgtga

SEQ ID NO: 13162 - RNA, 3222 nt, synthetic construct
  misc_feature 1..3222: note = derived and/or modified CDS sequence (opt1) from SFTSV(Zhao)__KF374684.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctggtcaccctgacctccgagctcaagagcgcgacggtgtgcgcctcccacttctgcagctccgccaccagcgggaagaagtccaccgagatccagttccacagcggctccctggtcggcaaggccgccatccacgtgaagggggcgctggtggacggcaccgagttcacgttcgaggggagctgcatgttccccgacggctgcgacgccgtcgactgcaccttctgccgcgagttcctcaagaacccccagtgctaccccgccaagaagtggctgttcatcatcatcgtgatcctgctcggctacgccgggctgatgctgctcaccaacgtgctgaaggccatcggcgtctgggggtcctgggtgatcgcgcccgtgaagctgatgttcgccatcatcaagaagctcatgcggagcgtctcctgcctgatgggcaagctgatggaccgcgggcgccaggtgatccacgaggagatcggcgagaaccgggagggcaaccaggacgacgtgcggatcgagatggtccgcccccgccgggtgcgccactggatgtacagcccggtgatcctcaccatcctggccatcgggctgacggagggctgcgacgagatggtccacgccgactccaagctcgtgagctgccggcaggggtccggcaacatgaaggagtgcgtgaccaccgggcgcgccctgctgcccgcggtcaaccccggccaggaggcctgcctccacttcaccgcccccggcagcccggacagcaagtgcctgaagatcaaggtgaagcggatcaacctgaagtgcaagaagtccagctcctacttcgtgcccgacgcccgcagccggtgcacgtccgtccgccggtgccgctgggccggggactgccagagcggctgcccctcccacttcaccagcaactccttcagcgacgactgggcggggaagatggaccgggccggcctcgggttctccggctgcagcgacggctgcgggggcgccgcctgcgggtgcttcaacgcggccccgtcctgcatcttctggcgcaagtgggtggagaacccccacggcatcatctggaaggtgagcccctgcgccgcctgggtcccctccgccgtgatcgagctgaccatgccgagcggggaggtgcggaccttccaccccatgtccggcatccccacgcaggtcttcaagggcgtgagcgtgacctacctggggtccgacatggaggtcagcggcctcaccgacctgtgcgagatcgaggagctcaagagcaagaagctggcgctggccccctgcaaccaggccgggatgggcgtggtgggcaaggtcggggagatccagtgctccagcgaggagtccgcccgcaccatcaagaaggacggctgcatctggaacgccgacctggtggggatcgagctgcgggtggacgacgcggtctgctacagcaagatcacgtccgtggaggccgtggccaactacagcgccatcccgaccaccatcggcgggctccgcttcgagcggtcccacgacagccagggcaaggtctccggcagccccctggacatcaccgccatccgcgggtccttcagcgtgaactaccggggcctgcgcctctccctgagcgagatcacggcgacctgcaccggggaggtgaccaacgtctccggctgctacagctgcatgaccggggccaaggtgtccatcaagctgcacagctccaagaacagcacggcccacgtgcgctgcaagggcgacgagaccgccttcagcgtcctcgagggcgtgcactcctacaccgtgagcctgtccttcgaccacgcggtcgtggacgagcagtgccagctgaactgcgggggccacgagagccaggtgaccctcaaggggaacctgatcttcctggacgtccccaagttcgtggacggctcctacatgcagacgtaccacagctccgtccccaccggggccaacatcccgagccccaccgactggctcaacgccctgttcggcaacggcctgtcccggtggatcctcggggtgatcggcgtgctgctcgggggcctggccctgttcttcctgatcatgagcctcttcaagctgggcaccaagcaggtcttccgctcccggacgaagctggcctga

SEQ ID NO: 13163 - RNA, 3222 nt, synthetic construct
  misc_feature 1..3222: note = derived and/or modified CDS sequence (opt1) from SFTSV(Zhejiang/01/2011)__KJ597824.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctggtcaccctgacctccgagctcaagagcgcgacggtgtgcgcctcccacttctgcagctccgccaccagcgggaagaagtccaccgagatccagttccacagcggctccctggtcggcaaggccgccatccacgtgaagggggcgctggtggacggcaccgagttcacgttcgaggggagctgcatgttccccgacggctgcgacgccgtcgactgcaccttctgccgcgagttcctcaagaacccccagtgctaccccgccaagaagtggctgttcatcatcatcgtgatcctgctcggctacgccgggctgatgctgctcaccaacgtgctgaaggccatcggcgtctgggggtcctgggtgatcgcgcccgtgaagctgatgttcgccatcatcaagaagctcatgcggagcgtctcctgcctgatgggcaagctgatggaccgcgggcgccaggtgatccacgaggagatcggcgagaaccgggagggcaaccaggacgacgtgcggatcgagatggtccgcccccgccgggtgcgccactggatgtacagcccggtgatcctcaccatcctggccatcgggctgacggagggctgcgacgagatggtccacgccgactccaagctcgtgagctgccggcaggggtccggcaacatgaaggagtgcgtgaccaccgggcgcgccctgctgcccgcggtcaaccccggccaggaggcctgcctccacttcaccgcccccggcagcccggacagcaagtgcctgaagatcaaggtgaagcggatcaacctgaagtgcaagaagtccagctcctacttcgtgcccgacgcccgcagccggtgcacgtccgtccgccggtgccgctgggccggggactgccagagcggctgcccctcccacttcaccagcaactccttcagcgacgactgggcggggaagatggaccgggccggcctcgggttctccggctgcagcgacggctgcgggggcgccgcctgcgggtgcttcaacgcggccccgtcctgcatcttctggcgcaagtgggtggagaacccccacggcatcatctggaaggtgagcccctgcgccgcctgggtcccctccgccgtgatcgagctgaccatgccgagcggggaggtgcggaccttccaccccatgtccggcatccccacgcaggtcttcaagggcgtgagcgtgacctacctggggtccgacatggaggtcagcggcctcaccgacctgtgcgagatcgaggagctcaagagcaagaagctggcgctggccccctgcaaccaggccgggatgggcgtggtgggcaaggtcggggagatccagtgctccagcgaggagtccgcccgcaccatcaagaaggacggctgcatctggaacgccgacctggtggggatcgagctgcgggtggacgacgcggtctgctacagcaagatcacgtccgtggaggccgtggccaactacagcgccatcccgaccaccatcggcgggctccgcttcgagcggtcccacgacagccagggcaagatctccggcagccccctggacatcaccgccatccgcgggtccttcagcgtcaactaccggggcctgcgcctctccctgagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttcagcgtgctcgagggcgtccactcctacaccgtgagcctgtccttcgaccacgcggtggtcgacgagcagtgccagctgaactgcgggggccacgagagccaggtgaccctcaaggggaacctgatcttcctggacgtgcccaagttcgtcgacggctcctacatgcagacgtaccacagctccgtgcccaccggggccaacatcccgagccccaccgactggctcaacgccctgttcggcaacggcctgtcccggtggatcctcggggtcatcggcgtgctgctcgggggcctggccctgttcttcctgatcatgagcctcttcaagctgggcaccaagcaggtcttccgctcccggacgaagctggcctga

SEQ ID NO: 13164 - RNA, 3222 nt, synthetic construct
  misc_feature 1..3222: note = derived and/or modified CDS sequence (opt1) from SFTSV(ZJ2013-06)__KP280204.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccgacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcgtgaacgggggcgtccggctgatcaccctgacctccgagctcaagagcgcgacggtgtgcgcctcccacttctgcagctccgccaccagcgggaagaagtccaccgagatccagttccacagcggctccctggtcggcaagaccgccatccacgtgaagggggccctggtggacggcacggagttcaccttcgaggggagctgcatgttccccgacggctgcgacgcggtcgactgcaccttctgccgcgagttcctcaagaacccccagtgctaccccgccaagaagtggctgttcatcaacatcgtgatcctgctcggctacgccgggctgatgctgctcaccaacgtgctgaaggccatcggcgtctgggggtcctgggtgatcgcccccgtgaagctgatgttcgcgatcatcaagaagctcatgcggagcgtctcctgcctgatgggcaagctgatggaccgcgggcgccaggtgatccacgaggagatcggcgagaaccgggagggcaaccaggacgacgtgcggatcgagatggcccgcccccgccgggtccgccactggatgtacagcccggtgatcctcacgatcctggccgtggggctggccgagggctgcgacgagatggtccacgccgactccaagctcgtgagctgcaagcaggggtccggcaacatgaaggagtgcgtgaccaccgggcgggcgctgctgcccgccgtcaaccccggccaggaggcctgcctccacttcaccgcccccggcagcccggacagcaagtgcctgaagatcaaggtgaagaagatcaacctgaagtgcaagaagtccagctcctacttcgtgcccgacgcccgcagccggtgcacgtccgtccgccggtgccgctgggcgggggactgccagagcggctgcccctcccacttcaccagcaactccttcagcgacgactgggccgggaagatggaccgggccggcctcgggttctccggctgcagcgacggctgcgggggcgccgcgtgcgggtgcttcaacgccgccccgtcctgcatcttctggcgcaagtgggtggagaacccccacggcatcatctggaaggtgagcccctgcgccgcctgggtcccctccgcggtgatcgagctgaccatgccgagcggggaggtgcggaccttccaccccatgtccggcatccccacgcaggtcttcaagggcgtgagcgtgacctacctggggtccgacatggaggtcagcggcctcaccgacctgtgcgagatcgaggagctcaagagcaagaagctggccctggccccctgcaaccaggccgggatgggcgtggtgggcaaggtcggggagatccagtgctccagcgaggagtccgcccgcaccatcaagaaggacggctgcatctggaacgcggacctggtggggatcgagctgcgggtggacgacgccgtctgctacagcaagatcacgtccgtggaggccgtggccaactacagcgccatcccgaccaccatcggcgggctccgcttcgagcggtcccacgacagccagggcaagatctccggcagccccctggacatcaccgcgatccgcgggtccttcagcgtcaactaccggggcctgcgcctctccctgagcgagatcacggcgacctgcaccggggaggtgaccaacgtgtccggctgctacagctgcatgaccggggccaaggtctccatcaagctgcacagcaacaagaactccacggcccacgtgcggtgcaagggcgacgagaccgccttcagcgtgctcgagggcgtccacagctacaccgtgtccctgagcttcgaccacgccgtggtcgacgagcagtgccagctgaactgcgggggccacgagtcccaggtgaccctcaaggggaacctgatcttcctggacgtgcccaagttcgtcgacggcagctacatgcagacgtaccactccagcgtgcccaccggggccaacatcccgtcccccaccgactggctcaacgccctgttcggcaacggcctgagccgctggatcctcggggtcatcggcgtgctgctcgggggcctggccctgttcttcctgatcatgtccctcttcaagctgggcaccaagcaggtcttccgcagccggacgaagctggcgtga

SEQ ID NO: 13165 - RNA, 3222 nt, synthetic construct
  misc_feature 1..3222: note = derived and/or modified CDS sequence (opt1) from SFTSV(ZJZHSH-AM/China/05/2012)__KR017846.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatccagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaaggccgccatccacgtcaagggggcgctggtggacggcaccgagttcacgttcgaggggagctgcatgttccccgacggctgcgacgccgtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcgcccgtgaagctgatgttcgccatcatcaagaagctcatgcggagcgtgtcctgcctgatgggcaagctgatggaccgcgggcggcaggtcatccacgaggagatcggcgagaaccgcgagggcaaccaggacgacgtgcggatcgagatggtgcgcccccgccgggtccgccactggatgtacagcccggtgatcctcaccatcctggccatcgggctgacggagggctgcgacgagatggtgcacgccgactccaagctcgtcagctgccggcaggggtccggcaacatgaaggagtgcgtgaccaccgggcgcgccctgctgcccgcggtgaaccccggccaggaggcctgcctccacttcaccgcccccggcagcccggacagcaagtgcctgaagatcaaggtcaagcggatcaacctgaagtgcaagaagtccagctcctacttcgtgcccgacgcccgcagccggtgcacgtccgtgcgccggtgccgctgggccggggactgccagagcggctgcccctcccacttcaccagcaactccttcagcgacgactgggcggggaagatggaccgggccggcctcgggttctccggctgcagcgacggctgcgggggcgccgcctgcgggtgcttcaacgcggccccgtcctgcatcttctggcgcaagtgggtcgagaacccccacggcatcatctggaaggtgagcccctgcgccgcctgggtgccctccgccgtcatcgagctgaccatgccgagcggggaggtgcggaccttccaccccatgtccggcatccccacccaggtgttcaagggcgtcagcgtgacgtacctggggtccgacatggaggtgagcggcctcaccgacctgtgcgagatcgaggagctcaagagcaagaagctggcgctggccccctgcaaccaggccgggatgggcgtcgtgggcaaggtgggggagatccagtgctccagcgaggagtccgcccgcaccatcaagaaggacggctgcatctggaacgccgacctggtcgggatcgagctgcgggtggacgacgcggtgtgctacagcaagatcacgtccgtcgaggccgtggccaactacagcgccatcccgaccaccatcggcgggctccgcttcgagcggtcccacgacagccagggcaagatctccggcagccccctggacatcaccgccatccgcgggtccttcagcgtgaactaccggggcctgcgcctctccctgagcgagatcacggcgacctgcaccggggaggtcaccaacgtgtccggctgctacagctgcatgaccggggccaaggtgtccatcaagctgcacagctccaagaacagcacggcccacgtccgctgcaagggcgacgagaccgccttcagcgtgctcgagggcgtgcactcctacaccgtcagcctgtccttcgaccacgcggtggtggacgagcagtgccagctgaactgcgggggccacgagagccaggtcaccctcaaggggaacctgatcttcctggacgtgcccaagttcgtggacggctcctacatgcagacgtaccacagctccgtccccaccggggccaacatcccgagccccaccgactggctcaacgccctgttcggcaacggcctgtcccggtggatcctcggggtgatcggcgtcctgctcgggggcctggccctgttcttcctgatcatgagcctcttcaagctgggcaccaagcaggtcttccgctcccggacgaagctggcctga

SEQ ID NO: 13166 - RNA, 3222 nt, synthetic construct
  misc_feature 1..3222: note = derived and/or modified CDS sequence (opt1) from SFTSV(ZJZHSH-CXD/China/05/2012)__KR017858.1__GP
  source 1..3222: mol_type = other RNA
atgatgaaggtgatctggttcagctccctgatctgcctcgtgatccagtgcggcggggacaccggccccatcatctgcgccgggccgatccacagcaacaagtccgccggcatcccccacctcctggggtacagcgagaagatctgccagatcgaccgcctgatccacgtgtccagctggctgcggaaccactcccagttccagggctacgtgggccagcgcgggggccggagccaggtctcctactaccccgcggagaacagctactcccgctggagcgggctgctctccccctgcgacgccgactggctgggcatgctggtggtgaagaaggccaaggggagcgacatgatcgtcccgggcccctcctacaagggcaaggtgttcttcgagcggcccaccttcgacgggtacgtgggctgggggtgcggcagcggcaagtcccgcacggagagcggggagctctgctccagcgacagcggcacctccagcgggctgctgccctccgaccgggtcctctggatcggcgacgtggcctgccagccgatgacccccatccccgaggagaccttcctggagctcaagagcttctcccagagcgagttccccgacgtgtgcaagatcgacgggatcgtcttcaaccagtgcgagggcgagtccctgccgcagcccttcgacgtggcctggatggacgtgggccacagccacaagatcatcatgcgcgagcacaagacgaagtgggtccaggagtccagctccaaggacttcgtgtgctacaaggaggggaccggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtccacaagcccggcgaggtggtggtcagctacgggggcatgcgggtgcgcccgaagtgctacgggttctcccggatgatggccacgctggaggtgaacccgcccgagcagcgcatcggccagtgcaccgggtgccacctcgagtgcatcaacggcggcgtccggctgatcaccctgaccagcgagctcaagagcgcgacggtgtgcgcctcccacttctgcagctccgccaccagcgggaagaagtccaccgagatccagttccacagcggctccctggtcgggaagaccgccatccacgtgaagggcgccctggtggacggcacggagttcaccttcgaggggagctgcatgttccccgacggctgcgacgcggtcgactgcaccttctgccgcgagttcctcaagaacccccagtgctaccccgccaagaagtggctgttcatcatcatcgtgatcctgctcgggtacgccggcctgatgctgctcaccaacgtgctgaaggccatcggggtctggggctcctgggtgatcgcccccgtgaagctggtcttcgcgatcatcaagaagctcatgcgggccgtgagctgcctgatgggcaagctgatggaccgcgggcgccaggtgatccacgaggagatcggcgagaaccgggaggggaaccagaacgacgtccggatcgagatggcccgcccccgccgggtgcgccactggatgtactccccggtgatcctcacgatcctggccatcggcttcgccgaggggtgcgacgagatggtccacgcggacagcaagctggtgtcctgccggcagggcagcgagaacatgaaggagtgcgtgaccaccggccgcgccctcctgcccgccgtcaaccccgggcaggaggcctgcctgcacttcaccgcccccggctccccggacagcaagtgcctcaagatcaaggtgaagcggatcaacctgaagtgcaagaagtccagcagctacttcgtgcccgacgcgcgctcccggtgcacgagcgtccgccggtgccgctgggccggggactgccagtccggctgcccgccccacttcaccagcaactccttcagcgacgactgggccgggaagatggaccgggccggcctgggcttctccgggtgcagcgacggctgcgggggcgcggcctgcgggtgcttcaacgccgccccctcctgcatcttctggcgcaagtgggtggagaacccccacggcatcatctggaaggtgagcccctgcgccgcgtgggtcccgtccgccgtgatcgagctcaccatgcccagcggcgaggtgcggaccttccaccccatgtccgggatccccacgcaggtcttcaagggcgtgagcgtgacctacctggggtccgacatggaggtcagcggcctgaccgacctctgcgagatcgaggagctgaagtccaagaagctggccctggccccgtgcaaccaggccggcatgggggtggtgggcaaggtcggggagatccagtgcagctccgaggagagcgcgcgcaccatcaagaaggacggctgcatctggaacgccgacctcgtggggatcgagctgcgggtggacgacgccgtctgctacagcaagatcacgtccgtggaggccgtggccaactacagcgcgatccccaccaccatcggcggcctgcgcttcgagcggtcccacgacagccaggggaagatctccggcagccccctcgacatcaccgccatccgcgggtccttcagcgtcaactaccggggcctgcgcctgtccctcagcgagatcacggcgacctgcaccggggaggtgaccaacgtgtccggctgctacagctgcatgaccggcgccaaggtctccatcaagctgcacagctccaagaacagcacggcgcacgtgcgctgcaagggggacgagaccgccttctccgtgctggagggcgtccacagctactccgtgagcctcagcttcgaccacgccgtggtcgacgagcagtgccagctgaactgcgggggccacgagtcccaggtgaccctgcgggggaacctcatcttcctggacgtgcccaagttcgtcgacggcagctacatgcagacctaccactccacggtgccgaccggcgccaacatccccagccccaccgactggctgaacgccctcttcgggaacggcctgtcccgctggatcctgggggtcatcggcgtgctcctgggcgggctggccctcttcttcctgatcatgagcctgttcaagctcggcaccaagcaggtcttccggtcccgcacgaagctggcctga

SEQ ID NO: 13167 - RNA, 3222 nt, synthetic construct
  misc_feature 1..3222: note = derived and/or modified CDS sequence (opt1) from SFTSV(ZJZHSH-FDE/China/06/2012)__KR017859.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaaggccgccatccacgtcaagggggcgctggtggacggcaccgagttcacgttcgaggggagctgcatgttccccgacggctgcgacgccgtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcgcccgtgaagctgatgttcgccatcatcaagaagctcatgcggagcgtgtcctgcctgatgggcaagctgatggaccgcgggcggcaggtcatccacgaggagatcggcgagaaccgcgagggcaaccaggacgacgtgcggatcgagatggtgcgcccccgccgggtccgccactggatgtacagcccggtgatcctcaccatcctggccatcgggctgacggagggctgcgacgagatggtgcacgccgactccaagctcgtcagctgccggcaggggtccggcaacatgaaggagtgcgtgaccaccgggcgcgccctgctgcccgcggtgaaccccggccaggaggcctgcctccacttcaccgcccccggcagcccggacagcaagtgcctgaagatcaaggtcaagcggatcaacctgaagtgcaagaagtccagctcctacttcgtgcccgacgcccgcagccggtgcacgtccgtgcgccggtgccgctgggccggggactgccagagcggctgcccctcccacttcaccagcaactccttcagcgacgactgggcggggaagatggaccgggccggcctcgggttctccggctgcagcgacggctgcgggggcgccgcctgcgggtgcttcaacgcggccccgtcctgcatcttctggcgcaagtgggtcgagaacccccacggcatcatctggaaggtgagcccctgcgccgcctgggtgccctccgccgtcatcgagctgaccatgccgagcggggaggtgcggaccttccaccccatgtccggcatccccacccaggtgttcaagggcgtcagcgtgacgtacctggggtccgacatggaggtgagcggcctcaccgacctgtgcgagatcgaggagctcaagagcaagaagctggcgctggccccctgcaaccaggccgggatgggcgtcgtgggcaaggtgggggagatccagtgctccagcgaggagtccgcccgcaccatcaagaaggacggctgcatctggaacgccgacctggtcgggatcgagctgcgggtggacgacgcggtgtgctacagcaagatcacgtccgtcgaggccgtggccaactacagcgccatcccgaccaccatcggcgggctccgcttcgagcggtcccacgacagccagggcaagatctccggcagccccctggacatcaccgccatccgcgggtccttcagcgtgaactaccggggcctgcgcctctccctgagcgagatcacggcgacctgcaccggggaggtcaccaacgtgtccggctgctacagctgcatgaccggggccaaggtgtccatcaagctgcacagctccaagaacagcacggcccacgtccgctgcaagggcgacgagaccgccttcagcgtgctcgagggcgtgcactcctacaccgtcagcctgtccttcgaccacgcggtggtggacgagcagtgccagctgaactgcgggggccacgagagccaggtcaccctcaaggggaacctgatcttcctggacgtgcccaagttcgtggacggctcctacatgcagacgtaccacagctccgtccccaccggggccaacatcccgagccccaccgactggctcaacgccctgttcggcaacggcctgtcccggtggatcctcggggtgatcggcgtcctgctcgggggcctggccctgttcttcctgatcatgagcctcttcaagctgggcaccaagcaggtcttccgctcccggacgaagctggcctga

SEQ ID NO: 13168 - RNA, 3222 nt, synthetic construct
  misc_feature 1..3222: note = derived and/or modified CDS sequence (opt1) from SFTSV(ZJZHSH-FZHR/China/07/2013)__KR017862.1__GP
  source 1..3222: mol_type = other RNA
atgatgaaggtgatctggttcagctccctgatctgcctcgtgatccagtgcggcggggacaccggccccatcatctgcgccgggccgatccacagcaacaagcgcgccggcatcccccacctcctggggtactccgagaagatctgccagatcgaccggctgatccacgtgagctcctggctgcgcaaccacagccagttccagggctacgtgggccagcgcgggggccggtcccaggtcagctactaccccgcggagaactcctacagccggtggtccgggctgctcagcccctgcgacgccgactggctgggcatgctggtggtgaagaaggccaaggggtccgacatgatcgtcccgggccccagctacaagggcaaggtgttcttcgagcgccccaccttcgacgggtacgtgggctgggggtgcggctccggcaagagccggacggagtccggggagctctgcagctccgacagcggcaccagctccgggctgctgcccagcgaccgcgtcctctggatcggcgacgtggcctgccagccgatgacccccatccccgaggagaccttcctggagctgaagtccttcagccagtccgagttccccgacgtgtgcaagatcgacgggatcgtcttcaaccagtgcgagggcgagagcctcccgcagcccttcgacgtggcctggatggacgtgggccactcccacaagatcatcatgcgggagcacaagacgaagtgggtccaggagagctccagcaaggacttcgtgtgctacaaggaggggaccggcccctgctccgagagcgaggagaagacctgcaagacctccgggagctgccgcggcgacatgcagttctgcaaggtggcggggtgcgagcacggcgaggaggcctccgaggccaagtgccggtgcagcctggtccacaagcccggcgaggtggtggtctcctacgggggcatgcgcgtgcggccgaagtgctacgggttcagccgcatgatggccacgctggaggtgaacccgcccgagcagcggatcggccagtgcaccgggtgccacctcgagtgcatcaacggcggcgtccgcctgatcaccctgacctccgagctcaagagcgcgacggtgtgcgccagccacttctgctccagcgccacctccgggaagaagtccaccgagatccagttccactccggcagcctggtcgggaagaccgccatccacgtgaagggcgccctggtggacggcacggagttcaccttcgaggggtcctgcatgttccccgacggctgcgacgcggtcgactgcaccttctgccgggagttcctcaagaacccccagtgctaccccgccaagaagtggctgttcatcatcatcgtgatcctgctcgggtacgccggcctgatgctgctcaccaacgtgctgaaggccatcggggtctggggcagctgggtgatcgcccccgtgaagctggtcttcgcgatcatcaagaagctcatgcgcgccgtgtcctgcctgatgggcaagctgatggaccgggggcgccaggtgatccacgaggagatcggcgagaaccgggaggggaaccaggacgacgtccgcatcgagatggcccgcccccggcgcgtgcggcactggatgtacagcccggtgatcctcacgatcctggccatcggcctggccgaggggtgcgacgagatggtccacgcggactccaagctcgtgagctgccgccagggctccggcaacatgaaggagtgcgtgaccaccgggcgggccctgctgcccgccgtcaaccccggccaggaggcctgcctccacttcaccgcccccgggagcccggactccaagtgcctgaagatcaaggtgaagcgcatcaacctgaagtgcaagaagtccagcagctacttcgtgcccgacgcgcggagccgctgcacgtccgtccggcgctgccggtgggccggcgactgccagagcgggtgcccgccccacttcacctccaacagcttctccgacgactgggccggcaagatggaccgcgccggcctcgggttcagcggctgctccgacgggtgcggcggggcggcctgcggctgcttcaacgccgcccccagctgcatcttctggcggaagtgggtggagaacccccacggcatcatctggaaggtgtccccctgcgccgcgtgggtcccgagcgccgtgatcgagctgaccatgccctccggggaggtgcgcaccttccaccccatgagcggcatccccacgcaggtcttcaagggggtgtccgtgacctacctgggcagcgacatggaggtctccggcctcaccgacctgtgcgagatcgaggagctcaagagcaagaagctggccctggccccgtgcaaccaggccgggatgggcgtggtggggaaggtcggcgagatccagtgctccagcgaggagtccgcgcggaccatcaagaaggacgggtgcatctggaacgccgacctggtgggcatcgagctgcgcgtggacgacgccgtctgctacagcaagatcacgagcgtggaggccgtggccaactactccgcgatccccaccaccatcggcgggctccggttcgagcgcagccacgactcccagggcaagatcagcgggagccccctggacatcaccgccatccggggcagcttctccgtcaactaccgcgggctgcgcctcagcctgtccgagatcacggcgacctgcaccggcgaggtgaccaacgtgagcggctgctactcctgcatgaccggggccaaggtcagcatcaagctgcactccagcaagaactccacggcccacgtgcggtgcaagggcgacgagaccgccttcagcgtgctcgagggggtccactcctacagcgtgtccctgagcttcgaccacgccgtggtcgacgagcagtgccagctgaactgcggcgggcacgagagccaggtgaccctccgcggcaacctgatcttcctggacgtgcccaagttcgtcgacggctcctacatgcagacctaccacagcacggtgccgaccggggccaacatcccctcccccaccgactggctcaacgccctgttcggcaacgggctgagccggtggatcctcggcgtcatcggcgtgctgctcgggggcctggcgctgttcttcctgatcatgtccctcttcaagctggggaccaagcaggtcttccgcagccggacgaagctggcctga

SEQ ID NO: 13169 - RNA, 3222 nt, synthetic construct
  misc_feature 1..3222: note = derived and/or modified CDS sequence (opt1) from SFTSV(ZJZHSH-HCY/China/06/2012)__KR017855.1__GP
  source 1..3222: mol_type = other RNA
atgatgaaggtgatctggttccccagcctgatctgcctcgtgatccagtgctccggcgacaccgggccgatcatctgcgccggccccatccacagcaacaagtccgccaacatcccccacctcctggggtacagcgagaagatctgccagatcgaccgcctgatccacgtgtccagctggctgcggaaccactcccagttccagggctacgtggggcagcgcggcggccggagccaggtctcctactaccccgcggagaacagctactcccgctggagcgggctgctctccccgtgcgacgccgactggctgggcatgctggtggtgaagaaggccaaggggagcgacatgatcgtccccggcccctcctacaaggggaaggtgttcttcgagcggcccaccttcgacggctacgtgggctgggggtgcggcagcgggaagtcccgcacggagagcggcgagctctgctccagcgacagcggcacctccagcgggctgctgccgtccgaccgggtcctctggatcggcgacgtggcctgccagcccatgacccccatccccgaggagaccttcctggagctcaagagcttctcccagagcgagttcccggacatctgcaagatcgacgggatcgtgttcaaccagtgcgagtccgagagcctgccccagcccttcgacgtcgcctggatggacgtgggccactcccacaagatcatcatgcgcgagcacaagacgaagtgggtgcaggagagctccagcaaggacttcgtctgctacaaggaggggaccggcccctgctccgagagcgaggagaagacctgcaagacctccggcagctgccgcggggacatgcagttctgcaaggtggcgggctgcgagcacggggaggaggcctccgaggccaagtgccggtgcagcctggtgcacaagccgggcgaggtcgtggtgtcctacgggggcatgcgggtccgccccaagtgctacggcttcagccggatgatggccacgctggaggtgaacccgcccgagcagcgcatcgggcagtgcaccggctgccacctcgagtgcatcaacgggggcgtgcggctggtcaccctgaccagcgagctcaagtccgcgacggtgtgcgccagccacttctgctccagcgccacctccgggaagaagtccaccgagatccagttccactccggcagcctggtcggcaaggccgccatccacgtgaagggggcgctggtggacggcaccgagttcacgttcgaggggtcctgcatgttccccgacggctgcgacgccgtcgactgcaccttctgccgcgagttcctcaagaacccccagtgctaccccgccaagaagtggctgttcatcatcatcgtgatcctgctcggctacgccgggctgatgctgctcaccaacgtgctgaaggccatcggcgtctgggggagctgggtgatcgcgcccgtgaagctgatgttcgccatcatcaagaagctcatgcggtccgtcagctgcctgatgggcaagctgatggaccgcgggcgccaggtgatccacgaggagatcggcgagaaccgggagggcaaccaggacgacgtgcggatcgagatggtccgcccgcgccgggtgcgccactggatgtactcccccgtgatcctcaccatcctggccatcgggctgacggagggctgcgacgagatggtccacgccgacagcaagctcgtgtcctgccggcaggggagcggcaacatgaaggagtgcgtgaccaccgggcgcgccctgctgcccgcggtcaaccccggccaggaggcctgcctccacttcaccgccccgggctcccccgacagcaagtgcctgaagatcaaggtgaagcggatcaacctgaagtgcaagaagtccagcagctacttcgtgcccgacgcccgctcccggtgcacgagcgtccgccggtgccgctgggccggggactgccagtccggctgcccgagccacttcacctccaacagcttctccgacgactgggcggggaagatggaccgggccggcctcgggttcagcggctgctccgacggctgcgggggcgccgcctgcgggtgcttcaacgcggcccccagctgcatcttctggcgcaagtgggtggagaacccccacggcatcatctggaaggtgtccccctgcgccgcctgggtcccgagcgccgtgatcgagctgaccatgccctccggggaggtgcggaccttccaccccatgagcggcatccccacgcaggtcttcaagggcgtgtccgtgacctacctggggagcgacatggaggtctccggcctcaccgacctgtgcgagatcgaggagctcaagagcaagaagctggcgctggccccgtgcaaccaggccgggatgggcgtggtgggcaaggtcggggagatccagtgcagctccgaggagagcgcccgcaccatcaagaaggacggctgcatctggaacgccgacctggtggggatcgagctgcgggtggacgacgcggtctgctactccaagatcacgagcgtggaggccgtggccaactactccgccatccccaccaccatcggcgggctccgcttcgagcggagccacgactcccagggcaagatcagcggcagccccctggacatcaccgccatccgcgggagcttctccgtcaactaccggggcctgcgcctcagcctgtccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctcgagggcgtccacagctacaccgtgtccctgagcttcgaccacgcggtggtcgacgagcagtgccagctgaactgcgggggccacgagtcccaggtgaccctcaaggggaacctgatcttcctggacgtgcccaagttcgtcgacggcagctacatgcagacgtaccactccagcgtgccgaccggggccaacatcccctcccccaccgactggctcaacgccctgttcggcaacggcctgagccggtggatcctcggggtcatcggcgtgctgctcgggggcctggccctgttcttcctgttcatgtccctcttcaagctgggcaccaagcaggtcttccgcagccggacgaagctggcctga

SEQ ID NO: 13170 - RNA, 3222 nt, synthetic construct
  misc_feature 1..3222: note = derived and/or modified CDS sequence (opt1) from SFTSV(ZJZHSH-HYC/China/05/2012)__KR017847.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaaggccgccatccacgtcaagggggcgctggtggacggcaccgagttcacgttcgaggggagctgcatgttccccgacggctgcgacgccgtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcgcccgtgaagctgatgttcgccatcatcaagaagctcatgcggagcgtgtcctgcctgatgggcaagctgatggaccgcgggcggcaggtcatccacgaggagatcggcgagaaccgcaagggcaaccaggacgacgtgcggatcgagatggtgcgcccccgccgggtccgccactggatgtacagcccggtgatcctcaccatcctggccatcgggctgacggagggctgcgacgagatggtgcacgccgactccaagctcgtcagctgccggcaggggtccggcaacatgaaggagtgcgtgaccaccgggcgcgccctgctgcccgcggtgaaccccggccaggaggcctgcctccacttcaccgcccccggcagcccggacagcaagtgcctgaagatcaaggtcaagcggatcaacctgaagtgcaagaagtccagctcctacttcgtgcccgacgcccgcagccggtgcacgtccgtgcgccggtgccgctgggccggggactgccagagcggctgcccctcccacttcaccagcaactccttcagcgacgactgggcggggaagatggaccgggccggcctcgggttctccggctgcagcgacggctgcgggggcgccgcctgcgggtgcttcaacgcggccccgtcctgcatcttctggcgcaagtgggtcgagaacccccacggcatcatctggaaggtgagcccctgcgccgcctgggtgccctccgccgtcatcgagctgaccatgccgagcggggaggtgcggaccttccaccccatgtccggcatccccacccaggtgttcaagggcgtcagcgtgacgtacctggggtccgacatggaggtgagcggcctcaccgacctgtgcgagatcgaggagctcaagagcaagaagctggcgctggccccctgcaaccaggccgggatgggcgtcgtgggcaaggtgggggagatccagtgctccagcgaggagtccgcccgcaccatcaagaaggacggctgcatctggaacgccgacctggtcgggatcgagctgcgggtggacgacgcggtgtgctacagcaagatcacgtccgtcgaggccgtggccaactacagcgccatcccgaccaccatcggcgggctccgcttcgagcggtcccacgacagccagggcaagatctccggcagccccctggacatcaccgccatccgcgggtccttcagcgtgaactaccggggcctgcgcctctccctgagcgagatcacggcgacctgcaccggggaggtcaccaacgtgtccggctgctacagctgcatgaccggggccaaggtgtccatcaagctgcacagctccaagaacagcacggcccacgtccgctgcaagggcgacgagaccgccttcagcgtgctcgagggcgtgcactcctacaccgtcagcctgtccttcgaccacgcggtggtggacgagcagtgccagctgaactgcgggggccacgagagccaggtcaccctcaaggggaacctgatcttcctggacgtgcccaagttcgtggacggctcctacatgcagacgtaccacagctccgtccccaccggggccaacatcccgagccccaccgactggctcaacgccctgttcggcaacggcctgtcccggtggatcctcggggtgatcggcgtcctgctcgggggcctggccctgttcttcctgatcatgagcctcttcaagctgggcaccaagcaggtcttccgctcccggacgaagctggcctga

SEQ ID NO: 13171 - RNA, 3222 nt, synthetic construct
  misc_feature 1..3222: note = derived and/or modified CDS sequence (opt1) from SFTSV(ZJZHSH-HYJ/China/07/2012)__KR017852.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaaggccgccatccacgtcaagggggcgctggtggacggcaccgagttcacgttcgaggggagctgcatgttccccgacggctgcgacgccgtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcgcccgtgaagctgatgttcgccatcatcaagaagctcatgcggagcgtgtcctgcctgatgggcaagctgatggaccgcgggcggcaggtcatccacgaggagatcggcgagaaccgcgagggcaaccaggacgacgtgcggatcgagatggtgcgcccccgccgggtccgccactggatgtacagcccggtgatcctcaccatcctggccatcgggctgacggagggctgcgacgagatggtgcacgccgactccaagctcgtcagctgccggcaggggtccggcaacatgaaggagtgcgtgaccaccgggcgcgccctgctgcccgcggtgaaccccggccaggaggcctgcctccacttcaccgcccccggcagcccggacagcaagtgcctgaaggtcaaggtgaagcggatcaacctgaagtgcaagaagtccagctcctacttcgtgcccgacgcccgcagccggtgcacgtccgtccgccggtgccgctgggccggggactgccagagcggctgcccctcccacttcaccagcaactccttcagcgacgactgggcggggaagatggaccgggccggcctcgggttctccggctgcagcgacggctgcgggggcgccgcctgcgggtgcttcaacgcggccccgtcctgcatcttctggcgcaagtgggtggagaacccccacggcatcatctggaaggtgagcccctgcgccgcctgggtcccctccgccgtgatcgagctgaccatgccgagcggggaggtgcggaccttccaccccatgtccggcatccccacgcaggtcttcaagggcgtgagcgtgacctacctggggtccgacatggaggtcagcggcctcaccgacctgtgcgagatcgaggagctcaagagcaagaagctggcgctggccccctgcaaccaggccgggatgggcgtggtgggcaaggtcggggagatccagtgctccagcgaggagtccgcccgcaccatcaagaaggacggctgcatctggaacgccgacctggtggggatcgagctgcgggtggacgacgcggtctgctacagcaagatcacgtccgtggaggccgtggccaactacagcgccatcccgaccaccatcggcgggctccgcttcgagcggtcccacgacagccagggcaagatctccggcagccccctggacatcaccgccatccgcgggtccttcagcgtcaactaccggggcctgcgcctctccctgagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttcagcgtgctcgagggcgtccactcctacaccgtgagcctgtccttcgaccacgcggtggtcgacgagcagtgccagctgaactgcgggggccacgagagccaggtgaccctcaaggggaacctgatcttcctggacgtgcccaagttcgtcgacggctcctacatgcagacgtaccacagctccgtgcccaccggggccaacatcccgagccccaccgactggctcaacgccctgttcggcaacggcctgtcccggtggatcctcggggtcatcggcgtgctgctcgggggcctggccctgttcttcctgatcatgagcctcttcaagctgggcaccaagcaggtcttccgctcccggacgaagctggcctga

SEQ ID NO: 13172 - RNA, 3222 nt, synthetic construct
  misc_feature 1..3222: note = derived and/or modified CDS sequence (opt1) from SFTSV(ZJZHSH-LU/China/10/2011)__KR017850.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatgtgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctggtcaccctgacctccgagctcaagagcgcgacggtgtgcgcctcccacttctgcagctccgccaccagcgggaagaagtccaccgagatccagttccacagcggctccctggtcggcaaggccgccatccacgtgaagggggcgctggtggacggcaccgagttcacgttcgaggggagctgcatgttccccgacggctgcgacgccgtcgactgcaccttctgccgcgagttcctcaagaacccccagtgctaccccgccaagaagtggctgttcatcatcatcgtgatcctgctcggctacgccgggctgatgctgctcaccaacgtgctgaaggccatcggcgtctgggggtcctgggtgatcgcgcccgtgaagctgatgttcgccatcatcaagaagctcatgcggagcgtctcctgcctgatgggcaagctgatggaccgcgggcgccaggtgatccacgaggagatcggcgagaaccgggagggcaaccaggacgacgtgcggatcgagatggtccgcccccgccgggtgcgccactggatgtacagcccggtgatcctcaccatcctggccatcgggctgacggagggctgcgacgagatggtccacgccgactccaagctcgtgagctgccggcaggggtccggcaacatgaaggagtgcgtgaccaccgggcgcgccctgctgcccgcggtcaaccccggccaggaggcctgcctccacttcaccgcccccggcagcccggacagcaagtgcctgaagatcaaggtgaagcggatcaacctgaagtgcaagaagtccagctcctacttcgtgcccgacgcccgcagccggtgcacgtccgtccgccggtgccgctgggccggggactgccagagcggctgcccctcccacttcaccagcaactccttcagcgacgactgggcggggaagatggaccgggccggcctcgggttctccggctgcagcgacggctgcgggggcgccgcctgcgggtgcttcaacgcggccccgtcctgcatcttctggcgcaagtgggtggagaacccccacggcatcatctggaaggtgagcccctgcgccgcctgggtcccctccgccgtgatcgagctgaccatgccgagcggggaggtgcggaccttccaccccatgtccggcatccccacgcaggtcttcaagggcgtgagcgtgacctacctggggtccgacatggaggtcagcggcctcaccgacctgtgcgagatcgaggagctcaagagcaagaagctggcgctggccccctgcaaccaggccgggatgggcgtggtgggcaaggtcggggagatccagtgctccagcgaggagtccgcccgcaccatcaagaaggacggctgcatctggaacgccgacctggtggggatcgagctgcgggtggacgacgcggtctgctacagcaagatcacgtccgtggaggccgtggccaactacagcgccatcccgaccaccatcggcgggctccgcttcgagcggtcccacgacagccagggcaagatctccggcagccccctggacatcaccgccatccgcgggtccttcagcgtcaactaccggggcctgcgcctctccctgagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttcagcgtgctcgagggcgtccactcctacaccgtgagcctgtccttcgaccacgcggtggtcgacgagcagtgccagctgaactgcgggggccacgagagccaggtgaccctcaaggggaacctgatcttcctggacgtgcccaagttcgtcgacggctcctacatgcagacgtaccacagctccgtgcccaccggggccaacatcccgagccccaccgactggctcaacgccctgttcggcaacggcctgtcccggtggatcctcggggtcatcggcgtgctgctcgggggcctggccctgttcttcctgatcatgagcctcttcaagctgggcaccaagcaggtcttccgctcccggacgaagctggcctga

SEQ ID NO: 13173 - RNA, 3222 nt, synthetic construct
  misc_feature 1..3222: note = derived and/or modified CDS sequence (opt1) from SFTSV(ZJZHSH-SHZ/China/05/2012)__KR017848.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctggtcaccctgacctccgagctcaagagcgcgacggtgtgcgcctcccacttctgcagctccgccaccagcgggaagaagtccaccgagatccagttccacagcggctccctggtcggcaaggccgccatccacgtgaagggggcgctggtggacggcaccgagttcacgttcgaggggagctgcatgttccccgacggctgcgacgccgtcgactgcaccttctgccgcgagttcctcaagaacccccagtgctaccccgccaagaagtggctgttcatcatcatcgtgatcctgctcggctacgccgggctgatgctgctcaccaacgtgctgaaggccatcggcgtctgggggtcctgggtgatcgcgcccgtgaagctgatgttcgccatcatcaagaagctcatgcggagcgtctcctgcctgatgggcaagctgatggaccgcgggcgccaggtgatccacgaggagatcggcgagaaccgggagggcaaccaggacgacgtgcggatcgagatggtccgcccccgccgggtgcgccactggatgtacagcccggtgatcctcaccatcctggccatcgggctgacggagggctgcgacgagatggtccacgccgactccaagctcgtgagctgccggcaggggtccggcaacatgaaggagtgcgtgaccaccgggcgcgccctgctgcccgcggtcaaccccggccaggaggcctgcctccacttcaccgcccccggcagcccggacagcaagtgcctgaagatcaaggtgaagcggatcaacctgaagtgcaagaagtccagctcctacttcgtgcccgacgcccgcagccggtgcacgtccgtccgccggtgccgctgggccggggactgccagagcggctgcccctcccacttcaccagcaactccttcagcgacgactgggcggggaagatggaccgggccggcctcgggttctccggctgcagcgacggctgcgggggcgccgcctgcgggtgcttcaacgcggccccgtcctgcatcttctggcgcaagtgggtggagaacccccacggcatcatctggaaggtgagcccctgcgccgcctgggtcccctccgccgtgatcgagctgaccatgccgagcggggaggtgcggaccttccaccccatgtccggcatccccacgcaggtcttcaagggcgtgagcgtgacctacctggggtccgacatggaggtcagcggcctcaccgacctgtgcgagatcgaggagctcaagagcaagaagctggcgctggccccctgcaaccaggccgggatgggcgtggtgggcaaggtcggggagatccagtgctccagcgaggagtccgcccgcaccatcaagaaggacggctgcatctggaacgccgacctggtggggatcgagctgcgggtggacgacgcggtctgctacagcaagatcacgtccgtggaggccgtggccaactacagcgccatcccgaccaccatcggcgggctccgcttcgagcggtcccacgacagccagggcaagatctccggcagccccctggacatcaccgccatccgcgggtccttcagcgtcaactaccggggcctgcgcctctccctgagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttcagcgtgctcgagggcgtccacgggtacaccgtgtccctgagcttcgaccacgcggtggtcgacgagcagtgccagctgaactgcggcgggcacgagtcccaggtgaccctcaagggcaacctgatcttcctggacgtgcccaagttcgtcgacgggagctacatgcagacgtaccactccagcgtgcccaccggcgccaacatcccgtcccccaccgactggctcaacgccctgttcggcaacgggctgagccggtggatcctcggcgtcatcggggtgctgctgggcggcctcgccctgttcttcctgatcatgtccctcttcaagctggggaccaagcaggtcttccgcagccggacgaagctggcctga

SEQ ID NO: 13174 - RNA, 3222 nt, synthetic construct
  misc_feature 1..3222: note = derived and/or modified CDS sequence (opt1) from SFTSV(ZJZHSH-WSH/China/08/2012)__KR017854.1__GP
  source 1..3222: mol_type = other RNA
atgatgaaggtgatctggttcagctccctgatctgcctcgtgatccagtgcggcggggacaccggccccatcatctgcgccgggccgatccacagcaacaagtccgccggcatcccccacctcctggggtacagcgagaagatctgccagatcgaccgcctgatccacgtgtccagctggctgcggaaccactcccagttccagggctacgtgggccagcgcgggggccggagccaggtctcctactaccccgcggagaacagctactcccgctggagcgggctgctctccccctgcgacgccgactggctgggcatgctggtggtgaagaaggccaaggggagcgacatgatcgtcccgggcccctcctacaagggcaaggtgttcttcgagcggcccaccttcgacgggtacgtgggctgggggtgcggcagcggcaagtcccgcacggagagcggggagctctgctccagcgacagcggcacctccagcgggctgctgccctccgaccgggtcctctggatcggcgacgtggcctgccagccgatgacccccatccccgaggagaccttcctggagctcaagagcttctcccagagcgagttccccgacgtgtgcaagatcgacgggatcgtcttcaaccagtgcgagggcgagtccctgccgcagcccttcgacgtggcctggatggacgtgggccacagccacaagatcatcatgcgcgagcacaagacgaagtgggtccaggagtccagctccaaggacttcgtgtgctacaaggaggggaccggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtccagaagcccggcgaggtggtggtcagctacgggggcatgcgggtgcgcccgaagtgctacgggttctcccggatgatggccacgctggaggtgaacccgcccgagcagcgcatcggccagtgcaccgggtgccacctcgagtgcatcaacggcggcgtccggctgatcaccctgaccagcgagctcaagagcgcgacggtgtgcgcctcccacttctgcagctccgccaccagcgggaagaagtccaccgagatccagttccacagcggctccctggtcgggaagaccgccatccacgtgaagggcgccctggtggacggcacggagttcaccttcgaggggagctgcatgttccccgacggctgcgacgcggtcgactgcaccttctgccgcgagttcctcaagaacccccagtgctaccccgccaagaagtggctgttcatcatcatcgtgatcctgctcgggtacgccggcctgatgctgctcaccaacgtgctgaaggccatcggggtctggggctcctgggtgatcgcccccgtgaagctgatgttcgcgatcatgaagaagctcatgcggagcgtctcctgcctgatgggcaagctgatggaccgcgggcgccaggtgatccacgaggagatcggcgagaaccgggaggggaaccaggacgacgtgcggatcgagatggtccgcccccgccgggtgcgccactggatgtacagcccggtgatcctcacgatcctggccatcggcctgaccgaggggtgcgacgagatggtccacgccgactccaagctcgtgagctgccggcagggctccggcaacatgaaggagtgcgtgaccaccgggcgcgccctgctgcccgccgtcaaccccggccaggaggcgtgcctccacttcacggcccccgggagcccggactccaagtgcctgaagatcaaggtgaagcggatcaacctgaagtgcaagaagtccagctcctacttcgtgcccgacgcccgcagccggtgcacctccgtccgccggtgccgctgggccggcgactgccagagcgggtgcccgccccacttcacctccaacagcttctccgacgactgggccggcaagatggaccgggcgggcctcgggttcagcggctgctccgacgggtgcggcggggccgcctgcggctgcttcaacgccgcgcccagctgcatcttctggcgcaagtgggtggagaacccccacggcatcatctggaaggtgtccccctgcgccgcctgggtcccgagcgccgtgatcgagctgaccatgccctccggggaggtgcggacgttccaccccatgagcggcatccccacccaggtcttcaagggggtgtccgtgacctacctgggcagcgacatggaggtctccggcctcaccgacctgtgcgagatcgaggagctcaagagcaagaagctggccctggcgccgtgcaaccaggccgggatgggcgtggtggggaaggtcggcgagatccagtgctccagcgaggagagcgcccgcacgatcaagaaggacgggtgcatctggaacgccgacctggtgggcatcgagctgcgggtggacgacgccgtctgctactccaagatcaccagcgtggaggcggtggccaactactccgccatccccaccaccatcggcgggctccgcttcgagcggagccacgactcccagggcaagatcagcgggagccccctggacatcacggccatccgcggcagcttctccgtcaactaccgggggctgcgcctcagcctgtccgagatcaccgcgacctgcaccggcgaggtgaccaacgtgagcggctgctactcctgcatgacgggggccaaggtcagcatcaagctgcactccagcaagaactccaccgcccacgtgcgctgcaagggcgacgagaccgccttcagcgtgctcgagggggtccactcctacagcgtgagcctgtccttcgaccacgccgtggtcgacgagcagtgccagctgaactgcggcgggcacgagagccaggtgaccctccggggcaacctgatcttcctggacgtgcccaagttcgtcgacggctcctacatgcagacgtaccacagcaccgtgccgaccggggcgaacatcccctcccccaccgactggctcaacgccctgttcggcaacgggctgagccgctggatcctcggcgtcatcggcgtgctgctcgggggcctggccctgttcttcctgatcatgtccctcttcaagctggggacgaagcaggtcttccggagccgcaccaagctggcctga

SEQ ID NO: 13175 - RNA, 3222 nt, synthetic construct
  misc_feature 1..3222: note = derived and/or modified CDS sequence (opt1) from SFTSV(ZJZHSH-XAM/China/06/2012)__KR017853.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctggtcaccctgacctccgagctcaagagcgcgacggtgtgcgcctcccacttctgcagctccgccaccagcgggaagaagtccaccgagatccagttccacagcggctccctggtcggcaaggccgccatccacgtgaagggggcgctggtggacggcaccgagttcacgttcgaggggagctgcatgttccccgacggctgcgacgccgtcgactgcaccttctgccgcgagttcctcaagaacccccagtgctaccccgccaagaagtggctgttcatcatcatcgtgatcctgctcggctacgccgggctgatgctgctcaccaacgtgctgaaggccatcggcgtctgggggtcctgggtgatcgcgcccgtgaagctggtcttcgccatcatcaagaagctcatgcgggccgtgagctgcctgatgggcaagctgatggaccgcgggcgccaggtgatccacgaggagatcggcgagaaccgggagggcaaccaggacgacgtccggatcgagatggcccgcccccgccgggtgcgccactggatgtactccccggtgatcctcaccatcctggccatcgggctggcggagggctgcgacgagatggtccacgccgacagcaagctcgtgtcctgccggcaggggagcggcaacatgaaggagtgcgtgacgaccgggcgcgccctgctgcccgccgtcaaccccggccaggaggcctgcctccacttcaccgcgcccggctccccggacagcaagtgcctgaagatcaaggtgaagcggatcaacctgaagtgcaagaagtcctccagctacttcgtgcccgacgcccgctcccggtgcaccagcgtccgccggtgccgctgggccggggactgccagtccggctgccccagccacttcacgtccaacagcttctccgacgactgggccgggaagatggaccgggcgggcctcgggttcagcggctgctccgacggctgcgggggcgccgcctgcgggtgcttcaacgccgccccgagctgcatcttctggcgcaagtgggtggagaacccccacggcatcatctggaaggtgtccccctgcgcggcctgggtccccagcgccgtgatcgagctgaccatgccgtccggggaggtgcggaccttccaccccatgagcggcatccccacccaggtcttcaagggcgtgtccgtgacgtacctggggagcgacatggaggtctccggcctcaccgacctgtgcgagatcgaggagctcaagagcaagaagctggccctggccccctgcaaccaggcggggatgggcgtggtgggcaaggtcggggagatccagtgcagctccgaggagagcgcccgcaccatcaagaaggacggctgcatctggaacgccgacctggtggggatcgagctgcgggtggacgacgccgtctgctactccaagatcaccagcgtggaggccgtggcgaactactccgccatcccgacgaccatcggcgggctccgcttcgagcggagccacgactcccagggcaagatcagcggcagccccctggacatcaccgccatccgcgggagcttctccgtcaactaccggggcctgcgcctcagcctgtccgagatcaccgccacgtgcaccggggaggtgaccaacgtgagcggctgctactcctgcatgaccggggcgaaggtcagcatcaagctgcactccagcaagaactccaccgcccacgtgcgctgcaagggcgacgagacggccttcagcgtgctcgagggcgtccacagctacaccgtgtccctgagcttcgaccacgccgtggtcgacgagcagtgccagctgaactgcgggggccacgagtcccaggtgaccctcaaggggaacctgatcttcctggacgtgcccaagttcgtcgacggcagctacatgcagacctaccactccagcgtgcccacgggggccaacatcccgtcccccaccgactggctcaacgcgctgttcggcaacggcctgagccggtggatcctcggggtcatcggcgtgctgctcgggggcctggccctgttcttcctgatcatgtccctcttcaagctgggcaccaagcaggtcttccgcagccggaccaagctggcctga

SEQ ID NO: 13176 - RNA, 3222 nt, synthetic construct
  misc_feature 1..3222: note = derived and/or modified CDS sequence (opt1) from SFTSV(ZJZHSH-YJX/China/06/2012)__KR017860.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgacgccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctccgcagcgcgacggtctgcgcctcccacttctgcagctccgccaccagcgggaagaagtccaccgagatccagttccacagcggctccctggtgggcaagaccacgatccacgtcaagggggccctggtggacggcaccgagttcaccttcgaggggagctgcatgttccccgacggctgcgacgccgtggactgcaccttctgccgggagttcctcaagaacccccagtgctaccccgcgaagaagtggctgttcatcatcatcgtcatcctgctcggctacgccgggctgatgctgctcacgaacgtgctgaaggccatcggcgtgtgggggtcctgggtcatcgcccccgtgaagctgatgttcgccatcatcaagaagctcatgcgcagcgtgtcctgcctgatgggcaagctgatggaccgggggcgccaggtcatccacgaggagatcggcgagaaccgggagggcaaccaggacgacgtgcgcatcgagatggcgcgcccccggcgcgtgcggcactggatgtacagcccggtcatcctcaccatcctggccatcgggctggccgagggctgcgacgagatggtgcacgccgactccaagctcgtgagctgcaagcaggcctccgggaacatgaaggagtgcgtcaccaccggccgcgcgctgctgcccgccgtgaaccccgggcaggaggcctgcctccacttcacggcccccggcagcccggacagcaagtgcctgaagatcaaggtgaagcggatcaacctgaagtgcaagaagtccagctcctacttcgtcctcgacgcccgcagccggtgcacctccgtgcgccggtgccgctgggcgggcgactgccagagcgggtgcccctcccacttcaccagcaactccttcagcgacgactgggccggcaagatggaccgggccgggctgggcttctccgggtgcagcgacggctgcggcggggccgcgtgcggctgcttcaacgccgccccctcctgcatcttctggcgcaagtgggtggagaacccgcacgggatcatctggaaggtcagcccctgcgccgcctgggtgccctccgcggtgatcgagctgaccatgcccagcggcgaggtccggacgttccacccgatgtccgggatccccacccaggtgttcaagggcgtgagcgtcacctacctcggctccgacatggaggtgagcgggctgaccgacctgtgcgagatcgaggagctcaagagcaagaagctggccctggccccctgcaaccaggccggcatgggggtggtcggcaaggtgggcgagatccagtgctccagcgaggagtccgcccgcacgatcaagaaggacgggtgcatctggaacgcggacctggtgggcatcgagctccgggtcgacgacgccgtgtgctacagcaagatcacctccgtggaggccgtcgccaactacagcgccatccccaccaccatcgggggcctgcgcttcgagcggtcccacgacagccaggggaagatctccggcagcccgctggacatcacggcgatccgcggctccttcagcgtgaactaccgggggctccgcctgtccctgagcgaggtgaccgcgacctgcaccggcgaggtcaccaacgtgtccgggtgctacagctgcatgacgggcgccaaggtgtccatcaagctccacagctccaagaacagcaccgcccacgtccgctgcaagggggacgagaccgccttcagcgtgctggagggcgtgcactcctacaccgtcagcctgtccttcgaccacgccgtggtggacgagcagtgccagctcaactgcggcgggcacgagagccaggtcacgctgaagggcaacctgatcttcctcgacgtgcccaagttcgtggacgggtcctacatgcagacctaccacagctccgtcctgaccggcgccaacatccccagccccaccgactggctgaacgccctcttcgggaacggcctgtccaagtggatcctgggcgtgatcggggtcctcctgggcgggctggccctcttcttcctgatcatgagcctgttcaagctcggcacgaagcagatcttccggtcccgcaccaagctggcgtga

SEQ ID NO: 13177 - RNA, 3222 nt, synthetic construct
  misc_feature 1..3222: note = derived and/or modified CDS sequence (opt1) from SFTSV(SPL003A)__AB817988.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaactcccccgagcagcgcatcgggcagtgcaccggctgccacctcgagtgcatcaacgggggcgtgcggctgatcaccctgaccagcgagctcaagtccgcgacggtctgcgccagccacttctgctccagcgccacctccgggaagaagtccaccgagatccagttccacagcggcagcctggtgggcaagaccgccatccacgtcaagggggccctggtggacggcacggagttcaccttcgaggggtcctgcatgttccccgacggctgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggagctgggtcatcgcccccgtgaagctgatgttcgcgatcatcaagaagctcatgcggtccgtgagctgcctgatgggcaagctgatggaccgcgggcggcaggtcatccacgaggagatcggcgagaaccgcgagggcaaccaggacgacgtgcggatcgagatggcccgcccccgccgggtgcgccactggatgtactcccccgtcatcctcacgatcctggccatcgggctggccgagggctgcgacgagatggtgcacgccgacagcaagctcgtgtcctgcaagcaggggagcggcaacatgaaggagtgcgtcaccaccgggcgggcgctgctgccggccgtgaaccccggccaggaggcctgcctccacttcaccgcccccggcagccccgactccaagtgcctgaagatcaaggtgaagcgcatcaacctgaagtgcaagaagtccagcagctacttcgtcccggacgcccggtcccgctgcacgagcgtgcggcgctgccggtgggcgggggactgccagtccggctgccccagccacttcacctccaacagcttctccgacgactgggccgggaagatggaccgcgccggcctcgggttcagcggctgctccgacggctgcgggggcgccgcgtgcgggtgcttcaacgccgcccccagctgcatcttctggcggaagtgggtggagaacccgcacggcatcatctggaaggtctccccctgcgccgcctgggtgcccagcgcggtgatcgagctgaccatgccctccggggaggtccgcaccttccacccgatgagcggcatccccacccaggtgttcaagggcgtgtccgtcacctacctggggagcgacatggaggtgagcggcctcaccgacctgtgcgagatcgaggagctgaagtccaagaagctggccctcgccccctgcaaccaggccgggatgggcgtggtcggcaaggtgggggagatccagtgcagctccgaggagagcgcccggaccatcaagaaggacggctgcatctggaacgcggacctggtggggatcgagctgcgcgtcgacgacgccgtgtgctactccaagatcacgagcgtggaggccgtcgccaactactccgccatccccaccaccatcggcgggctccggttcgagcgcagccacgactcccagggcaagatcagcggctccccgctggacatcaccgcgatccgggggagcttctccgtgaactaccgcggcctgcggctcagcctgtccgagatcacggccacgtgcaccggggaggtgaccaacgtcagcggctgctactcctgcatgaccggggcccgcgtgagcatcaagctgcactccagcaagaacagcacggcccacgtgcgctgcaagggcgacgagaccgcgttctccgtcctcgagggcgtgcacagctacaccgtgtccctgagcttcgaccacgccgtcgtggacgagcagtgccagctgaactgcgggggccacgagtcccaggtgaccctcaaggggaacctgatcttcctggacgtccccaagttcgtggacggcagctacatgcagacgtaccactccagcgtgcccaccggggccaacatcccctccccgaccgactggctcaacgccctgttcggcaacggcctgagccggtggatcctcggggtcatcggcgtgctgctcgggggcctggccctgttcttcctgatcatgtccctcttcaagctgggcaccaagcaggtcttccgcagccggacgaagctggcgtga

SEQ ID NO: 13178 - RNA, 3222 nt, synthetic construct
  misc_feature 1..3222: note = derived and/or modified CDS sequence (opt1) from SFTSV(SPL004A)__AB817989.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatctccgggggcgtgcggctgatcaccctgaccagcgagctcaagtccgcgacggtctgcgccagccacttctgctccagcgccacctccgggaagaagtccaccgagatccagttccactccggcagcctggtgggcaaggccgccatccacgtcaagggggcgctggtggacggcaccgagttcacgttcgaggggtcctgcatgttccccgacggctgcgacgccgtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggagctgggtcatcgcgcccgtgaagctgatgttcgccatcatgaagaagctcatgcggtccgtgagctgcctgatgggcaagctgatggaccgcgggcggcaggtcatccacgaggagatcggcgagaaccgcgagggcaaccaggacgacgtgcggatcgagatggcccgcccccgccgggtgcgccactggatgtactccccggtcatcctcaccatcctggccatcgggctggccgagggctgcgacgagatggtgcacgcggacagcaagctcgtgtcctgccggcaggggagcggcaacatgaaggagtgcgtcacgaccgggcgcgccctgctgcccgccgtgaaccccggccaggaggcctgcctccacttcaccgcccccggcagcccggactccaagtgcctgaagatcaaggtgaagcggatcaacctgaagtgcaagaagtccagcagctacttcgtccccgacgcgcgctcccggtgcaccagcgtgcgccggtgccgctgggccggggactgccagtccggctgccccagccacttcacgtccaacagcttctccgacgactgggccgggaagatggaccgggccggcctcgggttcagcggctgctccgacggctgcgggggcgcggcctgcgggtgcttcaacgccgccccgagctgcatcttctggcgcaagtgggtggagaacccccacggcatcatctggaaggtctccccctgcgccgcgtgggtgcccagcgccgtgatcgagctgaccatgccgtccggggaggtccggaccttccaccccatgagcggcatccccacccaggtgttcaagggcgtgtccgtcacgtacctggggagcgacatggaggtgagcggcctcaccgacctgtgcgagatcgaggagctgaagtccaagaagctggccctcgccccctgcaaccaggccgggatgggcgtggtcggcaaggtgggggagatccagtgcagctccgaggagagcgcgcgcaccatcaagaaggacggctgcatctggaacgccgacctggtggggatcgagctgcgggtcgacgacgccgtgtgctactccaagatcaccagcgtggaggccgtcgccaactactccgcgatcccgacgaccatcggcgggctccgcttcgagcggagccacgactcccagggcaagatcagcggcagccccctggacatcaccgccatccgcgggagcttctccgtgaactaccggggcctgcgcctcagcctgtccgagatcaccgccacgtgcaccggggaggtgaccaacgtcagcggctgctactcctgcatgaccggggccaaggtgagcatcaagctgcactccagcaagaacagcaccgcgcacgtgcgctgcaaggaggacgagacggccttctccgtcctcgagggcgtgcacagctacaccgtgtccctgagcttcgaccacgccgtcgtggacgagcagtgccagctgaactgcggcgggcacgagtcccacgtgaccctcaagggcaacctgatcttcctggacgtccccaagttcgtggacgggagctacatgcagacctaccactccagcgtgcccacgggcgccaacatcccgtcccccaccgactggctcaacgccctgttcgggaacggcctgagccggtggatcctcggcgtcatgggggtgctgctgggcgggctcgcgctgttcttcctgatcatgtccctcttcaagctgggcaccaagcaggtcttccgcagccggaccaagctggcctga

SEQ ID NO: 13179 - RNA, 3222 nt, synthetic construct
  misc_feature 1..3222: note = derived and/or modified CDS sequence (opt1) from SFTSV(SPL005A)__AB817990.1__GP
  source 1..3222: mol_type = other RNA
atgatgaaggtgatctggttcagctccctgatctgcctcgtcatccagtgcagcggcgacgcctcccccatcatctgcgccgggccgatccacagcaacaagtccgcgaacatcccccacctcctgggctacagcgagaagatctgccagatcgaccgcctcatccacgtgtccagctggctgcggaaccactcccagttccaggggtacgtgggccagcgcgggggccggagccaggtctcctacttccccgccgagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacgggtacgtgggctggggctgcgggagcggcaagtcccgcaccgagagcggggagctctgcagctccgacagcggcacgtccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagtccgagagcctcccgcagcccctggacgtcgcgtggatggacgtggggcactcccacaagatcatcatgcgcgagcacaagaccaagtgggtgcaggagagctccagcaaggacttcgtctgctacaaggagggcacggggccctgctccgagagcgaggagaagacctgcaagacctccggcagctgccggggcgacatgcagttctgcaaggtggccgggtgcgagcacggcgaggaggcctccgaggccaagtgccgctgcagcctggtgcacaagcccggggaggtcgtggtgagctacggcgggatgcgggtccgcccgaagtgctacggcttctcccggatgatggcgaccctcgaggtgaaccccctggagcagcgcatcggccagtgcacggggtgccacctggagtgcatcaacggcggggtgcggctcatcaccctgaccagcgagctgaagtccgccaccgtctgcgccagccacttctgctccagcgccacgtccggcaagaagtccaccgagatccagttccacagcgggagcctcgtgggcaagaccgccatccacgtcaagggcgcgctggtggacgggaccgagttcacgttcgagggctcctgcatgttccccgacgggtgcgacgccgtggactgcaccttctgccgcgagttcctgaagaacccccagtgctacccggccaagaagtggctgttcatcatcatcgtcatcctgctgggctacgccggcctcatgctgctgaccaacgtgctcaaggccatcggggtgtggggcagctgggtcatcgcgcccgtgaagctgatgttcgccatcatcaagaagctgatgcggtccgtgagctgcctcatggggaagctgatggaccgcggccggcaggtcatccacgaggagatcggggagaaccgcgagggcaaccaggacgacgtgcggatcgagatggcccgcccccgccgggtgcgccactggatgtactcccccgtcatcctgaccatcctcgccatcggcctggccgaggggtgcgacgagatggtgcacgcggacagcaagctggtgtcctgcaagcagggcgggggcaacatgaaggagtgcgtcacgaccgggcgggccctcctgccggccgtgaaccccggccaggaggcctgcctgcacttcaccgcccccggcagccccgacagcaagtgcctcaagatcaaggtgaagcgcatcaacctgaagtgcaagaagtccagctcctacttcgtcccggacgcgcggagccgctgcacctccgtgcggcgctgccggtgggccggggactgccagagcggctgcccctcccacttcacgagcaactccttcagcgacgactgggccgggaagatggaccgcgccggcctggggttctccggctgcagcgacggctgcgggggcgcggcctgcgggtgcttcaacgccgccccctcctgcatcttctggcggaagtgggtggagaacccgcacggcatcatctggaaggtcagcccctgcgccgcgtgggtgccctccgccgtgatcgagctcaccatgcccagcggggaggtccgcaccttccacccgatgtccggcatccccacccaggtgttcaagggcgtgagcgtcacgtacctggggtccgacatggaggtgagcggcctgaccgacctgtgcgagatcgaggagctcaagagcaagaagctggccctggccccctgcaaccaggccgggatgggcgtggtcggcaaggtgggggagatccagtgctccagcgaggagtccgcgcggaccatcaagaaggacggctgcatctggaacgccgacctcgtggggatcgagctgcgcgtcgacgacgccgtgtgctacagcaagatcacctccgtggaggccgtcgccaactacagcgcgatccccacgaccatcggcgggctgcggttcgagcgctcccacgacagccagggcaagatctccggcagcccgctcgacatcaccgccatccgggggtccttcagcgtgaactaccgcggcctgcggctgtccctcagcgagatcaccgccacgtgcaccggggaggtgaccaacgtctccggctgctacagctgcatgaccggggccaaggtgtccatcaagctgcacagctccaagaacagcaccgcgcacgtgcgctgcaagggcgacgagacggccttcagcgtcctggagggcgtgcactcctacaccgtgagcctctccttcgaccacgccgtcgtggacgagcagtgccagctgaactgcgggggccacgagagccaggtgaccctgaaggggaacctcatcttcctggacgtccccaagttcgtggacggctcctacatgcagacctaccacagctccgtgcccacgggggccaacatccccagcccgaccgactggctgaacgccctcttcggcaacggcctgtcccgctggatcctgggggtcatcggcgtgctcctcgggggcctggcgctgttcttcctgatcatgagcctgttcaagctgggcaccaagcaggtcttccggtcccgcaccaagctggcctga

SEQ ID NO: 13180 - RNA, 3222 nt, synthetic construct
  misc_feature 1..3222: note = derived and/or modified CDS sequence (opt1) from SFTSV(SPL010A)__AB817991.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaactcccccgagcagcgcatcgggcagtgcaccggctgccacctcgagtgcatcaacgggggcgtgcggctgatcaccctgaccagcgagctcaagtccgcgacggtctgcgccagccacttctgctccagcgccacctccgggaagaagtccaccgagatccagttccacagcggcagcctggtgggcaagaccgccatccacgtcaagggggccctggtggacggcacggagttcaccttcgaggggtcctgcatgttccccgacggctgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggagctgggtcatcgcccccgtgaagctgatgttcgcgatcatcaagaagctcatgcggtccgtgagctgcctgatgggcaagctgatggaccgcgggcggcaggtcatccacgaggagatcggcgagaaccgcgagggcaaccaggacgacgtgcggatcgagatggcccgcccccgccgggtgcgccactggatgtactcccccgtcatcctcacgatcctggccatcgggctggccgagggctgcgacgagatggtgcacgccgacagcaagctcgtgtcctgcaagcaggggagcggcaacatgaaggagtgcgtcaccaccgggcgggcgctgctgccggccgtgaaccccggccaggaggcctgcctccacttcaccgcccccggcagccccgactccaagtgcctgaagatcaaggtgaagcgcatcaacctgaagtgcaagaagtccagcagctacttcgtcccggacgcccggtcccgctgcacgagcgtgcggcgctgccggtgggcgggggactgccagtccggctgccccagccacttcacctccaacagcttctccgacgactgggccgggaagatggaccgcgccggcctcgggttcagcggctgctccgacggctgcgggggcgccgcgtgcgggtgcttcaacgccgcccccagctgcatcttctggcggaagtgggtggagaacccgcacggcatcatctggaaggtctccccctgcgccgcctgggtgcccagcgcggtgatcgagctgaccatgccctccggggaggtccgcaccttccacccgatgagcggcatccccacccaggtgttcaagggcgtgtccgtcacgtacctggggagcgacatggaggtgagcggcctcaccgacctgtgcgagatcgaggagctgaagtccaagaagctggccctcgccccctgcaaccaggccgggatgggcgtggtcggcaaggtgggggagatccagtgcagctccgaggagagcgcccggaccatcaagaaggacggctgcatctggaacgcggacctggtggggatcgagctgcgcgtcgacgacgccgtgtgctactccaagatcacgagcgtggaggccgtcgccaactactccgccatccccaccaccatcggcgggctccggttcgagcgcagccacgactcccagggcaagatcagcggctccccgctggacatcaccacgatccgggggagcttctccgtgaactaccgcggcctgcggctcagcctgtccgagatcaccgcgacctgcaccggggaggtgaccaacgtcagcggctgctactcctgcatgacgggggcccgcgtgagcatcaagctgcactccagcaagaacagcaccgcccacgtgcgctgcaagggcgacgagaccgccttctccgtcctcgagggcgtgcacagctacaccgtgtccctgagcttcgaccacgcggtcgtggacgagcagtgccagctgaactgcgggggccacgagtcccaggtgacgctcaaggggaacctgatcttcctggacgtccccaagttcgtggacggcagctacatgcagacctaccactccagcgtgcccaccggggccaacatcccctccccgaccgactggctcaacgccctgttcggcaacggcctgagccggtggatcctcggggtcatcggcgtgctgctcgggggcctggccctgttcttcctgatcatgtccctcttcaagctgggcacgaagcaggtcttccgcagccggaccaagctggcctga

SEQ ID NO: 13181 - RNA, 3222 nt, synthetic construct
  misc_feature 1..3222: note = derived and/or modified CDS sequence (opt1) from SFTSV(SPL030A)__AB817992.1__GP
  source 1..3222: mol_type = other RNA
atgatgaaggtgatctggttcagctccctgatctgcctcgtcatccagtgcagcggcgacacctcccccatcatctgcgccgggccgatccacagcaacaagtccgccagcatcccccacctcctgggctactccgagaagatctgccagatcgaccgcctcatccacgtgagctcctggctgcggaaccacagccagttccaggggtacgtgggccagcgcgggggccggtcccaggtcagctacttccccgcggagaactcctacagccgctggtccggcctgctcagcccctgcgacgccgactggctggggatgctggtggtgaagaaggccaagggctccgacatgatcgtcccggggcccagctacaagggcaaggtgttcttcgagcggcccaccttcgacgggtacgtgggctggggctgcgggtccggcaagagccgcacggagagcggggagctctgctccagcgactccggcaccagctccggcctgctgcccagcgaccgggtcctctggatcggggacgtggcctgccagccgatgacccccatccccgaggagaccttcctggagctgaagtccttcagccagtccgagttccccgacatctgcaagatcgacggcatcgtgttcaaccagtgcgagagcgagtccctcccgcagcccctggacgtcgcctggatggacgtggggcacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccggggcgacatgcagttctgcaaggtggcggggtgcgagcacggcgaggaggccagcgaggccaagtgccgctgcagcctggtgcacaagcccggggaggtcgtggtgtcctacggcgggatgcgggtccgcccgaagtgctacggcttcagccggatgatggccacgctcgaggtgaacccgcccgagctgcgcatcggccagtgcaccgggtgccacctggagtgcatcaacggcggggtgcggctcatcaccctgacctccgagctcaagagcgcgacggtctgcgcctcccacttctgcagctccgccaccagcggcaagaagtccaccgagatccagttccacagcgggtccctggtgggcaagaccgccatccacgtcaagggcgccctggtggacgggacggagttcaccttcgagggcagctgcatgttccccgacgggtgcgacgcggtggactgcaccttctgccgcgagttcctgaagaacccccagtgctaccccgccaagaagtggctgttcatcatcatcgtcatcctgctgggctacgccggcctcatgctgctgaccaacgtgctcaaggccatcggggtgtggggctcctgggtcatcgcccccgtgaagctgatgttcgcgatcatcaagaagctgatgcggagcgtgtcctgcctcatggggaagctgatggaccgcggccggcaggtcatccacgaggagatcggggagaaccgcgagggcaaccaggacgacgtgcggatcgagatggcccgcccccgccgggtgcgccactggatgtacagcccggtcatcctgacgatcctcgccatcggcctggccgaggggtgcgacgagatggtgcacgccgactccaagctggtgagctgcaagcagggcgggggcaacatgaaggagtgcgtcaccaccgggcgggcgctcctgcccgccgtgaaccccggccaggaggcctgcctgcacttcaccgcccccggcagcccggactccaagtgcctcaagatccgcgtgaagcggatcaacctgaagtgcaagaagtccagcagctacttcgtccccgacgcccgctcccggtgcacgagcgtgcgccggtgccgctgggcgggggactgccagtccggctgccccagccacttcacctccaacagcttctccgacgactgggccgggaagatggaccgggccggcctggggttcagcggctgctccgacggctgcgggggcgccgcgtgcgggtgcttcaacgccgccccgagctgcatcttctggcgcaagtgggtggagaacccccacggcatcatctggaaggtctccccctgcgccgcctgggtgcccagcgcggtgatcgagctcaccatgccgtccggggaggtccggaccttccaccccatgagcggcatccccacccaggtgttcaagggcgtgtccgtcacctacctggggagcgacatggaggtgagcggcctgaccgacctgtgcgagatcgaggagctcaagtccaagaagctggccctggccccctgcaaccaggccgggatgggcgtggtcggcaaggtgggggagatccagtgcaacagcgaggagtccgcccgcaccatcaagaaggacggctgcatctggaacgcggacctcgtggggatcgagctgcgggtcgacgacgccgtgtgctacagcaagatcacgtccgtggaggccgtcgccaactacagcgccatcccgaccaccatcggcgggctgcgcttcgagcggtcccacgacagccagggcaagatctccggcagccccctcgacatcaccgcgatccgcgggtccttcagcgtgaactaccggggcctgcgcctgtccctcagcgagatcacggccacgtgcaccggggaggtgaccaacgtctccggctgctacagctgcatgaccggggccaaggtgtccatcaagctgcacagctccaagaacagcacggcccacgtgcgctgcaagggcgacgagaccgcgttcagcgtcctggagggcgtgcactcctacaccgtgagcctctccttcgaccacgccgtcgtggacgagcagtgccagctgaactgcgggggccacgagagccaggtgaccctgaaggggaacctcatcttcctggacgtccccaagttcgtggacggctcctacatgcagacgtaccacagctccgtgcccaccggggccaacatcccgagccccaccgactggctgaacgccctcttcggcaacggcctgtcccggtggatcctgggggtcatcggcgtgctcctcgggggcctggccctgttcttcctgatcatgagcctgttcaagctcggcaccaagcaggtcttccgctcccggacgaagctggcgtga

SEQ ID NO: 13182 - RNA, 3222 nt, synthetic construct
  misc_feature 1..3222: note = derived and/or modified CDS sequence (opt1) from SFTSV(SPL053A)__AB985292.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagggggccaacatcccccacctcctgggctacagcgagaagatctgccagatcgaccgcctgatccacgtgtccagctggctgcggaaccactcccagttccaggggtacgtgggccagcgcggcgggcggagccaggtctcctacttccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgcatctccgacagcgggaccagctccggcctgctgcccagcgaccgggtcctctggatcggggacgtggcctgccagccgatgacccccatccccgaggagaccttcctggagctgaagtccttcagccagtccgagttccccgacatctgcaagatcgacggcatcgtgttcaaccagtgcgagagcgagtccctcccgcagcccttcgacgtcgcctggatggacgtggggcacagccacaagatcatcatgcgcgagcacaagacgaagtgggtgcaggagtccagctccaaggacttcgtctgctacaaggagggcaccggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggggaggtcgtggtgagctacggcggcatgcgggtccgcccgaagtgctacgggttctcccggatgatggccacgctggaggtgaacagccccgagcagcgcatcggccagtgcaccgggtgccacctcgagtgcatcaacggcggggtgcggctgatcaccctgaccagcgagctcaagtccgcgacggtctgcgccagccacttctgctccagcgccacctccggcaagaagtccaccgagatccagttccacagcggcagcctggtggggaagaccgccatccacgtcaagggcgccctggtggacgggacggagttcaccttcgagggctcctgcatgttccccgacggctgcgacgcggtggactgcaccttctgccgcgagttcctcaagaacccccagtgctacccggccaagaagtggctgttcatcatcatcgtcatcctgctcgggtacgccggcctgatgctgctcaccaacgtgctgaaggccatcggggtgtggggcagctgggtcatcgcccccgtgaagctgatgttcgcgatcatcaagaagctcatgcggtccgtgagctgcctgatggggaagctgatggaccgcggccggcaggtcatccacgaggagatcggcgagaaccgcgaggggaaccaggacgacgtgcggatcgagatggcccgcccccgccgggtgcgccactggatgtactcccccgtcatcctcacgatcctggccatcggcctggccgaggggtgcgacgagatggtgcacgccgacagcaagctcgtgtcctgcaagcagggcagcgggaacatgaaggagtgcgtcaccaccggccgggcgctgctgccggccgtgaaccccggccaggaggcctgcctccacttcaccgcccccgggtcccccgacagcaagtgcctgaagatcaaggtgaagcgcatcaacctgaagtgcaagaagtccagcagctacttcgtcccggacgcccggtcccgctgcacgagcgtgcggcgctgccggtgggcgggcgactgccagtccgggtgccccagccacttcacctccaacagcttctccgacgactgggccggcaagatggaccgcgccgggctcggcttcagcggctgctccgacgggtgcggcggggccgcgtgcggctgcttcaacgccgcccccagctgcatcttctggcggaagtgggtggagaacccgcacgggatcatctggaaggtctccccctgcgccgcctgggtgcccagcgcggtgatcgagctgaccatgccctccggcgaggtccgcaccttccacccgatgagcggcatccccacccaggtgttcaagggggtgtccgtcacctacctgggcagcgacatggaggtgtccgggctcaccgacctgtgcgagatcgaggagctcaagagcaagaagctggccctggccccctgcaaccaggccggcatgggcgtggtcgggaaggtgggcgagatccagtgcagctccgaggagagcgcccggaccatcaagaaggacgggtgcatctggaacgcggacctggtgggcatcgagctgcgcgtcgacgacgccgtgtgctactccaagatcacgagcgtggaggccgtcgccaactactccgccatccccaccaccatcgggggcctccggttcgagcgcagccacgactcccagggcaagatcagcgggtccccgctggacatcaccgcgatccggggcagcttctccgtgaactaccgcgggctgcggctcagcctgtccgagatcacggccacgtgcaccggcgaggtgaccaacgtcagcgggtgctactcctgcatgaccggcgcccgcgtgagcatcaagctgcactccagcaagaactccacggcccacgtgcgctgcaagggcgacgagaccgcgttcagcgtcctcgagggggtgcacagctacaccgtgtccctgagcttcgaccacgccgtcgtggacgagcagtgccagctgaactgcggcgggcacgagtcccaggtgaccctcaagggcaacctgatcttcctggacgtccccaagttcgtggacgggagctacatgcagacgtaccactccagcgtgcccaccggcgccaacatcccctccccgaccgactggctcaacgccctgttcggcaacgggctgagccggtggatcctcggcgtcatcggggtgctgctgggcggcctcgccctgttcttcctgatcatgtccctcttcaagctggggaccaagcaggtcttccgcagccggacgaagctggcgtga

SEQ ID NO: 13183 - RNA, 3222 nt, synthetic construct
  misc_feature 1..3222: note = derived and/or modified CDS sequence (opt1) from SFTSV(SPL054A)__AB985293.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctcatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcatggagctgaagtccttcagccagtccgagttccccgacatctgcaagatcgacgggatcgtgttcaaccagtgcgagagcgagtccctgccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctcgtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctggagtgcatcaacgggggcgtgcggctcatcaccctgacctccgagctcaagagcgcgacggtctgcgcctcccacttctgcagctccgccaccagcgggaagaagtccaccgagatccagttccacagcggctccctggtgggcaagaccgccatccacgtcaagggggccctggtggacggcacggagttcaccttcgaggggagctgcatgttccccgacggctgcgacgcggtggactgcaccttctgccgcgagttcctgaagaacccccagtgctaccccgccaagaagtggctgttcatcatcatcgtcatcctgctgggctacgccgggctcatgctgctgaccaacgtgctcaaggccatcggcgtgtgggggtcctgggtcatcgcccccgtgaagctgatgttcgcgatcatcaagaagctgatgcggagcgtgtcctgcctcatgggcaagctgatggaccgcgggcggcaggtcatccacgaggagatcggcgagaacggcgaggggaaccaggacgacgtgcgcatcgagatcgcccggccccgccgcgtgcggcactggatgtacagcccggtcatcctgacgatcctcgccatcggcctggccgaggggtgcgacgagatggtgcacgccgactccaagctggtgagctgcaagcagggctccgggaacatgaaggagtgcgtcaccaccggccgcgcgctcctgcccgccgtgaaccccggccaggaggcctgcctgcacttcaccgcccccgggagcccggacagcaagtgcctcaagatcaaggtgaagcggatcaacctgaagtgcaagaagtccagctcctacttcgtccccgacgcccgcagccggtgcacgtccgtgcgccggtgccgctgggcgggcgactgccagagcgggtgcccctcccacttcaccagcaactccttcagcgacgactgggccggcaagatggaccgggccgggctgggcttctccggctgcagcgacgggtgcggcggggccgcgtgcggctgcttcaacgccgccccgtcctgcatcttctggcgcaagtgggtggagaacccccacgggatcatctggaaggtcagcccctgcgccgcctgggtgccctccgcggtgatcgagctcaccatgccgagcggcgaggtccggaccttccaccccatgtccggcatccccacccaggtgttcaagggggtgagcgtcacctacctgggctccgacatggaggtgagcgggctgaccgacctctgcgagatcgaggagctcaagagcaagaagctggccctggccccctgcaaccaggccggcatgggcgtggtcgggaaggtgggcgagatccagtgctccagcgaggagtccgcccgcaccatcaagaaggacgggtgcatctggaacgcggacctggtgggcatcgagctgcgggtcgacgacgccgtgtgctacagcaagatcacgtccgtggaggccgtcgccaactacagcgccatcccgaccaccatcgggggcctgcgcttcgagcggtcccacgacagccagggcaagatctccgggagccccctcgacatcaccgcgatccgcggctccttcagcgtgaactaccgggggctgcgcctgtccctcagcgagatcacggccacgtgcaccggcgaggtgaccaacgtctccgggtgctacagctgcatgaccggcgccaaggtgtccatcaagctgcacagctccaagaacagcacggcccacgtgcggtgcaagggcgacgagaccgcgttcagcgtcctggagggggtgcactcctacaccgtgagcctctccttcgaccacgccgtcgtggacgagcagtgccagctgaactgcggcgggcacgagagccaggtgaccctgaagggcaacctcatcttcctggacgtcccccgcttcgtggacgggtcctacatgcagacgtaccacagctccgtgcccaccggcgccaacatcccgagccccaccgactggctgaacgccctcttcggcaacgggctgtcccgctggatcctgggcgtcatcggggtgctcctgggcggcctggccctcttcttcctgatcatgagcctgttcaagctcgggaccaagcaggtcttccggtcccgcacgaagctggcgtga

SEQ ID NO: 13184 - RNA, 3222 nt, synthetic construct
  misc_feature 1..3222: note = derived and/or modified CDS sequence (opt1) from SFTSV(SPL055A)__AB985294.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaactcccccgagcagcgcatcgggcagtgcaccggctgccacctcgagtgcatcaacgggggcgtgcggctgatcaccctgaccagcgagctcaagtccgcgacggtctgcgccagccacttctgctccagcgccacctccgggaagaagtccaccgagatccagttccacagcggcagcctggtgggcaagaccgccatccacgtcaagggggccctggtggacggcacggagttcaccttcgaggggtcctgcatgttccccgacggctgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggagctgggtcatcgcccccgtgaagctgatgttcgcgatcatcaagaagctcatgcggtccgtgagctgcctgatgggcaagctgatggaccgcgggcggcaggtcatccacgaggagatcggcgagaaccgcgagggcaaccaggacgacgtgcggatcgaggtggcccgcccccgccgggtccgccactggatgtactcccccgtgatcctcacgatcctggccatcgggctggccgagggctgcgacgagatggtgcacgccgacagcaagctcgtctcctgcaagcaggggagcggcaacatgaaggagtgcgtgaccaccgggcgggcgctgctgccggccgtgaaccccggccaggaggcctgcctccacttcaccgcccccggcagccccgactccaagtgcctgaagatcaaggtcaagcgcatcaacctgaagtgcaagaagtccagcagctacttcgtgccggacgcccggtcccgctgcacgagcgtgcggcgctgccggtgggcgggggactgccagtccggctgccccagccacttcacctccaacagcttctccgacgactgggccgggaagatggaccgcgccggcctcgggttcagcggctgctccgacggctgcgggggcgccgcgtgcgggtgcttcaacgccgcccccagctgcatcttctggcggaagtgggtcgagaacccgcacggcatcatctggaaggtgtccccctgcgccgcctgggtgcccagcgcggtcatcgagctgaccatgccctccggggaggtgcgcaccttccacccgatgagcggcatccccacccaggtgttcaagggcgtctccgtgacctacctggggagcgacatggaggtgagcggcctcaccgacctgtgcgagatcgaggagctgaagtccaagaagctggccctcgccccctgcaaccaggccgggatgggcgtcgtgggcaaggtgggggagatccagtgcagctccgaggagagcgcccggaccatcaagaaggacggctgcatctggaacgcggacctggtcgggatcgagctgcgcgtggacgacgccgtgtgctactccaagatcacgagcgtcgaggccgtggccaactactccgccatccccaccaccatcggcgggctccggttcgagcgcagccacgactcccagggcaagatcagcggctccccgctggacatcaccgcgatccgggggagcttctccgtgaactaccgcggcctgcggctcagcctgtccgagatcacggccacgtgcaccggggaggtcaccaacgtgagcggctgctactcctgcatgaccggggcccgcgtgagcatcaagctgcactccagcaagaacagcacggcccacgtccgctgcaagggcgacgagaccgcgttctccgtgctcgagggcgtgcacagctacaccgtctccctgagcttcgaccacgccgtggtggacgagcagtgccagctgaactgcgggggccacgagtcccaggtcaccctcaaggggaacctgatcttcctggacgtgcccaagttcgtggacggcagctacatgcagacgtaccactccagcgtccccaccggggccaacatcccctccccgaccgactggctcaacgccctgttcggcaacggcctgagccggtggatcctcggggtgatcggcgtcctgctcgggggcctggccctgttcttcctgatcatgtccctcttcaagctgggcaccaagcaggtcttccgcagccggacgaagctggcgtga

SEQ ID NO: 13185 - RNA, 3222 nt, synthetic construct
  misc_feature 1..3222: note = derived and/or modified CDS sequence (opt1) from SFTSV(SPL057A)__AB985295.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccgacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgccgcatcgacgggatcgtgttcaaccagtgcgagagcgagtccctcccgcagcccttcgacgtcgcctggatggacgtgggccacagccacaagatcatcatgcgggagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgcgtccggccgaagtgctacggcttcagccgcatgatggccacgctggaggtgaacccgcccgagcagcggatcgggcagtgcaccggctgccacctcgagtgcgtgaacgggggcgtccgcctgatcaccctgacctccgagctcaagagcgcgacggtgtgcgcctcccacttctgcagctccgccatcagcgggaagaagtccaccgagatccagttccacagcggctccctggtcggcaagaccgccatccacgtgaagggggccctggtggacggcaccgagttcacgttcgaggggagctgcatgttccccgacggctgcgacgcggtcgactgcaccttctgccgggagttcctcaagaacccccagtgctaccccgccaagaagtggctgttcatcatcatcgtgatcctgctcggctacgccgggctgatgctgctcaccaacgtgctgaaggccatcggcgtctgggggtcctgggtgatcgcccccgtgaagctgatgttcgcgatcatgaagaagctcatgcgcagcgtctcctgcctgatgggcaagctgatggaccgggggcgccaggtgatccacgaggagatcggcgagaaccgggagggcaaccaggacgacgtgcgcatcgagatggcccgcccccggcgcgtccggcactggatgtacagcccggtgatcctcaccatcctggccgtggggctggccgagggctgcgacgagatggtccacgccgactccaagctcgtgagctgcaagcaggggtccggcaacatgaaggagtgcgtgacgaccgggcgcgcgctgctgcccgccgtcaaccccggccaggaggcctgcctccacttcaccgcccccggcagcccggacagcaagtgcctgaagatcaaggtgaagaagatcaacctgaagtgcaagaagtccagctcctacttcgtgcccgacgcccggagccgctgcacctccgtccggcgctgccggtgggcgggggactgccagagcggctgcccctcccacttcacgagcaactccttcagcgacgactgggccgggaagatggaccgcgccggcctcgggttctccggctgcagcgacggctgcgggggcgccgcgtgcgggtgcttcaacgccgccccgtcctgcatcttctggcggaagtgggtggagaacccccacggcatcatctggaaggtgagcccctgcgccgcctgggtcccctccgcggtgatcgagctgaccatgccgagcggggaggtgcgcaccttccaccccatgtccggcatccccacccaggtcttcaagggcgtgagcgtgacgtacctggggtccgacatggaggtcagcggcctcaccgacctgtgcgagatcgaggagctcaagagcaagaagctggccctggccccctgcaaccaggccgggatgggcgtggtgggcaaggtcggggagatccagtgctccagcgaggagtccgcccggaccatcaagaaggacggctgcatctggaacgcggacctggtggggatcgagctgcgcgtggacgacgccgtctgctacagcaagatcacctccgtggaggccgtggccaactacagcgccatcccgacgaccatcggcgggctccggttcgagcgctcccacgacagccagggcaagatctccggcagccccctggacatcaccgcgatccgggggtccttcagcgtcaactaccgcggcctgcggctctccctgagcgagatcaccgccacgtgcaccggggaggtgaccaacgtgtccggctgctacagctgcatgaccggggccaaggtctccatcaagctgcacagcaacaagaactccaccgcccacgtgcgctgcaagggcgacgagacggcgttcagcgtgctcgagggcgtccacagctacaccgtgtccctgagcttcgaccacgccgtggtcgacgagcagtgccagctgaactgcgggggccacgagtcccaggtgaccctcaaggggaacctgatcttcctggacgtgcccaagttcgtcgacggcagctacatgcagacctaccactccagcgtgcccacgggggccaacatcccgtcccccaccgactggctcaacgccctgttcggcaacggcctgagccgctggatcctcggggtcatcggcgtgctgctcgggggcctggccctgttcttcctgatcatgtccctcttcaagctgggcaccaagcaggtcttccggagccgcaccaagctggcgtga

SEQ ID NO: 13186 - RNA, 3222 nt, synthetic construct
  misc_feature 1..3222: note = derived and/or modified CDS sequence (opt1) from SFTSV(SPL062A)__AB985297.1__GP
  source 1..3222: mol_type = other RNA
atgatgaaggtgatctggttcagctccctgatctgcctcgtgatccgctgcagcggcgggaccggccccatcatctgcgccgggccgatccactccaacaagagcgccaacatcccccacctcctgggctactccgagaagatctgccagatcgaccggctgatccacgtgagctcctggctgcgcaaccacagccagttccaggggtacgtgggccagcggggcgggcgctcccaggtcagctacttccccgcggagaactcctacagccggtggtccggcctgctcagcccctgcgacgccgactggctggggatgctggtggtgaagaaggcccgcggctccgacatgatcgtcccggggcccagctacaagggcaaggtgttcttcgagcggcccaccttcgacggctacgtggggtggggctgcgggtccggcaagagccgcacggagtccggcgagctctgcagcagcgactccgggaccagctccggcctgctgcccagcgaccgggtcctctggatcggggacgtggcctgccagccgatgacccccatccccgaggagaccttcctggagctgaagtccttcagccagtccgagttccccgacatctgcaagatcgacggcatcgtgttcaaccagtgcgagagcgagtccctcccgcagcccttcgacgtcgcctggatggacgtggggcacagccacaagatcatcatgcgcgagcacaagacgaagtgggtgcaggagtccagctccaaggacttcgtctgctacaaggagggcaccggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggggaggtcgtggtgagctacggcggcatgcgggtccgcccgaagtgctacgggttcagccggatgatggccacgctggaggtgaacccgcccgagcagcgcatcggccagtgcaccgggtgccacctcgagtgcatcaacggcggggtgcggctgatcaccctgacctccgagctcaagagcgcgacggtctgcgcctcccacttctgcagctccgccaccagcggcaagaagtccaccgagatccagttccacagcggctccctggtggggaagaccgccatccacgtcaagggcgccctggtggacgggacggagttcaccttcgagggcagctgcatgttccccgacggctgcgacgcggtggactgcaccttctgccgcgagttcctcaagaacccccagtgctaccccgccaagaagtggctgttcatcatcatcgccatcctgctcgggtacgccggcctgatgctgctcaccaacgtcctgaaggccatcggggtgtggggctcctgggtgatcgcgcccgtcaagctgatgttcgccatcatcaagaagctcatgcggagcgtgtcctgcctgatggggaagctgatggaccgcggccgccaggtgatccacgaggagatcggcgagaaccgggaggggaaccaggacgacgtccgcatcgagatggcccggccccgccgggtgcgccactggatgtacagcccggtgatcctcacgatcctggccatcggcctggccgaggggtgcgacgagatggtccacgcggactccaagctcgtgagctgcaagcagggctccgggaacatgaaggagtgcgtgaccaccggccgggccctgctgcccgccgtcaaccccggccaggaggcctgcctccacttcaccgcccccgggagcccggacagcaagtgcctgaagatcaaggtgaagcgcatcaacctgaagtgcaagaagtccagctcctacttcgtgcccgacgcgcggagccgctgcacgtccgtccggcgctgccggtgggccggcgactgccagagcgggtgcccctcccacttcaccagcaactccttcagcgacgactgggccggcaagatggaccgcgccgggctcggcttctccggctgcagcgacgggtgcggcggggcggcctgcggctgcttcaacgccgccccgtcctgcatcttctggcggaagtgggtggagaacccccacgggatcatctggaaggtgagcccctgcgccgcgtgggtcccctccgccgtgatcgagctgaccatgccgagcggcgaggtgcgcaccttccaccccatgtccggcatccccacgcaggtcttcaagggggtgagcgtgacctacctgggctccgacatggaggtcagcgggctcaccgacctgtgcgagatcgaggagctcaagagcaagaagctggccctggccccctgcaaccaggccggcatgggcgtggtggggaaggtcggcgagatccagtgctccagcgaggagtccgcgcggaccatcaagaaggacgggtgcatctggaacgccgacctggtgggcatcgagctgcgcgtggacgacgccgtctgctacagcaagatcacgtccgtggaggccgtggccaactacagcgcgatcccgaccaccatcgggggcctccggttcgagcgctcccacgacagccagggcaagatctccgggagccccctggacatcaccgccatccggggctccttcagcgtcaactaccgcgggctgcgcctctccctgagcgagatcacggcgacctgcaccggcgaggtgaccaacgtgtccgggtgctacagctgcatgaccggcgccaaggtctccatcaagctgcacagctccaagaacagcacggcccacgtgcggtgcaagggcgacgagaccgccttcagcgtgctcgagggggtccactcctacaccgtgagcctgtccttcgaccacgccgtggtcgacgagcagtgccagctgaactgcggcgggcacgagagccaggtgaccctcaagggcaacctgatcttcctggacgtgcccaagttcgtcgacgggtcctacatgcagacgtaccacagctccgtgcccaccggcgccaacatcccgagccccaccgactggctcaacgccctgttcggcaacgggctgtcccgctggatcctcggcgtgatcggggtcctgctgggcggcctcgcgctgttcttcctgatcatgagcctcttcaagctggggaccaagcaggtcttccggtcccgcacgaagctggcctga

SEQ ID NO: 13187 - RNA, 3222 nt, synthetic construct
  misc_feature 1..3222: note = derived and/or modified CDS sequence (opt1) from SFTSV(SPL066A)__AB985298.1__GP
  source 1..3222: mol_type = other RNA
atgatgaaggtgatctggttcagctccctgatctgcctcgtgatccagtgcagcggcgacgcctcccccatcatctgcgccgggccgatccacagcaacaagtccgcgaacatcccccacctcctgggctacagcgagaagatctgccagatcgaccgcctgatccacgtgtccagctggctgcggaaccactcccagttccaggggtacgtgggccagcgcgggggccggagccaggtctcctacttccccgccgagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacgggtacgtgggctggggctgcgggagcggcaagtcccgcaccgagagcggggagctctgcagctccgacagcggcacgtccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagtccgagagcctgccgcagcccttcgacgtcgcgtggatggacgtggggcactcccacaagatcatcatgcgcgagcacaagaccaagtgggtgcaggagagctccagcaaggacttcgtctgctacaaggagggcacggggccctgctccgagagcgaggagaagacctgcaagacctccggcagctgccggggcgacatgcagttctgcaaggtggccgggtgcgagcacggcgaggaggcctccgaggccaagtgccgctgcagcctggtgcacaagcccggggaggtcgtggtgagctacggcgggatgcgggtccgcccgaagtgctacggcttctcccggatgatggcgaccctggaggtgaacccgcccgagcagcgcatcggccagtgcacggggtgccacctcgagtgcatcaacggcggggtgcggctgatcaccctgaccagcgagctcaagtccgccaccgtctgcgccagccacttctgctccagcgccacgtccggcaagaagtccaccgagatccagttccactccgggagcctggtgggcaaggccgcgatccacgtcaagggcgccctggtggacgggaccgagttcaccttcgagggctcctgcatgttccccgacgggtgcgacgccgtggactgcacgttctgccgcgagttcctcaagaacccccagtgctaccccgccaagaagtggctgttcatcatcatcgtcatcctgctcggctacgccggcctgatgctgctcaccaacgtgctgaaggcgatcggggtgtggggcagctgggtcatcgcccccgtgaagctgatgttcgccatcatcaagaagctcatccggtccgtgagctgcctgatggggaagctgatggaccgcggccggcaggtcatccacgaggagatcggggagaacggcgagggcaaccaggacgacgtgcgcatcgagatggcccggccccgccgcgtgcggcactggatgtactccccggtcatcctcaccatcctggccatcgggctggcggagggctgcgacgagatggtgcacgccgacagcaagctcgtgtcctgcaagcaggggagcggcaacatgaaggagtgcgtcaccacggggcgcgccctgctgcccgccgtgaaccccggccaggaggcctgcctccacttcaccgcgcccggcagcccggactccaagtgcctgaagatcaaggtgaagcggatcaacctgaagtgcaagaagtccagcagctacttcgtccccgacgcccgctcccggtgcaccagcgtgcgccggtgccgctgggccggggactgccagtccggctgccccagccacttcacctccaacagcttctccgacgactgggccgggaagatggaccgggcgggcctcgggttcagcggctgctccgacggctgcgggggcgccgcctgcgggtgcttcaacgccgccccgagctgcatcttctggcgcaagtgggtggagaacccccacggcatcatctggaaggtctccccctgcgcggcctgggtgcccagcgccgtgatcgagctgacgatgccgtccggggaggtccggaccttccaccccatgagcggcatccccacccagatcttcaagggcgtgtccgtgacctacctggggagcgacatggaggtcagcggcctcacggacctgtgcgagatcgaggagctgcgctccaagaagctggccctcgccccctgcaaccaggcggggatgggcgtggtgggcaaggtcggggagatccagtgcagctccgaggagagcgcccggaccatcaagaaggacggctgcatctggaacgccgacctggtggggatcgagctgcgcgtggacgacgccgtctgctactccaagatcaccagcgtggaggccgtggcgaactactccgccatcccgaccacgatcggcgggctccggttcgagcgcagccacgactcccagggcaagatcagcggcagccccctggacatcaccgccatccgggggagcttctccgtcaactaccgcggcctgcggctcagcctgtccgagatcaccgcgacctgcacgggggaggtgaccaacgtgagcggctgctactcctgcatgaccggggccaaggtcagcatcaagctgcactccagcaagaacagcaccgcccacgtgcgctgcaagggcgacgagaccgccttctccgtgctcgagggcgtccacagctacacggtgtccctgagcttcgaccacgccgtggtcgacgagcagtgccagctgaactgcgggggccacgagtcccaggtgaccctcaaggggaacctgatcttcctggacgtgcccaagttcgtcgacggcagctacatgcagacctaccactccagcgtgcccaccggggccaacatcccgtcccccacggactggctcaacgcgctgttcggcaacggcctgagccgctggatcctcggggtgatcggcgtcctgctcgggggcctggccctgttcttcctgatcatgtccctcttcaagctgggcaccaagcaggtcttccggagccgcaccaagctggcctga

SEQ ID NO: 13188 - RNA, 3222 nt, synthetic construct
  misc_feature 1..3222: note = derived and/or modified CDS sequence (opt1) from SFTSV(SPL070A)__AB985301.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctcatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcatggagctgaagtccttcagccagtccgagttccccgacatctgcaagatcgacgggatcgtgttcaaccagtgcgagagcgagtccctgccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctcgtgcacaagcccggcgaggtcgtggtgagctacgggggcatgcgggtccgcccgaagtgctacggcttcagccggatgatggccacgctggaggtgtccccgcccgagcagcgcatcgggcagtgcaccggctgccacctggagtgcatcaacgggggcgtgcggctcatcaccctgaccagcgagctgaagtccgcgacggtctgcgccagccacttctgctccagcgccacctccgggaagaagtccaccgagatccagttccacagcggcagcctcgtgggcaagaccgccatccacgtcaagggggccctgatggacggcacggagttcaccttcgaggggtcctgcatgttccccgacggctgcgacgcggtggactgcaccttctgccgcgagttcctgaagaacccccagtgctaccccgccaagaagtggctgttcatcatcatcgtgatcctgctgggctacgccgggctcatgctgctgaccaacgtcctcaaggccatcggcgtgtgggggagctgggtgatcgcccccgtcaagctgatgttcgcgatcatcaagaagctgatgcggtccgtgagctgcctcatgggcaagctgatggaccgcgggcgccaggtgatccacgaggagatcggcgagaacggcgaggggaaccaggacgacgtccggatcgagatggcccggccccgccgcgtgcggcactggatgtactccccggtgatcctgacgatcctcgccatcggcctggccgaggggtgcgacgagatggtccacgccgacagcaagctggtgtcctgcaagcagggcagcgggaacatgaaggagtgcgtgaccaccggccgcgcgctcctgcccgccgtcaaccccggccaggaggcctgcctgcacttcaccgcccccgggagcccggactccaagtgcctcaagatcaaggtgaagcggatcaacctgaagtgcaagaagtccagcagctacttcgtgcccgacgcccgctcccggtgcacgagcgtccgccggtgccgctgggcgggcgactgccagtccgggtgccccagccacttcacctccaacagcttctccgacgactgggccggcaagatggaccgggccgggctgggcttcagcggctgctccgacgggtgcggcggggccgcgtgcggctgcttcaacgccgccccgagctgcatcttctggcgcaagtgggtggagaacccccacgggatcatctggaaggtgtccccctgcgccgcctgggtccccagcgcggtgatcgagctcaccatgccgtccggcgaggtgcggaccttccaccccatgagcggcatccccacgcaggtcttcaagggggtgtccgtgacctacctgggcagcgacatggaggtcaccgggctgaccgacctctgcgagatcgaggagctcaagagcaagaagctggccctggccccctgcaaccaggccggcatgggcgtggtggggaaggtcggcgagatccagtgctccagcgaggagtccgcccgcacgatcaagaaggacgggtgcatctggaacgcggacctggtgggcatcgagctgcgggtggacgacgccgtctgctacagcaagatcacctccgtggaggccgtggccaactacagcgccatcccgaccaccatcgggggcctgcgcttcgagcggtcccacgacagccagggcaagatctccgggagccccctcgacatcacggcgatccgcggctccttcagcgtcaactaccgggggctgcgcctgtccctcagcgagatcaccgcgacctgcaccggcgaggtgaccaacgtgtccgggtgctacagctgcatgacgggcgccaaggtctccatcaagctgcacagctccaagaacagcaccgcccacgtgcggtgcaagggcgacgagaccgccttcagcgtgctggagggggtccactcctacaccgtgagcctctccttcgaccacgccgtggtcgacgagcagtgccagctgaactgcggcgggcacgagagccaggtgacgctgaagggcaacctcatcttcctggacgtgcccaagttcgtcgacgggtcctacatgcagacctaccacagctccgtgcccaccggcgccaacatcccgagccccaccgactggctgaacgccctcttcggcaacgggctgtcccgctggatcctgggcgtgatcggggtcctcctgggcggcctggccctcttcttcctgatcatgagcctgttcaagctcgggacgaagcaggtcttccgcccccggaccaagctggcgtga

SEQ ID NO: 13189 - RNA, 3222 nt, synthetic construct
  misc_feature 1..3222: note = derived and/or modified CDS sequence (opt1) from SFTSV(SPL071A)__AB985302.1__GP
  source 1..3222: mol_type = other RNA
atgatgaaggtgatctggttcagctccctgatctgcctcatcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtgagctacttccccgcggagaactcctacagccgctggtccgggctgctcagcccctgcgacgccgactggctgggcatgctggtcgtgaagaaggccaaggggtccgacatgatcgtgccgggccccagctacaaggggaaggtcttcttcgagcggcccaccttcgacggctacgtgggctgggggtgcggctccggcaagagccgcacggagtccggggagctctgcagcagcgactccggcaccagctccgggctgctgcccagcgaccgggtgctctggatcggcgacgtcgcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtggcctggatggacgtcggccacagccacaagatcatcatgcgcgagcacaagacgaagtgggtgcaggagtccagctccaaggacttcgtgtgctacaaggaggggaccggcccctgcagcgagtccgaggagaagacctgcaagaccagcggctcctgccgcggggacatgcagttctgcaaggtcgcgggctgcgagcacggggaggagacgagcgaggccaagtgccggtgctccctggtgcacaagcccggcgaggtggtcgtgagctacgggggcatgcgggtgcgcccgaagtgctacggcttcagccggatgatggccaccctggaggtcaacccgcccgagcagcgcatcgggcagtgcaccggctgccacctcgagtgcatcaacgggggcgtgcggctgatcaccctgacgtccgagctcaagagcgccaccgtgtgcgcgtcccacttctgcagctccgccaccagcgggaagaagtccaccgagatccagttccacagcggctccctggtcggcaagacggccatccacgtgaagggggccctggtcgacggcaccgagttcaccttcgaggggagctgcatgttccccgacggctgcgacgccgtggactgcaccttctgccgcgagttcctcaagaacccccagtgctaccccgcgaagaagtggctgttcatcatcatcgtgatcctgctcggctacgccgggctgatgctgctcacgaacgtcctgaaggccatcggcgtgtgggggtcctgggtgatcgcccccgtcaagctgatgttcgccatcatcaagaagctcatgcggagcgtgtcctgcctgatgggcaagctgatggaccgcgggcgccaggtgatccacgaggagatcggcgagaaccgggagggcaaccaggacgacgtccggatcgagatggcgcgcccccgccgggtgcgccactggatgtacagcccggtgatcctcgccatcctggccatcgggctggccgagggctgcgacgagatggtccacgccgactccaagctcgtgagctgcaagcaggggtccggcaacatgaaggagtgcgtgaccaccgggcgggcgctgctgcccgccgtcaaccccggccaggaggcctgcctccacttcaccgcccccggcagcccggacagcaagtgcctgaagatcaaggtgaagcgcatcaacctgaagtgcaagaagtccagctcctacttcgtgcccgacgcccggagccgctgcacgtccgtccggcgctgccggtgggcgggggactgccagagcggctgcccctcccacttcaccagcaactccttcagcgacgactgggccgggaagatggaccgcgccggcctcgggttctccggctgcagcgacggctgcgggggcgccgcgtgcgggtgcttcaacgccgccccgtcctgcatcttctggcggaagtgggtggagaacccccacggcatcatctggaaggtgagcccctgcgccgcctgggtcccctccgcggtgatcgagctgaccatgccgagcggggaggtgcgcaccttccaccccatgtccggcatccccacgcaggtcttcaagggcgtgagcgtgacctacctggggtccgacatggaggtcagcggcctcaccgacctgtgcgagatcgaggagctcaagagcaagaagctggccctggccccctgcaaccaggccgggatgggcgtggtgggcaaggtcggggagatccagtgctccagcgaggagtccgcccggaccatcaagaaggacggctgcatctggaacgcggacctggtggggatcgagctgcgcgtggacgacgccgtctgctacagcaagatcacgtccgtggaggccgtggccaactacagcgccatcccgaccaccatcggcgggctccggttcgagcgctcccacgacagccagggcaagatctccggcagccccctggacatcaccgcgatccgggggtccttcagcgtcaactaccgcggcctgcggctctccctgagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttcagcgtgctcgagggcgtccactcctacaccgtgagcctgtccttcgaccacgccgtggtcgacgagcagtgccagctgaactgcgggggccacgagagccaggtgaccctcaaggggaacctgatcttcctggacgtgcccaagttcgtcgacggctcctacatgcagacgtaccacagctccgtgcccaccggggccaacatcccgagccccaccgactggctcaacgccctgttcggcaacggcctgtcccgctggatcctcggggtgatcggcgtcctgctcgggggcctggccctgttcttcctgatcatgagcctcttcaagctgggcaccaagcaggtcttccggtcccgcacgaagctggcgtga

SEQ ID NO: 13190 - RNA, 3222 nt, synthetic construct
  misc_feature 1..3222: note = derived and/or modified CDS sequence (opt1) from SFTSV(SPL077A)__AB985304.1__GP
  source 1..3222: mol_type = other RNA
atgatgaaggtgatctggttcagctccctgatctgcctcgtcacccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccacgttcgacggctacgtgggctgggggtgcggctccgggaagtcccgcaccgagtccggcgagctctgcagcagcgactccggcaccagctccgggctgctgcccagcgaccgggtcctctggatcggcgacgtggcctgccagccgatgacccccatccccgaggagacgttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagaccaagtgggtgcaggagtccagctccaaggacttcgtctgctacaaggaggggaccggcccctgcagcgagtccgaggagaagacctgcaagacgagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccaccctggaggtgaacccgcccgagcagcgcatcgggcagtgcaccggctgccacctcgagtgcatcaacgggggcgtgcggctgatcaccctgacgtccgagctcaagagcgcgaccgtctgcgcctcccacttctgcagctccgccaccagcgggaagaagtccaccgagatccagttccacagcggctccctggtgggcaagacggccatccacgtcaagggggccctggtggacggcaccgagttcaccttcgaggggagctgcatgttccccgacggctgcgacgcggtggactgcaccttctgccgcgagttcctcaagaacccccagtgctaccccgccaagaagtggctgttcatcatcatcgtcatcctgctcggctacgccgggctgatgctgctcacgaacgtgctgaaggccatcggcgtgtgggggtcctgggtcatcgcccccgtgaagctgatgttcgcgatcctcaagaagctgatgcggagcgtgtcctgcctgatgggcaagctcatggaccgcgggcggcaggtcatccacgaggagatcggcgagaaccgcgagggcaaccaggacgacgtgcggatcgagatggcccgcccccgccgggtgcgccactggatgtacagcccggtcatcctgaccatcctggccatcgggctcgccgagggctgcgacgagatggtgcacgccgactccaagctggtgagctgcaagcaggggtccggcaacatgaaggagtgcgtcaccaccgggcgggcgctgctccccgccgtgaaccccggccaggaggcctgcctgcacttcacggcccccggcagcccggacagcaagtgcctgaagatcaaggtgaagcgcatcaacctcaagtgcaagaagtccagctcctacttcgtccccgacgcccggagccgctgcacctccgtgcggcgctgccggtgggcgggggactgccagagcggctgcccctcccacttcaccagcaactccttcagcgacgactgggccgggaagatggaccgcgccggcctggggttctccggctgcagcgacggctgcgggggcgccgcgtgcgggtgcttcaacgccgccccgtcctgcatcttctggcggaagtgggtggagaacccccacggcatcatctggaaggtcagcccctgcgccgcctgggtgccctccgcggtgatcgagctgaccatgccgagcggggaggtccgcacgttccaccccatgtccagcatccccacccaggtgttcaagggcgtgtccgtcacctacctcggcagcgacatggaggtgagcgggctgaccgacctgtgcgagatcgaggagctgaagtccaagaagctcgccctggccccctgcaaccaggccggcatgggggtggtcggcaaggtgggcgagatccagtgcagctccgaggagagcgcccggacgatcaagaaggacgggtgcatctggaacgcggacctggtgggcatcgagctccgcgtcgacgacgccgtgtgctactccaagatcaccagcgtggaggccgtcgccaactactccgccatcccgaccaccatcgggggcctgcggttcgagcgcagccacgactcccaggggaagatcagcggcagccccctggacatcacggcgatccggggcagcttctccgtgaactaccgcgggctccggctgagcctgtccgagatcaccgcgacctgcaccggcgaggtgaccaacgtcagcgggtgctactcctgcatgacgggcgccaaggtgagcatcaagctccactccagcaagaacagcaccgcccacgtgcgctgcaagggggacgagaccgccttctccgtcctggagggcgtgcacagctacaccgtgtccctgagcttcgaccacgccgtcgtggacgagcagtgccagctcaactgcggcgggcacgagtcccaggtgacgctgaagggcaacctgatcttcctcgacgtccccaagttcgtggacgggagctacatgcagacctaccactccagcgtgcccaccggcgccaacatcccgtcccccaccgactggctgaacgccctgttcgggaacggcctcagccgctggatcctgggcgtcatcggggtgctgctcggcgggctggccctgttcttcctcatcatgtccctgttcaagcagggcacgaagcaggtcttccggagccgcaccaagctggcgtga

SEQ ID NO: 13191 - RNA, 3222 nt, synthetic construct
  misc_feature 1..3222: note = derived and/or modified CDS sequence (opt1) from SFTSV(SPL084A)__AB985307.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaagaccgccatccacgtcaagggggccctggtggacggcacggagttcaccttcgaggggagctgcatgttccccgacggctgcgacgcggtggactgcaccttctgccgcgagttcctcaagaacccccagtgctaccccgccaagaagtggctgttcatcatcatcgtcatcctgctcggctacaccgggctgatgctgctcacgaacgtgctgaaggccatcggcgtgtgggggtcctgggtcatcgcccccgtgaagctgatgttcgccatcctcaagaagctgatgcggagcgtgtcctgcctgatgggcaagctcatggaccgcgggcggcaggtcatccacgaggagatcggcgagaaccgcgagggcaaccaggacgacgtgcggatcgagatggcgcgcccccgccgggtgcgccactggatgtacagcccggtcatcctgaccatcctggccatcgggctcgccgagggctgcgacgagatggtgcacgccgactccaagctggtgagctgcaagcaggggtccggcaacatgaaggagtgcgtcaccaccgggcgggccctgctccccgcggtgaaccccggccaggaggcctgcctgcacttcacggcccccggcagcccggacagcaagtgcctgaagatcaaggtgaagcgcatcaacctcaagtgcaagaagtccagctcctacttcgtccccgacgcccggagccgctgcacctccgtgcggcgctgccggtgggccggggactgccagagcggctgcccctcccacttcaccagcaactccttcagcgacgactgggcggggaagatggaccgcgccggcctggggttctccggctgcagcgacggctgcgggggcgccgcctgcgggtgcttcaacgcggccccgtcctgcatcttctggcggaagtgggtggagaacccccacggcatcatctggaaggtcagcccctgcgccgcctgggtgccctccgccgtgatcgagctgaccatgccgagcggggaggtccgcacgttccaccccatgtccggcatccccacccaggtgttcaagggcgtgagcgtcacctacctcgggtccgacatggaggtgagcggcctgaccgacctgtgcgagatcgaggagctcaagagcaagaagctggcgctggccccctgcaaccaggccgggatgggcgtggtcggcaaggtgggggagatccagtgctccagcgaggagtccgcccggacgatcaagaaggacggctgcatctggaacgccgacctggtggggatcgagctccgcgtcgacgacgcggtgtgctacagcaagatcacctccgtggaggccgtcgccaactacagcgccatcccgaccaccatcggcgggctgcggttcgagcgctcccacgacagccagggcaagatctccggcagccccctggacatcacggccatccgggggtccttcagcgtgaactaccgcggcctccggctgtccctgagcgagatcaccgcgacctgcaccggggaggtgaccaacgtctccggctgctacagctgcatgacgggggccaaggtgtccatcaagctccacagctccaagaacagcaccgcccacgtgcgctgcaagggcgacgagaccgccttcagcgtccaggagggcgtgcactcctacaccgtgagcctgtccttcgaccacgcggtcgtggacgagcagtgccagctgaactgcgggggccacgagagccaggtgacgctcaaggggaacctgatcttcctggacgtccccaagttcgtggacggctcctacatgcagacctaccacagctccgtgcccaccggggccaacatcccgagccccaccgactggctcaacgccctgttcggcaacggcctgtcccgctggatcctcggggtcatcggcgtgctgctcgggggcctggccctgttcttcctgatcatgagcctcttcaagctgggcacgaagcaggtcttccggtcccgcaccaagctggcctga

SEQ ID NO: 13192 - RNA, 3222 nt, synthetic construct
  misc_feature 1..3222: note = derived and/or modified CDS sequence (opt1) from SFTSV(SPL086A)__AB985308.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaagaccgccatccacgtcaagggggccctggtggacggcacggagttcaccttcgaggggagctgcatgttccccgacggctgcgacgcggtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcccccgtgaagctgatgttcgcgatcatcaagaagctcatgcggagcgtgtcctgcctgatgggcaagctgatggaccgcgggcggcaggtcatccacgaggagatcggcgagaaccgcgagggcaaccaggacgacgtgcggatcgagatggcccgcccccgccgggtgcgccactggatgtacagcccggtcatcctcacgatcctggccatcgggctggccgagggctgcgacgagatggtgcacgccgactccaagctcgtgagctgcaagcaggggtccggcaacatgaaggagtgcgtcaccaccgggcgggcgctgctgcccgccgtgaaccccggccaggaggcctgcctccacttcaccgcccccggcagcccggacagcaagtgcctgaagatcaaggtgaagcgcatcaacctgaagtgcaagaagtccagctcctacttcgtccccgacgcccggagccgctgcacgtccgtgcggcgctgccggtgggcgggggactgccagagcggctgcccctcccacttcaccagcaactccttcagcgacgactgggccgggaagatggaccgcgccggcctcgggttctccggctgcagcgacggctgcgggggcgccgcgtgcgggtgcttcaacgccgccccgtcctgcatcttctggcggaagtgggtggagaacccccacggcatcatctggaaggtcagcccctgcgccgcctgggtgccctccgcggtgatcgagctgaccatgccgagcggggaggtccgcaccttccaccccatgtccggcatccccacccaggtgttcaagggcgtgagcgtcacctacctggggtccgacatggaggtgagcggcctcaccgacctgtgcgagatcgaggagctcaagagcaagaagctggccctggccccctgcaaccaggccgggatgggcgtggtcggcaaggtgggggagatccagtgctccagcgaggagtccgcccggaccatcaagaaggacggctgcatctggaacgcggacctggtggggatcgagctgcgcgtcgacgacgccgtgtgctacagcaagatcacgtccgtggaggccgtcgccaactacagcgccatcccgaccaccatcggcgggctccggttcgagcgctcccacgacagccagggcaagatctccggcagccccctggacatcaccgcgatccgggggtccttcagcgtgaactaccgcggcctgcggctctccctgagcgagatcacggccacgtgcaccggggaggtgaccaacgtctccggctgctacagctgcatgaccggggcccgcgtgtccatcaagctgcacagctccaagaacagcacggcccacgtgcgctgcaagggcgacgagaccgcgttcagcgtcctcgagggcgtgcactcctacaccgtgagcctgtccttcgaccacgccgtcgtggacgagcagtgccagctgaactgcgggggccacgagagccaggtgaccctcaaggggaacctgatcttcctggacgtccccaagttcgtggacggctcctacatgcagacgtaccacagctccgtgcccaccggggccaacatcccgagccccaccgactggctcaacgccctgttcggcaacggcctgtcccggtggatcctcggggtcatcggcgtgctgctcgggggcctggccctgttcttcctgatcatgagcctcttcaagctgggcaccaagcaggtcttccgctcccggacgaagctggcgtga

SEQ ID NO: 13193 - RNA, 3222 nt, synthetic construct
  misc_feature 1..3222: note = derived and/or modified CDS sequence (opt1) from SFTSV(SPL087A)__AB985309.1__GP
  source 1..3222: mol_type = other RNA
atgatgaaggtgatctggttcagctccctgatctgcctcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctgcggaaccactcccagttccagggctacgtggggcagcgcggcggccggagccaggtctcctactaccccgcggagaacagctactcccgctggagcgggctgctctccccctgcgacgccgactggctgggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcagcgagagcggcgagctctgctccagcgactccggcaccagctccgggctgctgcccagcgaccgggtcctctggatcggcgacgtggcctgccagccgatgacgcccatccccgaggagaccttcctggagctgaagtccttcagccagtccgagttccccgacatctgcaagatcgacgggatcgtgttcaaccagtgcgagggcgagagcctcccgcagcccttcgacgtcgcctggatggacgtggggcactcccacaagatcatcatgcgcgagcacaagaccaagtgggtgcaggagagctccagcaaggacttcgtctgctacaaggagggcaccggcccctgctccgagagcgaggagaagacgtgcaagacctccgggagctgccggggcgacacccagttctgcaaggtggcggggtgcgagcacggcgaggaggcctccgaggccaagtgccgctgcagcctggtgcacaagcccggggaggtcgtggtgagctacggcggcatgcgggtccgcccgaagtgctacgggttctcccggatgatggccaccctggaggtgagcccgcccgagcagcgcatcggccagtgcacggggtgccacctcgagtgcatcaacggcggggtgcggctgatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgcgagttcctcaagaacccccagtgctaccccgccaagaagtggctgttcatcatcatcgtcatcctgctcgggtacgccggcctgatgctgctcaccaacgtgctgaaggccatcggggtgtggggctcctgggtcatcgcccccgtgaagctgatgttcgcgatcatcaagaagctcatgcggaccgtgagctgcctgatggggaagctgatggaccgcggccggcaggtcatccacgaggagatcggcgagaaccgcgaggggaaccgggacgacatccgcatcgagatggcccgcccccggcgcgtgcggcactggatgtactccccggtgatcctcacgatcctggccatcggcctggccgaggggtgcgacgagatggtccacgccgacagcaagctcgtgtcctgccgccagggcagcgggaacatgaaggagtgcgtgaccaccggccgggcgctgctgcccgccgtcaaccccggccaggaggcctgcctccacttcaccgcccccgggagcccggactccaagtgcctgaagatcaaggtgaagcgcatcaacctgaagtgcaagaagtccagcagctacttcgtgcccgacgcccggtcccgctgcacgagcgtccggcgctgccggtgggcgggcgactgccagtccgggtgcccgccccacttcaccagcaactccttcagcgacgactgggccggcaagatggaccgcgccgggctcggcttctccggctgcagcgacgggtgcggcggggccgcgtgcggctgcttcaacgccgccccctcctgcatcttctggcggaagtgggtggagaacccccacgggatcatctggaaggtgagcccctgcgccgcctgggtcccgtccgcggtgatcgagctgaccatgcccagcggcgaggtgcgcaccttccaccccatgtccggcatccccacgcaggtcttcaagggggtgagcgtgacctacctgggctccgacatggaggtcagcgggctcaccgacctgtgcgagatcgaggagctcaagagcaagaagctggccctggccccgtgcaaccaggccggcatgggcgtggtggggaaggtcggcgagatccagtgctccagcgaggagtccgcccggaccatcaagaaggacgggtgcatctggaacgcggacctggtgggcatcgagctgcgcgtggacgacgccgtctgctacagcaagatcacgtccgtggaggccgtggccaactacagcgccatccccaccaccatcgggggcctccggttcgagcgctcccacgacagccagggcaagatctccgggagccccctggacatcaccgcgatccggggctccttcagcgtcaactaccgcgggctgcgcctctccctgagcgagatcacggcgacctgcaccggcgaggtgaccaacgtgtccgggtgctacagctgcatgaccggcgccaaggtctccatcaagctgcacagctccaagaacagcacggcccacgtgcggtgcaagggcgacgagaccgccttcagcgtgctcgagggggtccactcctacaccgtgagcctgtccttcgaccacgccgtggtcgacgagcgctgccagctgaactgcggcgggcacgagagccaggtgaccctcaagggcaacctgatcttcctggacgtgcccaagttcgtcgacgggtcctacatgcagacgtaccacagcaccgtgccgaccggcgccaacatcccctcccccaccgactggctcaacgccctgttcggcaacgggctgagccggtggatcctcggcgtgatcggggtcctgctgggcggcctcgccctgttcttcctgatcatgtccctcttcaagctggggacgaagcaggtcttccgcagccggaccaagctggcgtga

SEQ ID NO: 13194 - RNA, 3222 nt, synthetic construct
  misc_feature 1..3222: note = derived and/or modified CDS sequence (opt1) from SFTSV(SPL090A)__AB985311.1__GP
  source 1..3222: mol_type = other RNA
atgatgaaggtgatctggttccccagcctgatctgcctcgtgatccgctgctccggcgggaccggcccgatcatctgcgccgggcccatccacagcaacaagtccgccaacatcccccacctcctgggctacagcgagaagatctgccagatcgaccggctgatccacgtgtccagctggctgcgcaaccactcccagttccaggggtacgtgggccagcggggcgggcgcagccaggtctcctacttccccgcggagaacagctactcccggtggagcggcctgctctccccgtgcgacgccgactggctggggatgctggtggtgaagaaggcccgcggcagcgacatgatcgtccccgggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccgtccgaccgggtcctctggatcggggacgtggcctgccagcccatgacccccatccccgaggagaccttcctggagctcaagagcttctcccagagcgagttcccggacatctgcaagatcgacggcatcgtgttcaaccagtgcgagtccgagagcctgccccagcccttcgacgtcgcctggatggacgtggggcactcccacaagatcatcatgcgcgagcacaagacgaagtgggtgcaggagagctccagcaaggacttcgtctgctacaaggagggcaccggcccctgctccgagagcgaggagaagacctgcaagacctccgggagctgccggggcgacatgcagttctgcaaggtggcggggtgcgagcacggcgaggaggcctccgaggccaagtgccgctgcagcctggtgcacaagccgggggaggtcgtggtgtcctacggcggcatgcgggtccgccccaagtgctacgggttcagccggatgatggccacgctggaggtgaacccgcccgagcagcgcatcggccagtgcaccgggtgccacctcgagtgcatcaacggcggggtgcggctgatcaccctgaccagcgagctcaagtccgcgacggtctgcgccagccacttctgctccagcgccacctccggcaagaagtccaccgagatccagttccactccggcagcctggtggggaagaccgccatccacgtcaagggcgccctggtggacgggacggagttcaccttcgagggctcctgcatgttccccgacggctgcgacgcggtggactgcaccttctgccgcgagttcctcaagaacccccagtgctaccccgccaagaagtggctgttcatcatcatcgccatcctgctcgggtacgccggcctgatgctgctcaccaacgtcctgaaggccatcggggtgtggggcagctgggtgatcgcgcccgtcaagctgatgttcgccatcatcaagaagctcatgcggtccgtgagctgcctgatggggaagctgatggaccgcggccgccaggtgatccacgaggagatcggcgagaaccgggaggggaaccaggacgacgtccgcatcgagatggcccggccgcgccgggtgcgccactggatgtactcccccgtgatcctcacgatcctggccatcggcctggccgaggggtgcgacgagatggtccacgcggacagcaagctcgtgtcctgcaagcagggcagcgggaacatgaaggagtgcgtgaccaccggccgggccctgctgcccgccgtcaaccccggccaggaggcctgcctccacttcaccgccccggggtcccccgacagcaagtgcctgaagatcaaggtgaagcgcatcaacctgaagtgcaagaagtccagcagctacttcgtgcccgacgcgcggtcccgctgcacgagcgtccggcgctgccggtgggccggcgactgccagtccgggtgcccgagccacttcacctccaacagcttctccgacgactgggccggcaagatggaccgcgccgggctcggcttcagcggctgctccgacgggtgcggcggggcggcctgcggctgcttcaacgccgcccccagctgcatcttctggcggaagtgggtggagaacccccacgggatcatctggaaggtgtccccctgcgccgcgtgggtcccgagcgccgtgatcgagctgaccatgccctccggcgaggtgcgcaccttccaccccatgagcggcatccccacgcaggtcttcaagggggtgtccgtgacctacctgggcagcgacatggaggtctccgggctcaccgacctgtgcgagatcgaggagctcaagagcaagaagctggccctggccccgtgcaaccaggccggcatgggcgtggtggggaaggtcggcgagatccagtgcagctccgaggagagcgcgcggaccatcaagaaggacgggtgcatctggaacgccgacctggtgggcatcgagctgcgcgtggacgacgccgtctgctactccaagatcacgagcgtggaggccgtggccaactactccgcgatccccaccaccatcgggggcctccggttcgagcgcagccacgactcccagggcaagatcagcgggagccccctggacatcaccgccatccggggcagcttctccgtcaactaccgcgggctgcgcctcagcctgtccgagatcacggcgacctgcaccggcgaggtgaccaacgtgagcgggtgctactcctgcatgaccggcgccaaggtcagcatcaagctgcactccagcaagaactccacggcccacgtgcggtgcaagggcgacgagaccgccttcagcgtgctcgagggggtccacagctacaccgtgtccctgagcttcgaccacgccgtggtcgacgagcagtgccagctgaactgcggcgggcacgagtcccaggtgaccctcaagggcaacctgatcttcctggacgtgcccaagttcgtcgacgggagctacatgcagacgtaccactccagcgtgccgaccggcgccaacatcccctcccccaccgactggctcaacgccctgttcggcaacgggctgagccgctggatcctcggcgtgatcggggtcctgctgggcggcctcgcgctgttcttcctgatcatgtccctcttcaagctggggaccaagcaggtcttccggagccgcacgaagctggcctga

SEQ ID NO: 13195 - RNA, 3222 nt, synthetic construct
  misc_feature 1..3222: note = derived and/or modified CDS sequence (opt1) from SFTSV(SPL097A)__AB985312.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccgacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaagcaggggaccggcccctgccccgagagcgaggagaagacctgcaagacctccggcagctgccgcggggacatgcagttctgcaaggtggcgggctgcgagcacggggaggaggcctccgaggccaagtgccggtgcagcctggtgcacaagccgggcgaggtcgtggtgtcctacgggggcatgcgggtccgccccaagtgctacggcttcagccggatgatggccacgctggaggtgaacccgcccgagcagcgcatcgggcagtgcaccggctgccacctcgagtgcgtgaacgggggcgtccggctgatcaccctgaccagcgagctcaagtccgcgacggtgtgcgccagccacttctgctccagcgccacctccgggaagaagaacaccgagatccagttccacagcggctccctggtcggcaagaccgccatccacgtgaagggggccctgctcgacggcacggagttcaccttcgaggggagctgcatgttccccgacggctgcgacgcggtggactgcaccttctgccgcgagttcctgaagaacccccagtgctaccccgccaagaagtggctgttcatcatcatcgtcatcctcctgggctacgccgggctgatgctcctgaccaacgtgctgaaggccatcggcgtgtgggggtcctgggtcatcgcccccgtgaagctcatgttcgcgatcatcaagaagctgatgcggagcgtgtcctgcctgatgggcaagctcatggaccgcgggcggcaggtcatccacgaggagatcggcgagaaccgcgagggcaaccaggacgacgtgcggatcgagatggcccgcccgcgccgggtgcgccactggatgtacagccccgtcatcctgacgatcctggccgtggggctcgccgagggctgcgacgagatggtgcacgccgactccaagctggtcagctgcaagcaggggtccggcaacatgaaggagtgcgtgaccaccgggcgggcgctgctccccgccgtgaaccccggccaggaggcctgcctgcacttcaccgccccgggcagccccgactccaagtgcctgaagatcaaggtcaagaagatcaacctcaagtgcaagaagtccagcagctacttcgtgcccgacgcccgcagccggtgcacgtccgtgcgccggtgccgctgggcgggggactgccagagcggctgcccgtcccacttcaccagcaactccttcagcgacgactgggccgggaagatggaccgggccggcctggggttctccggctgcagcgacggctgcgggggcgccgcgtgcgggtgcttcaacgccgccccctcctgcatcttctggcgcaagtgggtcgagaacccccacggcatcatctggaaggtgagcccctgcgccgcctgggtgccgtccgcggtcatcgagctgaccatgcccagcggggaggtgcggaccttccaccccatgtccggcatccccacccaggtgttcaagggcgtcagcgtgacctacctcgggtccgacatggaggtgagcggcctgaccgacctgtgcgagatcgaggagctgaagtccaagaagctcgccctggccccgtgcaaccaggccgggatgggcgtcgtgggcaaggtgggggagatccagtgcagcagcgaggagtccgcccgcaccatcaagaaggacggctgcatctggaacgcggacctggtcgggatcgagctccgggtggacgacgccgtgtgctacagcaagatcacgtccgtcgaggccgtggccaactacagcgccatccccaccaccatcggcgggctgcgcttcgagcggtcccacgacagccagggcaagatctccggcagccccctggacatcaccgcgatccgcgggtccttcagcgtgaactaccggggcctccgcctgtccctgagcgagatcacggccacgtgcaccggggaggtcaccaacgtgtccggctgctacagctgcatgaccggggccaaggtgtccatcaagctccacagcaacaagaactccacggcccacgtccggtgcaagggcgacgagaccgcgttcagcgtgctggagggcgtgcactcctacaccgtcagcctgagcttcgaccacgccgtggtggacgagcagtgccagctcaactgcgggggccacgagtcccaggtcaccctgaaggggaacctgatcttcctcgacgtgcccaagttcgtggacggcagctacatgcagacgtaccactccagcgtcccgaccggggccaacatcccctcccccaccgactggctgaacgccctgttcggcaacggcctcagccgctggatcctgggggtgatcggcgtcctgctcgggggcctggccctgttcttcctcatcatgtccctgttcaagctgggcaccaagcaggtcttccgcagccggacgaagctcgcgtga

SEQ ID NO: 13196 - RNA, 3222 nt, synthetic construct
  misc_feature 1..3222: note = derived and/or modified CDS sequence (opt1) from SFTSV(SPL100A)__AB985313.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccgacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaagcaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcgtgaacgggggcgtccggctgatcaccctgacctccgagctcaagagcgcgacggtgtgcgcctcccacttctgcagctccgccaccagcgggaagaagtccaccgagatccagttccacagcggctccctggtcggcaagaccgccatccacgtgaagggggccctgctcgacggcacggagttcaccttcgaggggagctgcatgttccccgacggctgcgacgcggtggactgcaccttctgccgcgagttcctgaagaacccccagtgctaccccgccaagaagtggctgttcatcatcatcgtcatcctcctgggctacgccgggctgatgctcctgaccaacgtgctgaaggccatcgccgtgtggggctcctgggtcatcgcgcccgtgaagctcatgttcgccatcatcaagaagctgatgcggagcgtgtcctgcctgatggggaagctcatggaccgcggccggcaggtcatccacgaggagatcggggagaaccgcgagggcaaccaggacgacgtgcggatcgagatggcccgcccccgccgggtgcgccactggatgtacagcccggtcatcctgacggtgctggccgtgggcctcgccgaggggtgcgacgagatggtccacgcggactccaagctggtgagctgcaagcagggctccgggaacatgaaggagtgcgtgaccaccggccgggccctgctccccgccgtcaaccccgggcaggaggcctgcctgcacttcaccgcccccggcagcccggacagcaagtgcctgaagatcaaggtgaagaagatcaacctcaagtgcaagaagtccagctcctacttcgtgcccgacgcgcgcagccggtgcacgtccgtccgccggtgccgctgggccggcgactgccagagcgggtgcccctcccacttcaccagcaactccttcagcgacgactgggccggcaagatggaccgggccgggctgggcttctccgggtgcagcgacggctgcggcggggcggcctgcggctgcttcaacgccgccccgtcctgcatcttctggcgcaagtgggtggagaacccccacgggatcatctggaaggtgagcccctgcgccgcgtgggtcccctccgccgtgatcgagctgaccatgccgagcggcgaggtgcggaccttccaccccatgtccgggatccccacgcaggtcttcaagggcgtgagcgtgacctacctcggctccgacatggaggtcagcgggctgaccgacctgtgcgagatcgaggagctcaagagcaagaagctggccctggccccctgcaaccaggccggcatgggggtggtgggcaaggtcggcgagatccagtgctccagcgaggagtccgcgcgcaccatcaagaaggacgggtgcatctggaacgccgacctggtgggcatcgagctccgggtggacgacgccgtctgctacagcaagatcacgtccgtggaggccgtggccaactacagcgcgatcccgaccaccatcgggggcctgcgcttcgagcggtcccacgacagccaggggaagatctccggcagccccctggacatcaccgccatccgcggctccttcagcgtcaactaccgggggctccgcctgtccctgagcgagatcacggcgacctgcaccggcgaggtgaccaacgtgtccgggtgctacagctgcatgaccggcgccaaggtctccatcaagctccacagcaacaagaactccacggcccacgtgcggtgcaagggggacgagaccgccttcagcgtgctggagggcgtccacagctacaccgtgtccctgagcttcgaccacgccgtggtcgacgagcagtgccagctcaactgcggcgggcacgagtcccaggtgaccctgaagggcaacctgatcttcctcgacgtgcccaagttcgtcgacgggagctacatgcagacgtaccactccagcgtgcccaccggcgccaacatcccgtcccccaccgactggctgaacgccctgttcgggaacggcctcagccgctggatcctgggcgtcatcggggtgctgctcggcgggctggcgctgttcttcctcatcatgtccctgttcaagctgggcaccaagcaggtcttccgcagccggacgaagctcgcctga

SEQ ID NO: 13197 - RNA, 3222 nt, synthetic construct
  misc_feature 1..3222: note = derived and/or modified CDS sequence (opt1) from SFTSV(SPL106A)__AB985316.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaagaccgccatccacgtcaagggggccctggtggacggcacggagttcaccttcgaggggagctgcatgttccccgacggctgcgacgcggtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcccccgtgaagctgatgttcgcgatcctcaagaagctgatgcggagcgtgtcctgcctgatgggcaagctcatggaccgcgggcggcaggtcatccacgaggagatcggcgagaaccgcgagggcaaccaggacgacgtgcggatcgagatggcccgcccccgccgggtgcgccactggatgtacagcccggtcatcctgacgatcctggccatcgggctcgccgagggctgcgacgaggtggtgcacgccgactccaagctggtcagctgcaagcaggggtccggcaacatgaaggagtgcgtgaccaccgggcgggcgctgctccccgccgtgaaccccggccaggaggcctgcctgcacttcaccgcccccggcagcccggacagcaagtgcctgaagatcaaggtcaagcgcatcaacctcaagtgcaagaagtccagctcctacttcgtgcccgacgcccggagccgctgcacgtccgtgcggcgctgccggtgggcgggggactgccagagcggctgcccctcccacttcaccagcaactccttcagcgacgactgggccgggaagatggaccgcgccggcctggggttctccggctgcagcgacggctgcgggggcgccgcgtgcgggtgcttcaacgccgccccgtcctgcatcttctggcggaagtgggtcgagaacccccacggcatcatctggaaggtgagcccctgcgccgcctgggtgccctccgcggtcatcgagctgaccatgccgagcggggaggtgcgcaccttccaccccatgtccggcatccccacccaggtgttcaagggcgtcagcgtgacctacctcgggtccgacatggaggtgagcggcctgaccgacctgtgcgagatcgaggagctcaagagcaagaagctggccctggccccctgcaaccaggccgggatgggcgtcgtgggcaaggtgggggagatccagtgctccagcgaggagtccgcccggaccatcaagaaggacggctgcatctggaacgcggacctggtcgggatcgagctccgcgtggacgacgccgtgtgctacagcaagatcacgtccgtcgaggccgtggccaactacagcgccatcccgaccaccatcggcgggctgcggttcgagcgctcccacgacagccagggcaagatctccggcagccccctggacatcaccgcgatccgggggtccttcagcgtgaactaccgcggcctccggctgtccctgagcgagatcacggccacgtgcaccggggaggtcaccaacgtgtccggctgctacagctgcatgatcggggccaaggtgtccatcaagctccacagctccaagaacagcaccgcccacgtccgctgcaagggcgacgagacggcgttcagcgtgctggagggcgtgcactcctacaccgtcagcctgtccttcgaccacgccgtggtggacgagcagtgccagctcaactgcgggggccacgagagccaggtcaccctgaaggggaacctgatcttcctcgacgtgcccaagttcgtggacggctcctacatgcagacctaccacagctccgtccccacgggggccaacatcccgagccccaccgactggctgaacgccctgttcggcaacggcctctcccgctggatcctgggggtgatcggcgtcctgctcgggggcctggccctgttcagcctcatcatgtccctgttcaagctgggcaccaagcaggtcctccggagccgcaccaagctggcgtga

SEQ ID NO: 13198 - RNA, 3222 nt, synthetic construct
  misc_feature 1..3222: note = derived and/or modified CDS sequence (opt1) from SFTSV(SPL117A)__AB985321.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctaccgggggaaggtgttcttcgagcgccccaccttcgacggctacgtgggctgggggtgcggctccggcaagagccggacggagtccggggagctctgcagcagcgactccggcaccagctccgggctgctgcccagcgaccgcgtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgggagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgcgtccggccgaagtgctacggcttcagccgcatgatggccacgctggaggtgaacccgcccgagcagcggatcgggcagtgcaccggctgccacctcgagtgcatcaacgggggcgtgcgcctgatcaccctgacctccgagctcaagagcgcgacggtctgcgcctcccacttctgcagctccgccaccagcgggaagaagtccaccgagatccagttccacagcggctccctggtgggcaagaccgccatccacgtcaagggggccctggtggacggcacggagttcaccttcgaggggagctgcatgttccccgacggctgcgacgcggtggactgcaccttctgccgggagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcccccgtgaagctgatgttcgcgatcatcaagaagctcatgcgcagcgtgtcctgcctgatgggcaagctgatggaccgggggcgccaggtcatccacgaggagatcggcgagaaccgggagggcaaccaggacgacgtgcgcatcgagatggcccgcccccggcgcgtgcggcactggatgtacagcccggtcatcctcacgatcctggccatcgggctggccgagggctgcgacgagatggtgcacgccgactccaagctcgtgagctgcaagcaggggtccggcaacatgaaggagtgcgtcaccaccgggcgcgcgctgctgcccgccgtgaaccccggccaggaggcctgcctccacttcaccgcccccggcagcccggacagcaagtgcctgaagatcaaggtgaagcggatcaacctgaagtgcaagaagtccagctcctacttcgtccccgacgcccgcagccggtgcacgtccgtgcgccggtgccgctgggcgggggactgccagagcggctgcccctcccacttcaccagcaactccttcagcgacgactgggccgggaagatggaccgggccggcctcgggttctccggctgcagcgacggctgcgggggcgccgcgtgcgggtgcttcaacgccgccccgtcctgcatcttctggcgcaagtgggtggagaacccccacggcatcatctggaaggtcagcccctgcgccgcctgggtgccctccgcggtgatcgagctgaccatgccgagcggggaggtccggaccttccaccccatgtccggcatccccacccaggtgttcaagggcgtgagcgtcacctacctggggtccgacatggaggtgagcggcctcaccgacctgtgcgagatcgaggagctcaagagcaagaagctggccctggccccctgcaaccaggccgggatgggcgtggtcggcaaggtgggggagatccagtgctccagcgaggagtccgcccgcaccatcaagaaggacggctgcatctggaacgcggacctggtggggatcgagctgcgggtcgacgacgccgtgtgctacagcaagatcacgtccgtggaggccgtcgccaactacagcgccatcccgaccaccatcggcgggctccgcttcgagcggtcccacgacagccagggcaagatctccggcagccccctggacatcaccgcgatccgcgggtccttcagcgtgaactaccggggcctgcgcctctccctgagcgagatcacggccacgtgcaccggggaggtgaccaacgtctccggctgctacagctgcatgaccggggccaaggtgtccatcaagctgcacagctccaagaacagcacggcccacgtgcgctgcaagggcgacgagaccgcgttcagcgtcctcgagggcgtgcactcctacaccgtgagcctgtccttcgaccacgccgtcgtggacgagcagtgccagctgaactgcgggggccacgagagccaggtgaccctcaaggggaacctgatcttcctggacgtccccaagttcgtggacggctcctacatgcagacgtaccacagctccgtgcccaccggggccaacatcccgagccccaccgactggctcaacgccctgttcggcaacggcctgtcccggtggatcctcggggtcatcggcgtgctgctcgggggcctggccctgttcttcctgatcatgagcctcttcaagctgggcaccaagcaggtcttccgctcccggacgaagctggcgtga

SEQ ID NO: 13199 - RNA, 3222 nt, synthetic construct
  misc_feature 1..3222: note = derived and/or modified CDS sequence (opt1) from SFTSV(SPL120A)__AB985322.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaagaccgccatccacgtcaagggggccctggtggacggcacggagttcaccttcgaggggagctgcatgttccccgacggctgcgacgcggtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggtcctgggtcatcgcccccgtgaagctgatgttcgcgatcctcaagaagctgatgcggagcgtgtcctgcctgatgggcaagctcatggaccgcgggcggcaggtcatccacgaggagatcggcgagaaccgcgagggcaaccaggacgacgtgcggatcgagatggcccgcccccgccgggtgcgccactggatgtacagcccggtcatcctgacgatcctggccatcgggctcgccgagggctgcgacgaggtggtgcacgccgactccaagctggtcagctgcaagcaggggtccggcaacatgaaggagtgcgtgaccaccgggcgggcgctgctccccgccgtgaaccccggccaggaggcctgcctgcacttcaccgcccccggcagcccggacagcaagtgcctgaagatcaaggtcaagcgcatcaacctcaagtgcaagaagtccagctcctacttcgtgcccgacgcccggagccgctgcacgtccgtgcggcgctgccggtgggcgggggactgccagagcggctgcccctcccacttcaccagcaactccttcagcgacgactgggccgggaagatggaccgcgccggcctggggttctccggctgcagcgacggctgcgggggcgccgcgtgcgggtgcttcaacgccgccccgtcctgcatcttctggcggaagtgggtcgagaacccccacggcatcatctggaaggtgagcccctgcgccgcctgggtgccctccgcggtcatcgagctgaccatgccgagcggggaggtgcgcaccttccaccccatgtccggcatccccacccaggtgttcaagggcgtcagcgtgacctacctcgggtccgacatggaggtgagcggcctgaccgacctgtgcgagatcgaggagctcaagagcaagaagctggccctggccccctgcaaccaggccgggatgggcgtcgtgggcaaggtgggggagatccagtgctccagcgaggagtccgcccggaccatcaagaaggacggctgcatctggaacgcggacctggtcgggatcgagctccgcgtggacgacgccgtgtgctacagcaagatcacgtccgtcgaggccgtggccaactacagcgccatcccgaccaccatcggcgggctgcggttcgagcgctcccacgacagccagggcaagatctccggcagccccctggacatcaccgcgatccgggggtccttcagcgtgaactaccgcggcctccggctgtccctgagcgagatcacggccacgtgcaccggggaggtcaccaacgtgtccggctgctacagctgcatgaccggggccaaggtgtccatcaagctccacagctccaagaacagcacggcccacgtccgctgcaagggcgacgagaccgcgttcagcgtgctggagggcgtgcactcctacaccgtcagcctgtccttcgaccacgccgtggtggacgagcagtgccagctcaactgcgggggccacgagagccaggtcaccctgaaggggaacctgatcttcctcgacgtgcccaagttcgtggacggctcctacatgcagacgtaccacagctccgtccccaccggggccaacatcccgagccccaccgactggctgaacgccctgttcggcaacggcctctcccgctggatcctgggggtgatcggcgtcctgctcgggggcctggccctgttcagcctcatcatgtccctgttcaagctgggcaccaagcaggtcttccggagccgcacgaagctcgcgtga

SEQ ID NO: 13200 - RNA, 3222 nt, synthetic construct
  misc_feature 1..3222: note = derived and/or modified CDS sequence (opt1) from SFTSV(SPL121A)__AB985323.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagccccaaggacttcgtctgctacaaggaggggaccggcccctgctccgagagcgaggagaagacctgcaagacctccggcagctgccgcggggacatgcagttctgcaaggtggcgggctgcgagcacggggaggaggcctccgaggccaagtgccggtgcagcctggtgcacaagccgggcgaggtcgtggtgtcctacgggggcatgcgggtccgccccaagtgctacggcttcagccggatgatggccacgctggaggtgaacagccccgagcagcgcatcgggcagtgcaccggctgccacctcgagtgcatcaacgggggcgtgcggctgatcaccctgacctccgagctcaagagcgcgacggtctgcgcctcccacttctgcagctccgccaccagcgggaagaagtccaccgagatccagttccacagcggctccctggtgggcaagaccgccatccacgtcaagggggccctggtggacggcacggagttcaccttcgaggggagctgcatgttccccgacggctgcgacgcggtggactgcaccttctgccgcgagttcctcaagaacccgcagtgctaccccgccaagaagtggctgttcatcatcatcgtcatcctgctcggctacgccgggctgatgctgctcaccaacgtgctgaaggccatcggcgtgtgggggtcctgggtcatcgcccccgtgaagctgatgttcgcgatcatcaagaagctcatgcggagcgtgtcctgcctgatgggcaagctgatggaccgcgggcggcaggtcatccacgaggagatcggcgagaaccgcgagggcaaccaggacgacgtgcggatcgagatggcccgcccccgccgggtgcgccactggatgtacagcccggtcatcctcacgatcctggccatcgggctggccgagggctgcgacgagatggtgcacgccgactccaagctcgtgagctgcaagcaggggtccggcaacatgaaggagtgcgtcaccaccgggcgggcgctgctgcccgccgtgaaccccggccaggaggcctgcctccacttcaccgcccccggcagcccggacagcaagtgcctgaaggtgaaggtcaagcgcatcaacctgaagtgcaagaagtccagctcctacttcgtgcccgacgcccggagccgctgcacgtccgtgcggcgctgccggtgggcgggggactgccagagcggctgcccctcccacttcaccagcaactccttcagcgacgactgggccgggaagatggaccgcgccggcctcgggttctccggctgcagcgacggctgcgggggcgccgcgtgcgggtgcttcaacgccgccccgtcctgcatcttctggcggaagtgggtcgagaacccccacggcatcatctggaaggtgagcccctgcgccgcctgggtgccctccgcggtcatcgagctgaccatgccgagcggggaggtgcgcaccttccaccccatgtccggcatccccacccaggtgttcaagggcgtcagcgtgacctacctggggtccgacatggaggtgagcggcctcaccgacctgtgcgagatggaggagctcaagagcaagaagctggccctggccccctgcaaccaggccgggatgggcgtcgtgggcaaggtgggggagatccagtgctccagcgaggagtccgcccggaccatcaagaaggacggctgcatctggaacgcggacctggtcgggatcgagctgcgcgtggacgacgccgtgtgctacagcaagatcacgtccgtcgaggccgtggccaactacagcgccatcccgaccaccatcggcgggctccggttcgagcgctcccacgacagccagggcaagatctccggcagccccctggacatcaccgcgatccgggggtccttcagcgtgaactaccgcggcctgcggctctccctgagcgagatcacggccacgtgcaccggggaggtcaccaacgtgtccggctgctacagctgcatgaccggggcccgcgtgtccatcaagctgcacagctccaagaacagcacggcccacgtccgctgcaagggcgacgagaccgcgttcagcgtgctcgagggcgtgcactcctacaccgtcagcctgtccttcgaccacgccgtggtggacgagcagtgccagctgaactgcgggggccacgagagccaggtcaccctcaaggggaacctgatcttcctggacgtgcccaagttcgtggacggctcctacatgcagacgtaccacagctccgtccccaccggggccaacatcccgagccccaccgactggctcaacgccctgttcggcaacggcctgtcccggtggatcctcggggtgatcggcgtcctgctcgggggcctggccctgttcttcctgatcatgagcctcttcaagctgggcaccaagcaggtcttccgctcccggacgaagctggcgtga

SEQ ID NO: 13201 - RNA, 3222 nt, synthetic construct
  misc_feature 1..3222: note = derived and/or modified CDS sequence (opt1) from SFTSV(SPL124A)__AB985324.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaactcccccgagcagcgcatcgggcagtgcaccggctgccacctcgagtgcatcaacgggggcgtgcggctgatcaccctgaccagcgagctcaagtccgcgacggtctgcgccagccacttctgctccagcgccacctccgggaagaagtccaccgagatccagttccacagcggcagcctggtgggcaagaccgccatccacgtcaagggggccctggtggacggcacggagttcaccttcgaggggtcctgcatgttccccgacggctgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggagctgggtcatcgcccccgtgaagctgatgttcgcgatcatcaagaagctcatgcggtccgtgagctgcctgatgggcaagctgatggaccgcgggcggcaggtcatccacgaggagatcggcgagaaccgcgagggcaaccaggacgacgtgcggatcgagatggcccgcccccgccgggtgcgccactggatgtactcccccgtcatcctcacgatcctggccatcgggctggccgagggctgcgacgagatggtgcacgccgacagcaagctcgtgtcctgcaagcaggggagcggcaacatgaaggagtgcgtcaccaccgggcgggcgctgctgccggccgtgaaccccggccaggaggcctgcctccacttcaccgcccccggcagccccgactccaagtgcctgaagatccgcgtgaagcggatcaacctgaagtgcaagaagtccagcagctacttcgtcccggacgcccgctcccggtgcacgagcgtgcgccggtgccgctgggcgggggactgccagtccggctgccccagccacttcacctccaacagcttctccgacgactgggccgggaagatggaccgggccggcctcgggttcagcggctgctccgacggctgcgggggcgccgcgtgcgggtgcttcaacgccgcccccagctgcatcttctggcgcaagtgggtggagaacccgcacggcatcatctggaaggtctccccctgcgccgcctgggtgcccagcgcggtgatcgagctgaccatgccctccggggaggtccggaccttccacccgatgagcggcatccccacccaggtgttcaagggcgtgtccgtcacctacctggggagcgacatggaggtgagcggcctcaccgacctgtgcgagatcgaggagctgaagtccaagaagctggccctcgccccctgcaaccaggccgggatgggcgtggtcggcaaggtgggggagatccagtgcagctccgaggagagcgcccgcaccatcaagaaggacggctgcatctggaacgcggacctggtggggatcgagctgcgggtcgacgacgccgtgtgctactccaagatcacgagcgtggaggccgtcgccaactactccgccatccccaccaccatcggcgggctccgcttcgagcggagccacgactcccagggcaagatcagcggctccccgctggacatcaccgcgatccgcgggagcttctccgtgaactaccggggcctgcgcctcagcctgtccgagatcacggccacgtgcaccggggaggtgaccaacgtcagcggctgctactcctgcatgaccggggcccgcgtgagcatcaagctgcactccagcaagaacagcacggcccacgtgcggtgcaagggcgacgagaccgcgttctccgtcctcgagggcgtgcacagctacaccgtgtccctgagcttcgaccacgccgtcgtggacgagcagtgccagctgaactgcgggggccacgagtcccaggtgaccctcaaggggaacctgatcttcctggacgtccccaagttcgtggacggcagctacatgcagacgtaccactccagcgtgcccaccggggccaacatcccctccccgaccgactggctcaacgccctgttcggcaacggcctgagccgctggatcctcggggtcatcggcgtgctgctcgggggcctggccctgttcttcctgatcatctccctcttcaagctgggcaccaagcaggtcttccggagccgcacgaagctggcgtga

SEQ ID NO: 13202 - RNA, 3222 nt, synthetic construct
  misc_feature 1..3222: note = derived and/or modified CDS sequence (opt1) from SFTSV(SPL128A)__AB985325.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaactcccccgagcagcgcatcgggcagtgcaccggctgccacctcgagtgcatcaacgggggcgtgcggctgatcaccctgaccagcgagctcaagtccgcgacggtctgcgccagccacttctgctccagcgccacctccgggaagaagtccaccgagatccagttccacagcggcagcctggtgggcaagaccgccatccacgtcaagggggccctggtggacggcacggagttcaccttcgaggggtcctgcatgttccccgacggctgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggagctgggtcatcgcccccgtgaagctgatgttcgcgatcatcaagaagctcatgcggtccgtgagctgcctgatgggcaagctgatggaccgcgggcggcaggtcatccacgaggagatcggcgagaaccgcgagggcaaccaggacgacgtgcggatcgagatggcccgcccccgccgggtgcgccactggatgtactcccccgtcatcctcacgatcctggccatcgggctggccgagggctgcgacgagatggtgcacgccgacagcaagctcgtgtcctgcaagcaggggagcggcaacatgaaggagtgcgtcaccaccgggcgggcgctgctgccggccgtgaaccccggccaggaggcctgcctccacttcaccgcccccggcagccccgactccaagtgcctgaagatccgcgtgaagcggatcaacctgaagtgcaagaagtccagcagctacttcgtcccggacgcccgctcccggtgcacgagcgtgcgccggtgccgctgggcgggggactgccagtccggctgccccagccacttcacctccaacagcttctccgacgactgggccgggaagatggaccgggccggcctcgggttcagcggctgctccgacggctgcgggggcgccgcgtgcgggtgcttcaacgccgcccccagctgcatcttctggcgcaagtgggtggagaacccgcacggcatcatctggaaggtctccccctgcgccgcctgggtgcccagcgcggtgatcgagctgaccatgccctccggggaggtccggaccttccacccgatgagcggcatccccacccaggtgttcaagggcgtgtccgtcacctacctggggagcgacatggaggtgagcggcctcaccgacctgtgcgagatcgaggagctgaagtccaagaagctggccctcgccccctgcaaccaggccgggatgggcgtggtcggcaaggtgggggagatccagtgcagctccgaggagagcgcccgcaccatcaagaaggacggctgcatctggaacgcggacctggtggggatcgagctgcgggtcgacgacgccgtgtgctactccaagatcacgagcgtggaggccgtcgccaactactccgccatccccaccaccatcggcgggctccgcttcgagcggagccacgactcccagggcaagatcagcggctccccgctggacatcaccgcgatccgcgggagcttctccgtgaactaccggggcctgcgcctcagcctgtccgagatcacggccacgtgcaccggggaggtgaccaacgtcagcggctgctactcctgcatgaccggggcccgcgtgagcatcaagctgcactccagcaagaacagcacggcccacgtgcggtgcaagggcgacgagaccgcgttctccgtcctcgagggcgtgcacagctacaccgtgtccctgagcttcgaccacgccgtcgtggacgagcagtgccagctgaactgcgggggccacgagtcccaggtgaccctcaaggggaacctgatcttcctggacgtccccaagttcgtggacggcagctacatgcagacgtaccactccagcgtgcccaccggggccaacatcccctccccgaccgactggctcaacgccctgttcggcaacggcctgagccgctggatcctcggggccatcggcgtcctgctcgggggcctggcgctgttcttcctgatcatctccctcttcaagctgggcaccaagcaggtcttccggagccgcacgaagctggcctga

SEQ ID NO: 13203 - RNA, 3222 nt, synthetic construct
  misc_feature 1..3222: note = derived and/or modified CDS sequence (opt1) from SFTSV(SPL129A)__AB985326.1__GP
  source 1..3222: mol_type = other RNA
atgatgaaggtgatctggttcagctccctgatctgcctcgtcatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctactaccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacgggggcatgcgggtccgcccgaagtgctacggcttcagccggatgatggccacgctggaggtgaacccgcccgagcagcgcatcgggcagtgcaccggctgccacctcgagtgcatctccgggggcgtgcggctgatcaccctgaccagcgagctcaagtccgcgacggtctgcgccagccacttctgctccagcgccacctccgggaagaagtccaccgagatccagttccactccggcagcctggtgggcaaggccgccatccacgtcaagggggcgctggtggacggcaccgagttcacgttcgaggggtcctgcatgttccccgacggctgcgacgccgtggactgcaccttctgccgcgagttcctcaagaacccccagtgctaccccgccaagaagtggctgttcatcatcatcgtcatcctgctcggctacgccgggctgatgctgctcaccaacgtgctgaaggccatcggcgtgtgggggagctgggtcatcgcgcccgtgaagctgatgttcgccatcatgaagaagctcatgcggtccgtgagctgcctgatgggcaagctgatggaccgcgggcggcaggtcatccacgaggagatcggcgagaaccgcgagggcaaccgggacgacgtgcgcatcgagatggcccgcccccggcgcgtgcggcactggatgtactccccggtcatcctcaccatcctggccatcgggctggccgagggctgcgacgagatggtgcacgcggacagcaagctcgtgtcctgccgccaggggagcggcaacatgaaggagtgcgtcacgaccgggcgggccctgctgcccgccgtgaaccccggccaggaggcctgcctccacttcaccgcccccggcagcccggactccaagtgcctgaagatcaaggtgaagcgcatcaacctgaagtgcaagaagtccagcagctacttcgtccccgacgcgcggtcccgctgcaccagcgtgcggcgctgccggtgggccggggactgccagtccggctgccccagccacttcacgtccaacagcttctccgacgactgggccgggaagatggaccgcgccggcctcgggttcagcggctgctccgacggctgcgggggcgcggcctgcgggtgcttcaacgccgccccgagctgcatcttctggcggaagtgggtggagaacccccacggcatcatctggaaggtctccccctgcgccgcgtgggtgcccagcgccgtgatcgagctgaccatgccgtccggggaggtccgcaccttccaccccatgagcggcatccccacccaggtgttcaagggcgtgtccgtcacgtacctggggagcgacatggaggtgagcggcctcaccgacctgtgcgagatcgaggagctgaagtccaagaagctggccctcgccccctgcaaccaggccgggatgggcgtggtcggcaaggtgggggagatccagtgcagctccgaggagagcgcgcggaccatcaagaaggacggctgcatctggaacgccgacctggtggggatcgagctgcgcgtcgacgacgccgtgtgctactccaagatcaccagcgtggagacggtcgccaactactccgccatcccgaccaccatcggcgggctccggttcgagcgcagccacgactcccagggcaagatcagcggcagccccctggacatcaccgcgatccgggggagcttctccgtgaactaccgcggcctgcgcctcagcctgtccgagatcacggcgacctgcaccggggaggtgaccaacgtcagcggctgctactcctgcatgaccggggccaaggtgagcatcaagctgcactccagcaagaacagcacggcccacgtgcggtgcaaggaggacgagaccgccttctccgtcctcgagggcgtgcacagctacaccgtgtccctgagcttcgaccacgccgtcgtggacgagcagtgccagctgaactgcggcgggcacgagtcccacgtgaccctcaagggcaacctgatcttcctggacgtccccaagttcgtggacgggagctacatgcagacgtaccactccagcgtgcccaccggcgccaacatcccgtcccccaccgactggctcaacgccctgttcgggaacggcctgagccgctggatcctcggcgtcatgggggtgctgctgggcgggctcgccctgttcttcctgatcatgtccctcttcaagctgggcaccaagcaggtcttccggagccgcacgaagctggcgtga

SEQ ID NO: 13204 - RNA, 3222 nt, synthetic construct
  misc_feature 1..3222: note = derived and/or modified CDS sequence (opt1) from SFTSV(YG1)__AB817987.1__GP
  source 1..3222: mol_type = other RNA
atgatgaaggtgatctggttcagctccctgatctgcctcgtgatccagtgcagcggcgacaccgggcccatcatctgcgccggcccgatccactccaacaagagcgccaacatcccccacctcctggggtactccgagaagatctgccagatcgaccgcctgatccacgtgagctcctggctgcggaaccacagccagttccagggctacgtggggcagcgcggcggccggtcccaggtcagctacttccccgcggagaactcctacagccgctggtccgggctgctcagcccctgcgacgccgactggctgggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctctgcagcagcgactccggcaccagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagagcgagtccctcccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcggctcctgccgcggggacatgcagttctgcaaggtggcgggctgcgagcacggggaggagacgagcgaggccaagtgccggtgctccctggtgcacaagcccggcgaggtcgtggtgagctacgggggcatgcgggtccgcccgaagtgctacggcttcagccggatgatggccaccctggaggtgaacccgcccgagcagcgcatcgggcagtgcaccggctgccacctcgagtgcatcaacgggggcgtgcggctgatcaccctgacgtccgagctcaagagcgccaccgtctgcgcgtcccacttctgcagctccgccaccagcgggaagaagtccaccgagatccagttccacagcggctccctggtgggcaagacggccatccacgtcaagggggccctggtggacggcaccgagttcaccttcgaggggagctgcatgttccccgacggctgcgacgccgtggactgcaccttctgccgcgagttcctcaagaacccccagtgctaccccgcgaagaagtggctgttcatcatcatcgtcatcctgctcggctacgccgggctgatgctgctcacgaacgtgctgaaggccatcggcatctgggggtcctgggtgatcgcccccgtcaagctgatgttcgccatcatcaagaagctcatgcggagcgtgtcctgcctgatgggcaagctgatggaccgcgggcgccaggtgatccacgaggagatcggcgagaaccgggagggcaaccaggaggacgtccggatcgagatggcgcgcccccgccgggtgcgccactggatgtacagcccggtgatcctcgccatcctggccatcgggctggccgagggctgcgacgagatggtccacgccgactccaagctcgtgagctgcaagcaggggtccggcaacatgaaggagtgcgtgaccaccgggcgggcgctgctgcccgccgtcaaccccggccaggaggcctgcctccacttcaccgcccccggcagcccggacagcaagtgcctgaagatcaaggtgaagcgcatcaacctgaagtgcaagaagtccagctcctacttcgtgcccgacgcccggagccgctgcacgtccgtccggcgctgccggtgggcgggggactgccagagcggctgcccctcccacttcaccagcaactccttcagcgacgactgggccgggaagatggaccgcgccggcctcgggttctccggctgcagcgacggctgcgggggcgccgcgtgcgggtgcttcaacgccgccccgtcctgcatcttctggcggaagtgggtggagaacccccacggcatcatctggaaggtgagcccctgcgccgcctgggtcccctccgcggtgatcgagctgaccatgccgagcggggaggtgcgcaccttccaccccatgtccggcatccccacgcaggtcttcaagggcgtgagcgtgacctacctggggtccgacatggaggtcagcggcctcaccgacctgtgcgagatcgaggagctcaagagcaagaagctggccctggccccctgcaaccaggccgggatgggcgtggtgggcaaggtcggggagatccagtgctccagcgaggagtccgcccggaccatcaagaaggacggctgcatctggaacgcggacctggtggggatcgagctgcgcgtggacgacgccgtctgctacagcaagatcacgtccgtggaggccgtggccaactacagcgccatcccgaccaccatcggcgggctccggttcgagcgctcccacgacagccagggcaagatctccggcagccccctggacatcaccgcgatccgggggtccttcagcgtcaactaccgcggcctgcggctctccctgagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttcagcgtgctcgagggcgtccactcctacaccgtgagcctgtccttcgaccacgccgtggtcgacgagcagtgccagctgaactgcgggggccacgagagccaggtgaccctcaaggggaacctgatcttcctggacgtgcccaagttcgtcgacggctcctacatgcagacgtaccacagctccgtgcccaccggggccaacatcccgagccccaccgactggctcaacgccctgttcggcaacggcctgtcccgctggatcctcggggtgatcggcgtcctgctcgggggcctggccctgttcttcctgatcatgagcctcttcaagctgggcaccaagcaggtcttccggtcccgcacgaagctggcgtga

SEQ ID NO: 13205 - RNA, 3222 nt, synthetic construct
  misc_feature 1..3222: note = derived and/or modified CDS sequence (opt1) from SFTSV(SDTA_1)__KX641913.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggcccgggagagcgacatgatcgtcccgggcccctcctacaaggggaaggtgttcttcgagcgccccaccttcgacggctacgtgggctgggggtgcggcagcgggaagtcccggaccgagagcggcgagctctgcagctccgacagcggcacgtccagcgggctgctgccctccgaccgcgtcctctggatcggcgacgtggcctgccagctgatgaccccgatccccgaggagaccttcctggagctcaagagcttctcccagagcgagttccccgacatctgcaagatcgacgggatcgtgttcaaccagtgcgagggcgagtccctgccccagccgttcgacgtcgcctggatggacgtggggcacagccacaagatcatcatgcgggagcacaagaccaagtgggtgcaggagtccagctccaaggacttcgtctgctacaaggagggcacgggcccctgcagcgagtccgaggagaaggcgtgcaagaccagcgggtcctgccgcggcgacatgcagttctgcaaggtggccgggtgcgagcacggcgaggagaccagcgaggccaagtgccggtgctccctggtgcacaagcccggggaggtcgtggtgagctacggcggcatgcgcgtccggcccaagtgctacgggttcagccgcatgatggccaccctcgaggtgaacccgcccgagcagcggatcggccagtgcacggggtgccacctggagtgcatcaacggcggggtgcgcctgatcaccctcacctccgagctgcggagcgcgaccgtctgcgcctcccacttctgcagctccgccagctccggcaagaagtccacggagatccacttccactccggcagcctggtggggaagaccgccatccacgtcaagggcgccctcgtggacgggaccgagttcaccttcgagggctcctgcatgttccccgacggctgcgacgcggtggactgcacgttctgccgcgagttcctgaagaacccccagtgctacccggccaagaagtggctgttcatcatcatcgtcatcctcctggggtacgccggcctgatgctcctgaccaacgtgctgaaggccatcggggtgtggggcagctgggtcatcgcccccgtgaagctcatgttcgcgatcatcaagaagctgatgcggaccgtgtcctgcctggtcgggaagctcatggaccgcggccgccaggtgatccacgaggagatcggcgagaacggggagggcaaccaggacgacgtgcggatcgagatcgcccgcccccggcgcgtccggcactggatgtacagccccgtgatcctgaccatcctggccatcgggctcgccgagggctgcgacgagatggtgcacgccgactccaagctggtcagctgccgccaggggtccggcaacatgaaggagtgcatcacgaccggccgggcgctgctcccggccgtgaaccccgggcaggaggcctgcctgcacttcaccgcccccggcagccccgacagcaagtgcctgaagatcaaggtgaagcgcatcaacctcaagtgcaagaagtccagctcctacttcgtcccggacgcccggagccgctgcacctccgtgcggcgctgccggtgggcgggggactgccagagcggctgcccgccccacttcacgtccaacagcttctccgacgactgggccgggaagatggaccgcgccggcctgggcttcagcgggtgctccgacggctgcgggggcgccgcgtgcgggtgcttcaacgccgcccccagctgcatcttctggcggaagtgggtggagaacccccacggcatcatctggaaggtctccccctgcgccgcctgggtgcccagcgcggtgatcgagctgaccatgccgtccggcgaggtccgcaccttccaccccatgagcgggatccccacccaggtgttcaagggcgtgtccgtcacgtacctcgggagcgacatggaggtgtccggcctgaccgacctgtgcgagatcgaggagctcaagagcaagaagctggccctggccccctgcaaccaggccggcatgggggtggtcggcaaggtgggggagatccagtgcagctccgaggagagcgcccggaccatcaagaaggacggctgcatctggaacgcggacctggtggggatcgagctccgcgtcgacgacgccgtgtgctactccaagatcaccagcgtggaggccgtcgccaactactccgccatcccgacgaccatcggcggcctgcggttcgagcgcagccacgactcccaggggaagatcagcggcagccccctggacatcaccgcgatccgggggagcttctccgtgaactaccgcggcctccgcctgagcctgtccgagatcaccgccacgtgcaccggggaggtgaccaacgtcagcggctgctactcctgcatgaccggcgccaaggtgagcatcaagctccactccagcaagaactccaccgcccacgtgcggtgcaagggggacgagacggcgttcagcgtcctggagggcgtgcacagctacatcgtgtccctgagcttcgaccacgccgtcgtggacgagcagtgccagctcaactgcgggggccacgagtcccaggtgaccctgaaggggaacctgatcttcctcgacgtccccaagttcgtggacggcagctacatgcagacctaccactccaccgtgcccacgggcgccaacatcccgagccccaccgactggctgaacgccctgttcgggaacggcctctcccgctggatcctgggggtcatcggcgtgctgctcggcgggctggccctgttcttcctcatcatgttcctgctgaagctcggcaccaagcaggtcttccggagccgcaccaagctggcgtga

SEQ ID NO: 13206 - RNA, 3222 nt, synthetic construct
  misc_feature 1..3222: note = derived and/or modified CDS sequence (opt1) from SFTSV(SDTA_2)__KX641914.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcatgcgggtccgcccgaagtgctacgggttcagccggatgatggcgaccctggaggtgaacccgcccgagcacatgatcggccagtgcaccgggtgccacctcgagtgcatcaacggcggggtgcgcctgatcacgctgacctccgagctccggagcgccaccgtctgcgcctcccacttctgcagctccgccagctccggcaagaagtccaccgagatccacttccactccggcagcctggtggggaagacggccatccacgtcaagggcgcgctggtggacgggaccgagttcaccttcgagggctcctgcatgttccccgacggctgcgacgccgtggactgcaccttctgccgcgagttcctcaagaacccccagtgctaccccgccaagaagtggctgttcatcatcatcgtcatcctgctcgggtacgccggcctgatgctgctcacgaacgtgctgaaggccatcggggtgtggggcagctgggtcatcgcgcccgtgaagctgatgttcgccatcatcaagaagctcatgcggaccgtgtcctgcctggtcgggaagctgatggaccgcggccgccaggtgatccacgaggagatcggcgagaacggggagggcaaccaggacgacgtgcggatcgagatggcccggccccgccgcgtccggcactggatgtacagcccggtgatcctcaccatcctggccatcgggctggccgagggctgcgacgagatggtgcacgcggactccaagctcgtcagctgccgccaggggtccggcaacatgaaggagtgcatcaccacgggccgggccctgctgcccgccgtgaaccccgggcaggaggcctgcctccacttcaccgcccccggcagcccggacagcaagtgcctgaagatcaaggtgaagcgcatcaacctgaagtgcaagaagtccagctcctacttcgtccccgacgcgcggagccgctgcacctccgtgcggcgctgccggtgggccggggactgccagagcggctgcccgccccacttcacctccaacagcttctccgacgactgggccgggaagatggaccgcgccggcctcggcttcagcgggtgctccgacggctgcgggggcgcggcctgcgggtgcttcaacgccgcccccagctgcatcttctggcggaagtgggtggagaacccccacggcatcatctggaaggtctccccctgcgccgcgtgggtgccgagcgccgtgatcgagctgacgatgccctccggcgaggtccgcaccttccaccccatgagcgggatccccacccaggtgttcaagggcgtgtccgtcacctacctggggagcgacatggaggtgtccggcctcacggacctgtgcgagatcgaggagctcaagagcaagaagctggccctggccccgtgcaaccaggccggcatgggggtggtcggcaaggtgggggagatccagtgcagctccgaggagagcgcgcggaccatcaagaaggacggctgcatctggaacgccgacctggtggggatcgagctgcgcgtcgacgacgccgtgtgctactccaagatcaccagcgtggaggccgtcgccaactactccgcgatccccaccacgatcggcggcctccggttcgagcgcagccacgactcccaggggaagatcagcggcagccccctggacatcaccgccatccgggggagcttctccgtgaactaccgcggcctgcggctcagcctgtccgagatcaccgcgacctgcacgggggaggtgaccaacgtcagcggctgctactcctgcatgaccggcgccaaggtgagcatcaagctgcactccagcaagaactccaccgcccacgtgcgctgcaagggggacgagaccgccttcagcgtcctcgagggcgtgcacagctacatcgtgtccctgagcttcgaccacgccgtcgtggacgagcagtgccagctgaactgcgggggccacgagtcccaggtgacgctcaaggggaacctgatcttcctggacgtccccaagttcgtggacggcagctacatgcagacctaccactccaccgtgccgaccggcgccaacatccccagccccacggactggctcaacgccctgttcgggaacggcctgtcccgctggatcctcggggtcatcggcgtgctgctgggcgggctcgcgctgttcttcctgatcatgttcctcctgaagctgggcaccaagcaggtcttccggagccgcaccaagctcgcctga

SEQ ID NO: 13207 - RNA, 3222 nt, synthetic construct
  misc_feature 1..3222: note = derived and/or modified CDS sequence (opt1) from SFTSV(SDTA_3)__KX641915.1__GP
  source 1..3222: mol_type = other RNA
atgatgaaggtgatctggttcagctccctgatctgcctcgtgatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcatgcgggtccgcccgaagtgctacgggttcagccggatgatggcgaccctggaggtgaacccgcccgagcagcgcatcggccagtgcaccgggtgccacctcgagtgcatcaacggcggggtgcggctgatcacgctgacctccgagctccgcagcgccaccgtctgcgcctcccacttctgcagctccgccagctccggcaagaagtccaccgagatccacttccactccggcagcctggtggggaagacggccatccacgtcaagggcgcgctggtggacgggaccgagttcaccttcgagggctcctgcatgttccccgacggctgcgacgccgtggactgcaccttctgccgggagttcctcaagaacccccagtgctaccccgccaagaagtggctgttcatcatcatcgtcatcctgctcgggtacgccggcctgatgctgctcacgaacgtgctgaaggccatcggggtgtggggcagctgggtcatcgcgcccgtgaagctgatgttcgccatcatcaagaagctcatgcgcaccgtgtcctgcctggtcgggaagctgatggaccggggccgccaggtgatccacgaggagatcggcgagaacggggagggcaaccaggacgacgtgcggatcgaggtcgcccgcccccgccgggtgcgccactggatgtacagcccggtgatcctcaccatcctggccatcgggctggccgagggctgcgacgagatggtccacgcggactccaagctcgtgagctgccggcaggggtccggcaacatgaaggagtgcatcaccacgggccgcgccctgctgcccgccgtgaaccccgggcaggaggcctgcctccacttcaccgcccccggcagcccggacagcaagtgcctgaagatcaaggtcaagcggatcaacctgaagtgcaagaagtccagctcctacttcgtgcccgacgcgcgcagccggtgcacctccgtgcgccggtgccgctgggccggggactgccagagcggctgcccgccccacttcacctccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtcgagaacccccacggcatcatctggaaggtgtccccctgcgccgcgtgggtgccgagcgccgtcatcgagctgacgatgccctccggcgaggtgcggaccttccaccccatgagcgggatccccacccaggtgttcaagggcgtctccgtgacctacctggggagcgacatggaggtgtccggcctcacggacctgtgcgagatcgaggagctcaagagcaagaagctggccctggccccgtgcaaccaggccggcatgggggtcgtgggcaaggtgggggagatccagtgcagctccgaggagagcgcgcgcaccatcaagaaggacggctgcatctggaacgccgacctggtcgggatcgagctgcgggtggacgacgccgtgtgctactccaagatcaccagcgtcgaggccgtggccaactactccgcgatccccaccacgatcggcggcctccgcttcgagcggagccacgactcccaggggaagatcagcggcagccccctggacatcaccgccatccgcgggagcttctccgtgaactaccggggcctgcgcctcagcctgtccgagatcaccgcgacctgcacgggggaggtcaccaacgtgagcggctgctactcctgcatgaccggcgccaaggtgagcatcaagctgcactccagcaagaactccaccgcccacgtccgctgcaagggggacgagaccgccttcagcgtgctcgagggcgtgcacagctacatcgtctccctgagcttcgaccacgccgtggtggacgagcagtgccagctgaactgcgggggccacgagtcccaggtcacgctcaaggggaacctgatcttcctggacgtgcccaagttcgtggacggcagctacatgcagacctaccactccaccgtcccgaccggcgccaacatccccagccccacggactggctcaacgccctgttcgggaacggcctgtcccggtggatcctcggggtgatcggcgtcctgctgggcgggctcgcgctgttcttcctgatcatgttcctcctgaagctgggcaccaagcaggtcttccgcagccggaccaagctcgcctga

SEQ ID NO: 13208 - RNA, 3222 nt, synthetic construct
  misc_feature 1..3222: note = derived and/or modified CDS sequence (opt1) from SFTSV(SDTA_4)__KX641916.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcatgcgggtccgcccgaagtgctacgggttcagccggatgatggcgaccctggaggtgaacccgcccgagcagcgcatcggccagtgcaccgggtgccacctcgagtgcatcaacggcggggtgcggctgatcacgctgacctccgagctccgcagcgccaccgtctgcgcctcccacttctgcagctccgccaccagcggcaagaagtccacggagatccacttccacagcggctccctggtggggaagaccgccatccacgtcaagggcgcgctggtggacgggaccgagttcaccttcgagggcagctgcatcttccccgacggctgcgacgccgtggactgcacgttctgccgggagttcctcaagaacccccagtgctaccccgccaagaagtggctgttcatcatcatcgtcatcctgctcgggtacgccggcctgatgctgctcaccaacgtgctgaaggccatcggggtgtggggctcctgggtcatcgcgcccgtgaagctgatcttcgccatcatgaagaagctcatgcgcaccgtgagctgcctggtcgggaagctgatggaccggggccgccaggtgatccacgaggagatcggcgagaacggggagggcaaccaggacgacgtgcggatcgagatggcccgcccccgccgggtccgccactggatgtactccccggtgatcctcaccatcctggccatcgggctggccgagggctgcgacgagatggtgcacgcggacagcaagctcgtctcctgccggcaggggagcggcaacatgaaggagtgcatcacgaccggcggggccctgctgcccgccgtgaaccccggccaggaggcctgcctccacttcaccgcccccgggtccccggacagcaagtgcctgaagatcaaggtgaagcgcatcaacctgaagtgcaagaagtccagcagctacttcgtccccgacgcgcggtcccgctgcaccagcgtgcggcgctgccggtgggccggcgactgccagtccgggtgcccgccccacttcacgagcaactccttcagcgacgactgggccggcaagatggaccgcgccggcctcgggttctccggctgcagcgacgggtgcggcggggcggcctgcggctgcttcaacgccgccccctcctgcatcttctggcggaagtgggtggagaacccccacggcatcatctggaaggtcagcccctgcgccgcgtgggtgccgtccgccgtgatcgagctgaccatgcccagcggggaggtccgcaccttccaccccatgtccggcatccccacccaggtgttcaagggggtgagcgtcacgtacctgggctccgacatggaggtgagcggcctcaccgacctgtgcgagatcgaggagctgaagtccaagaagctggccctcgccccgtgcaaccaggccgggatgggcgtggtcgggaaggtgggcgagatccagtgcagcagcgaggagtccgcgcggaccatcaagaaggacgggtgcatctggaacgccgacctggtgggcatcgagctgcgcgtcgacgacgccgtgtgctacagcaagatcacctccgtggaggccgtcgccaactacagcgcgatccccacgaccatcggcgggctccggttcgagcgctcccacgacagccagggcaagatctccgggagccccctggacatcaccgccatccggggctccttcagcgtgaactaccgcgggctgcggctctccctgagcgagatcaccgccacgtgcaccggcgaggtgaccaacgtctccggctgctacagctgcatgaccggggccaaggtgtccatcaagctgcacagctccaagaacagcaccgcgcacgtgcgctgcaagggcgacgagacggccttctccgtcctcgagggggtgcacagctacatcgtgagcctgtccttcgaccacgccgtcgtggacgagcagtgccagctgaactgcggcgggcacgagagccaggtgaccctcaagggcaacctgatcttcctggacgtccccaagttcgtggacggctcctacatgcagacctaccacagcaccgtgccgacgggggccaacatcccctcccccaccgactggctcaacgccctgttcggcaacgggctgagccgctggatcctcggcgtcatcggcgtgctgctcgggggcctggcgctgttcttcctgatcatgttcctcctgaagctggggaccaagcaggtcttccggtcccgcaccaagctcgcctga

SEQ ID NO: 13209 - RNA, 3222 nt, synthetic construct
  misc_feature 1..3222: note = derived and/or modified CDS sequence (opt1) from SFTSV(HBGS13_human_2015)__KY440773.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccaaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcatcgccgagagctgcgacgagatggtccacgccgactccaagctggtgagctgccggcaggggtccggcaacatgaaggagtgcgtgaccaccgggcgcgcgctgctcccggccgtcaaccccggccaggaggcctgcctgcacttcaccgcccccggcagccccgacagcaagtgcctgcggatcaaggtgaagcgcatcaacctcaagtgcaagaagtccagctcctacttcgtgccggacgcccggagccgctgcacgtccgtccggcgctgccggtgggcgggggactgccagagcggctgcccgccccacttcacctccaacagcttctccgacgactgggccgggaagatggaccgcgccggcctggggttcagcggctgctccgacggctgcgggggcgccgcgtgcgggtgcttcaacgccgcccccagctgcatcttctggcggaagtgggtggagaacccccacggcatcatctggaaggtgtccccctgcgccgcctgggtccccagcgcggtgatcgagctgaccatgccgtccggggaggtgcgcaccttccaccccatgagcggcatccccacgcaggtcttcaagggcgtgtccgtgacctacctcgggagcgacatggaggtctccggcctgaccgacctgtgcgagatcgaggagctcaagagcaagaagctggccctggccccctgcaaccaggccgggatgggcgtggtgggcaaggtcggggagatccagtgcagctccgaggagagcgcccggaccatcaagaaggacggctgcatctggaacgcggacctggtggggatcgagctccgcgtggacgacgccgtctgctactccaagatcacgagcgtggaggccgtggccaactactccgccatcccgaccaccatcggcgggctgcggttcgagcgcagccacgactcccagggcaagatcagcggcagccccctggacatcaccgcgatccgggggagcttctccgtcaactaccgcggcctccgcctgagcctgtccgagatcacggcgacctgcaccggggaggtgaccaacgtgagcggctgctactcctgcatgaccggggccaaggtcagcatcaagctccactccagcaagaactccacggcccacgtgcggtgcaagggcgacgagaccgccttcagcgtgctggagggcgtccacagctacaccgtgtccctgagcttcgaccacgccgtggtcgacgagcagtgccagctcaactgcgggggccacgagtcccaggtgaccctgaaggggaacctgatcttcctcgacgtgcccaagttcgtcgacggcagctacatgcagacgtaccactccaccgtgcccaccggggccaacatcccgagccccaccgactggctgaacgccctgttcggcaacggcctctcccgctggatcctgggggtgatgggcgtcctgctcgggggcctggccctgttcatcatcatcatgagcctcttcaagctgggcacgaagcaggtcttccggtcccgcaccaagctggcgtga

SEQ ID NO: 13210 - RNA, 3222 nt, synthetic construct
  misc_feature 1..3222: note = derived and/or modified CDS sequence (opt1) from SFTSV(HBMC16_human_2015)__KY440776.1__GP
  source 1..3222: mol_type = other RNA
atgatgaaggtgatctggttcagctccctggtctgcctcgtgatccagtgcagcggcgactccgggcccatcatctgcgccggcccgatccacagcaacaagtccgccgggatcccccacctgctgggctacagcgagaagatctgccagatcgaccgcctcatccacgtgtccagctggctgcggaaccactcccagttccaggggtacgtcggccagcgcggcgggcggagccaggtgtcctactaccccgcggagaacagctactcccgctggagcggcctgctctccccctgcgacgccgactggctggggatgctggtggtcaagaaggccaagggcagcgacatgatcgtgccggggccctcctacaagggcaaggtgttcttcgagcggcccaccttcgacggctacgtcgggtggggctgcgggagcggcaagtcccgcaccgagagcggcgagctctgcagctccgacagcgggacgtccagcggcctgctgccctccgaccgggtgctctggatcggggacgtggcctgccagccgatgacccccatccccgaggagaccttcctggagctgaagagcttctcccagagcgagttccccgacatctgcaagatcgacggcatcgtcttcaaccagtgcgagggggagtccctcccgcagcccttcgacgtggcctggatggacgtgggccacagccacaagatcatcatgcgcgagcacaagaccaagtgggtccaggagtccagctccaaggacttcgtgtgctacaaggagggcacggggccctgcagcgagtccgaggagaaggcgtgcaagaccagcggctcctgccggggggacatgcagttctgcaaggtggccggctgcgagcacggggaggaggccagcgaggccaagtgccgctgctccctggtccacaagcccggcgaggtggtggtcagctacggcgggatgcgggtgcgcccgaagtgctacggcttcagccggatgatggcgaccatggaggtgaacccccccgagcagcgcatcgggcagtgcaccggctgccacctggagtgcatcaacgggggcgtccggctcatcacgctgacctccgagctgaagagcgccaccgtgtgcgcctcccacttctgcagctccgccaccagcggcaagaagtccacggagatccacttccacagcgggtccctcgtcggcaaggccgcgatccacgtgaagggggccctggtggacggcaccgagttcaccttcgagggcagctgcatgttccccgacgggtgcaacgccgtcgactgcaccttctgccgcgagttcctgaagaacccgcagtgctaccccgccaagaagtggctcttcatcatcatcgtgatcctgctgggctacgccgggctcatgctgctgacgaacgtgctcaaggcgatcggcgtctgggggtcctgggtgatcgcccccgtgaagctgatgttcgccatcatgaagaagctgatgcggaccgtcagctgcctcgtgggcaagctgatggaccgcggccggcaggtgatccacgaggagatcggggagaacggcgaggggaaccaggacgacgtccgcatcgagatggcccggccccgccgcgtgcggcactggatgtactccccggtgatcctgaccatcctcgccatcggcctggcggaggggtgcgacgagatggtccacgccgacagcaagctggtgtcctgccgccagggcagcggcaacatgaaggagtgcgtgaccacggggcgggccctcctgcccgccgtcaaccccggccaggaggcctgcctgcacttcaccgcgcccgggtccccggacagcaagtgcctcaagatcaaggtgaagcgcatcaacctgaagtgcaagaagagctccagctacttcgtgcccgacgcccggtcccgctgcaccagcgtccggcgctgccggtgggccggcgactgccagtccgggtgccccccgcacttcaccagcaactccttcagcgacgactgggccggcaagatggaccgcgcgggcctggggttctccggctgcagcgacgggtgcggcggggccgcctgcggctgcttcaacgccgccccctcctgcatcttctggcggaagtgggtggagaacccccacggcatcatctggaaggtgagcccctgcgcggcctgggtcccgtccgccgtgatcgagctcacgatgcccagcggggaggtgcgcaccttccaccccatgtccggcatccccacccaggtcttcaagggggtgagcgtgacctacctgggctccgacatggaggtcagcggcctgacggacctctgcgagatcgaggagctgaagtccaagaagctggccctggccccgtgcaaccaggcggggatgggcgtggtggggaaggtcggcgagatccagtgcagcagcgaggagtccgcccggaccatcaagaaggacgggtgcatctggaacgccgacctcgtgggcatcgagctgcgcgtggacgacgccgtctgctacagcaagatcacctccgtggaggccgtggcgaactacagcgccatccccaccacgatcggcgggctgcggttcgagcgctcccacgacagccagggcaagatctccgggagccccctcgacatcaccgccatccggggctccttcagcgtcaactaccgcgggctgcggctgtccctcagcgagatcaccgccacctgcacgggcgaggtgaccaacgtgtccggctgctacagctgcatgaccggggcgaaggtctccatcaagctgcacagctccaagaacagcaccgcccacgtgcgctgcaagggcgacgagaccgccttctccgtgctggagggggtccacagctacacggtgagcctctccttcgaccacgccgtggtcgacgagcagtgccagctgaactgcggcgggcacgagagccaggtgaccctgaagggcaacctcatcttcctggacgtgcccaagttcgtcgacggctcctacatgcagacctaccacagcaccgtgccgacgggggccaacatcccctcccccaccgactggctgaacgcgctcttcggcaacgggctgagccgctggatcctgggcgtcatcggcgtgctcctggggggcctggccctcttcttcctgatcatgttcctgttcaagctcgggaccaagcaggtgttccggtcccgcaccaagctggcctga

SEQ ID NO: 13211 - RNA, 3222 nt, synthetic construct
  misc_feature 1..3222: note = derived and/or modified CDS sequence (opt1) from SFTSV(HBMC5_human_2016)__KY440770.1__GP
  source 1..3222: mol_type = other RNA
atgatgaaggtgatctggttcagctccctggtgtgcctcgtgatccagtgcagcggcgactccgggcccatcatctgcgccggcccgatccacagcaacaagtccgccgggatcccccacctcctgggctacagcgagaagatctgccagatcgaccgcctcatccacgtgtccagctggctgcggaaccactcccagttccaggggtacgtcggccagcgcggcgggcggagccaggtgtcctactaccccgcggagaacagctactcccgctggagcggcctgctctccccctgcgacgccgactggctggggatgctggtggtcaagaaggccaagggcagcgacatgatcgtgccggggccctcctacaagggcaaggtgctgttcgagcggcccaccttcgacggctacgtcgggtggggctgcgggagcggcaagtcccgcaccgagagcggcgagctgtgcagctccgacagcgggacgtccagcggcctgctcccctccgaccgggtgctgtggatcggggacgtggcctgccagccgatgacccccatccccgaggagaccttcctggagctcaagagcttctcccagagcgagttccccgacatctgcaagatcgacggcatcgtcttcaaccagtgcgagggggagtccctgccgcagcccttcgacgtggcctggatggacgtgggccacagccacaagatcatcatgcgcgagcacaagaccaagtgggtccaggagtccagctccaaggacttcgtgtgctacaaggagggcacggggccctgcagcgagtccgaggagaaggcgtgcaagaccagcggctcctgccgcggggacatgcagttctgcaaggtggccggctgcgagcacggggaggaggccagcgaggccaagtgccggtgctccctggtccacaagcccggcgaggtggtggtcagctacggcgggatgcgggtgcgcccgaagtgctacggcttcagccggatgatggcgaccatggaggtgaacccgcccgagcagcgcatcgggcagtgcaccggctgccacctcgagtgcatcaacgggggcgtccggctgatcacgctgacctccgagctcaagagcgccaccgtgtgcgcctcccacttctgcagctccgccaccagcggcaagaagtccacggagatccacttccacagcgggtccctggtcggcaaggccgcgatccacgtgaagggggccctggtggacggcaccgagttcaccttcgagggcagctgcatgttccccgacgggtgcaacgccgtcgactgcaccttctgccgcgagttcctcaagaacccccagtgctaccccgccaagaagtggctgttcatcatcatcgtgatcctgctcggctacgccgggctgatgctgctcacgaacgtgctgaaggcgatcggcgtctgggggtcctgggtgatcgcccccgtgaagctgatgttcgccatcatgaagaagctcatgcggaccgtcagctgcctggtgggcaagctgatggaccgcggccgccaggtgatccacgaggagatcggggagaacggcgaggggaaccaggacgacgtccggatcgagatggcccggccccgccgcgtgcggcactggatgtactccccggtgatcctcaccatcctggccatcggcctggcggaggggtgcgacgagatggtccacgccgacagcaagctcgtgtcctgccgccagggcagcggcaacatgaaggagtgcgtgaccacggggcgggccctgctgcccgccgtcaaccccggccaggaggcctgcctccacttcaccgcgcccgggtccccggacagcaagtgcctgaagatcaaggtgaagcgcatcaacctgaagtgcaagaagtccagcagctacttcgtgcccgacgcccggtcccgctgcaccagcgtccggcgctgccggtgggccggcgactgccagtccgggtgcccgccccacttcaccagcaactccttcagcgacgactgggccggcaagatggaccgcgcgggcctcgggttctccggctgcagcgacgggtgcggcggggccgcctgcggctgcttcaacgccgccccctcctgcatcttctggcggaagtgggtggagaacccccacggcatcatctggaaggtgagcccctgcgcggcctgggtcccgtccgccgtgatcgagctgacgatgcccagcggggaggtgcgcaccttccaccccatgtccggcatccccacccaggtcttcaagggggtgagcgtgacctacctgggctccgacatggaggtcagcggcctcacggacctgtgcgagatcgaggagctgaagtccaagaagctggccctcgccccgtgcaaccaggcggggatgggcgtggtggggaaggtcggcgagatccagtgcagcagcgaggagtccgcccggaccatcaagaaggacgggtgcatctggaacgccgacctggtgggcatcgagctgcgcgtggacgacgccgtctgctacagcaagatcacctccgtggaggccgtggcgaactacagcgccatccccaccacgatcggcgggctccggttcgagcgctcccacgacagccagggcaagatctccgggagccccctggacatcaccgccatccggggctccttcagcgtcaactaccgcgggctgcggctctccctgagcgagatcaccgcgacctgcacgggcgaggtgaccaacgtgtccggctgctacagctgcatgaccggggccaaggtctccatcaagctgcacagctccaagaacagcaccgcccacgtgcgctgcaagggcgacgagaccgccttctccgtgctcgagggggtccacagctacacggtgagcctgtccttcgaccacgccgtggtcgacgagcagtgccagctgaactgcggcgggcacgagagccaggtgaccctcaagggcaacctgatcttcctggacgtgcccaagttcgtcgacggctcctacatgcagacctaccacagcaccgtgccgacgggggccaacatcccctcccccaccgactggctcaacgcgctgttcggcaacgggctgagccgctggatcctcggcgtcatcggcgtgctgctcgggggcctggccctgttcttcctgatcatgttcctcttcaagctggggaccaagcaggtcttccggtcccgcaccaagctggcctga

SEQ ID NO: 13212 - RNA, 3222 nt, synthetic construct
  misc_feature 1..3222: note = derived and/or modified CDS sequence (opt1) from SFTSV(HB29)__KP202164.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcatgcgggtccgcccgaagtgctacgggttcagccggatgatggcgaccctggaggtgaacccgcccgagcagcgcatcggccagtgcaccgggtgccacctcgagtgcatcaacggcggggtgcggctgatcacgctgacctccgagctccgcagcgccaccgtctgcgcctcccacttctgcagctccgccagctccggcaagaagtccaccgagatccacttccactccggcagcctggtggggaagacggccatccacgtcaagggcgcgctggtggacgggaccgagttcaccttcgagggctcctgcatgttccccgacggctgcgacgccgtggactgcaccttctgccgggagttcctcaagaacccccagtgctaccccgccaagaagtggctgttcatcatcatcgtcatccacctggggtacgccggcctcatgctgctgacgaacgtgctcaaggccatcggggtgtggggcagctgggtcatcgcgcccgtgaagctgatgttcgccatcatcaagaagctgatgcgcaccgtgtcctgcctcgtcgggaagctgatggaccggggccgccaggtgatccacgaggagatcggcgagaacggggagggcaaccaggacgacgtgcggatcgagatggcccgcccccgccgggtccgccactggatgtacagcccggtgatcctgaccatcctcgccatcgggctggccgagggctgcgacgagatggtgcacgcggactccaagctggtcagctgccggcaggggtccggcaacatgaaggagtgcatcaccacgggccgcgccctcctgcccgccgtgaaccccgggcaggaggcctgcctgcacttcaccgcccccggcagcccggacagcaagtgcctcaagatcaaggtgaagcggatcaacctgaagtgcaagaagtccagctcctacttcgtccccgacgcgcgcagccggtgcacctccgtgcgccggtgccgctgggccggggactgccagagcggctgcccgccccacttcacctccaacagcttctccgacgactgggccgggaagatggaccgggccggcctgggcttcagcgggtgctccgacggctgcgggggcgcggcctgcgggtgcttcaacgccgcccccagctgcatcttctggcgcaagtgggtggagaacccccacggcatcatctggaaggtctccccctgcgccgcgtgggtgccgagcgccgtgatcgagctcacgatgccctccggcgaggtccggaccttccaccccatgagcgggatccccacccaggtgttcaagggcgtgtccgtcacctacctggggagcgacatggaggtgtccggcctgacggacctctgcgagatcgaggagctcaagagcaagaagctggccctggccccgtgcaaccaggccggcatgggggtggtcggcaaggtgggggagatccagtgcagctccgaggagagcgcgcgcaccatcaagaaggacggctgcatctggaacgccgacctggtggggatcgagctgcgggtcgacgacgccgtgtgctactccaagatcaccagcgtggaggccgtcgccaactactccgcgatccccaccacgatcggcggcctgcgcttcgagcggagccacgactcccaggggaagatcagcggcagccccctcgacatcaccgccatccgcgggagcttctccgtgaactaccggggcctgcgcctgagcctctccgagatcaccgcgacctgcacgggggaggtgaccaacgtcagcggctgctactcctgcatgaccggcgccaaggtgagcatcaagctgcactccagcaagaacaacaccgcgcacgtgcgctgcaagggggacgagaccgccttctccgtcctggagggcgtgcacagctacatcgtgagcctctccttcgaccacgccgtcgtggacgagcagtgccagctgaactgcgggggccacgagagccaggtgacgctgaaggggaacctcatcttcctggacgtccccaagttcgtggacggctcctacatgcagacctaccacagcaccgtgccgaccggcgccaacatcccctcccccacggactggctgaacgccctcttcgggaacggcctgagccggtggatcctgggggtcatcggcgtgctcctgggcgggctggccctcttcttcctgatcatgttcctgctcaagctgggcaccaagcaggtcttccgctcccggaccaagctggcctga

SEQ ID NO: 13213 - RNA, 3222 nt, synthetic construct
  misc_feature 1..3222: note = derived and/or modified CDS sequence (opt1) from SFTSV(HNXY_115)__KC292312.1__GP
  source 1..3222: mol_type = other RNA
atgatgaaggtgatctggttcagctccctgatctacttcgtgatccagtgcagcggcgactccgggagcatcatctgcgccggccccatccactccaacaagagcgccgacatcccgcacctcctggggtactccgagaagatctgccagatcgaccgcctgatccacgtgagctcctggctccggaaccacagccagttccagggctacgtggggcagcgcggcggccggtcccaggtcagctactaccccgcggagaactcctacagccgctggtccgggctgctgagcccctgcgacgccgactggctcggcatgctggtggtgaagaaggccaaggggtccgacatgatcgtccccggcccgagctacaaggggaaggtgttcttcgagcggcccaccttcgacggctacgtgggctgggggtgcggctccggcaagagccgcaccgagagcggggagctgtgctccagcgactccggcacgagctccgggctcctgcccagcgaccgggtcctgtggatcggcgacgtggcctgccagcccatgaccccgatccccgaggagaccttcctcgagctgaagtccttcagccagtccgagttccccgacatctgcaagatcgacgggatcgtgttcaaccagtgcgagggcgagagcctgccccagccgttcgacgtcgcctggatggacgtggggcactcccacaagatcatcatgcgcgagcacaagaccaagtgggtgcaggagagctccagcaaggacttcgtctgctacaaggagggcacgggcccctgctccgagagcgaggagaagacctgcaagacctccgggagctgccggggcgacatgcagttctgcaaggtggcggggtgcgagcacggcgaggaggcctccgaggccaagtgccgctgcagcctcgtgcacaagcccggggaggtcgtggtgagctacggcggcatgcgggtccgccccaagtgctacgggttctcccggatgatggccaccctggaggtgaaccagccggagcagcgcatcggccagtgcacggggtgccacctggagtgcatcaacggcggggtgcggctcatcaccctgaccagcgagctgaagtccgcgaccgtctgcgccagccacttctgctccagcgccacgtccggcaagaagtccaccgagatccagttccacagcggcagcctcgtggggaagaccgccatccacgtcaagggcgccctggtggacgggaccgagttcacgttcgagggctcctgcatgttccccgacggctgcgacgcggtggactgcaccttctgccgcgagttcctgaagaacccccagtgctaccccgccaagaagtggctgttcatcatcatcgtcatcctgctggggtacgccggcctcatgctgctgaccaacgtgctcaaggccatcgggatctggggcagctgggtgatcgccccggtcaagctgatcttcgcgatcatcaagaagctgatgcggaccgtgtcctgcctcatggggaagctgatggaccgcggccgccaggtgatccacgaggagatcggcgagaaccgggaggggaaccaggacgacgtccggatcgagatggcccgcccccgccgggtgcgccactggatgtacagccccgtgatcctgacgatcctcgccatcggcctggccgagtcctgcgacgagatggtccacgccgacagcaagctggtgtcctgccggcaggggagcggcaacatgaaggagtgcgtgaccaccgggcgcgcgctcctgcccgccgtcaacccgggccaggaggcctgcctgcacttcaccgcccccggcagccccgactccaagtgcctcaagatcaaggtgaagcggatcaacctgaagtgcaagaagtccagcagctacttcgtgcccgacgcccgctcccggtgcacgagcgtccgccggtgccgctgggcgggggactgccagtccggctgcccgccccacttcaccagcaactccttcagcgacgactgggccgggaagatggaccgggccggcctggggttctccggctgcagcgacggctgcgggggcgccgcgtgcgggtgcttcaacgccgccccctcctgcatcttctggcgcaagtgggtggagaacccgcacggcatcatctggaaggtgagcccctgcgccgcctgggtcccctccgcggtgatcgagctcaccatgcccagcggggaggtgcggaccttccacccgatgtccggcatccccacgcaggtcttcaagggcgtgagcgtgacctacctggggtccgacatggaggtcagcggcctgaccgacctctgcgagatcgaggagctcaagagcaagaagctggccctggccccctgcaaccaggccgggatgggcgtggtgggcaaggtcggggagatccagtgctccagcgaggagtccgcccgcaccatcaagaaggacggctgcatctggaacgcggacctcgtggggatcgagctgcgggtggacgacgccgtctgctacagcaagatcacgtccgtggaggccgtggccaactacagcgccatccccaccaccatcggcgggctgcgcttcgagcggtcccacgacagccagggcaagatctccggcagcccgctcgacatcaccgcgatccgcgggtccttcagcgtcaactaccggggcctgcgcctgtccctcagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttcagcgtgctggagggcgtccactcctacaccgtgagcctctccttcgaccacgccgtggtcgacgagcagtgccagctgaactgcgggggccacgagagccaggtgaccctgaaggggaacctcatcttcctggacgtgcccaagttcgtcgacggctcctacatgcagacgtaccacagcaccgtgcccaccggggccaacatcccctccccgaccgactggctgaacgccctcttcggcaacggcctgagccggtggatcctgggggtgatcggcgtcctcctcgggggcctggccctgttcttcatgatcatgtccctgttcaagctgggcacgaagcaggtcttccgcagccggaccaagctcgcgtga

SEQ ID NO: 13214 - RNA, 3222 nt, synthetic construct
  misc_feature 1..3222: note = derived and/or modified CDS sequence (opt1) from SFTSV(HNXY_144)__KC292307.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccggggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcctgtcccggtggatcctgggggtgatgggcgtcctcctcgggggcctggccctgttcttcatgatcatgagcctgttcaagctgggcacgaagcaggtcttccgctcccggaccaagctcgcgtga

SEQ ID NO: 13215 - RNA, 3222 nt, synthetic construct
  misc_feature 1..3222: note = derived and/or modified CDS sequence (opt1) from SFTSV(HNXY_157)__KC292305.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccaaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctccggatcaaggtgaagcgcatcaacctgaagtgcaagaagtccagctcctacttcgtgccggacgcccggagccgctgcacgtccgtccggcgctgccggtgggcgggggactgccagagcggctgcccgccccacttcacctccaacagcttctccgacgactgggccgggaagatggaccgcgccggcctggggttcagcggctgctccgacggctgcgggggcgccgcgtgcgggtgcttcaacgccgcccccagctgcatcttctggcggaagtgggtggagaacccccacggcatcatctggaaggtgtccccctgcgccgcctgggtccccagcgcggtgatcgagctcaccatgccgtccggggaggtgcgcaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccggaccatcaagaaggacggctgcatctggaacgcggacctggtggggatcgagctgcgcgtggacgacgccgtctgctactccaagatcacgagcgtggaggccgtggccaactactccgccatcccgaccaccatcggcgggctgcggttcgagcgcagccacgactcccagggcaagatcagcggcagccccctcgacatcaccgcgatccgggggagcttctccgtcaactaccgcggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcggtgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcctgtcccgctgggtgctgggggtcatgggcgtgctcctcgggggcctggccctgttcttcatgatcatgagcctgttcaagctgggcacgaagcaggtcttccggtcccgcaccaagctcgcgtga

SEQ ID NO: 13216 - RNA, 3222 nt, synthetic construct
  misc_feature 1..3222: note = derived and/or modified CDS sequence (opt1) from SFTSV(HNXY_170)__KC292304.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccaaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctccggatcaaggtgaagcgcatcaacctgaagtgcaagaagtccagctcctacttcgtgccggacgcccggagccgctgcacgtccgtccggcgctgccggtgggcgggggactgccagagcggctgcccgccccacttcacctccaacagcttctccgacgactgggccgggaagatggaccgcgccggcctggggttcagcggctgctccgacggctgcgggggcgccgcgtgcgggtgcttcaacgccgcccccagctgcatcttctggcggaagtgggtggagaacccccacggcatcatctggaaggtgtccccctgcgccgcctgggtccccagcgcggtgatcgagctcaccatgccgtccggggaggtgcgcaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccggaccatcaagaaggacggctgcatctggaacgcggacctggtggggatcgagctgcgcgtggacgacgccgtctgctactccaagatcacgagcgtggaggccgtggccaactactccgccatcccgaccaccatcggcgggctgcggttcgagcgcagccacgactcccagggcaagatcagcggcagccccctcgacatcaccgcgatccgggggagcttctccgtcaactaccgcggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcggtgcaagggcgacgagaccgccttcagcgtgctggagggcgtccacagctacaccgtgtccctcagcttcgaccacgccgtggtcgacgagcagtgccagctgaactgcgggggccacgagtcccagatcaccctgaaggggaacctcatcttcctggacgtgcccaagttcgtggacggcagctacatgcagacgtaccactccaccgtccccaccggggccaacatcccgagccccaccgactggctgaacgccctcttcggcaacggcctgtcccgctgggtgctgggggtgatcggcgtcctcctcgggggcctggccctgttcttcatgatcatgagcctgttcaagctgggcacgaagcaggtcttccggtcccgcaccaagctcgcgtga

SEQ ID NO: 13217 - RNA, 3222 nt, synthetic construct
  misc_feature 1..3222: note = derived and/or modified CDS sequence (opt1) from SFTSV(HNXY_174)__KC292306.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgccgcatcgacgggatcgtgttcaaccagtgcgagggcgagtccctgccgcagcccttcgacgtcgcctggatggacgtggggcacagccacaagatcatcatgcgggagcacaagaccaagtgggtgcaggagtccagctccaaggacttcgtctgctacaaggagggcacgggcccctgcagcgagtccgaggagaagacctgcaagaccagcgggtcctgccgcggcgacatgcagttctgcaaggtggcggggtgcgagcacggcgaggaggccagcgaggccaagtgccggtgctccctcgtgcacaagcccggggaggtcgtggtgagctacggcggcatgcgcgtccggccgaagtgctacgggttcagccgcatgatggccaccctggaggtgaaccagcccgagcagcggatcggccagtgcacggggtgccacctggagtgcatcaacggcggggtgcgcctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgggagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcgcaccgtgagctgcctcatggggaagctgatggaccggggccgccaggtgatccacgaggagatcggcgagaaccgggaggggaaccaggacgacgtccgcatcgagatggcccgcccccggcgcgtgcggcactggatgtactcccccgtgatcctgacgatcctcgccatcggcctggccgagagctgcgacgagatggtccacgccgactccaagctggtgagctgccgccaggggtccggcaacatgaaggagtgcgtgaccaccgggcgggcgctcctgccggccgtcaaccccggccaggaggcctgcctgcacttcaccgcccccggcagccccgacagcaagtgcctccgcatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccgcggcctgcggctgagcctctccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcatgtcccggtggatcctgggggtgatgggcgtcctgctcgggggcctggccctgttcttcatgatcatgagcctcttcaagctgggcacgaagcaggtcttccgctcccggaccaagctggcgtga

SEQ ID NO: 13218 - RNA, 3222 nt, synthetic construct
  misc_feature 1..3222: note = derived and/or modified CDS sequence (opt1) from SFTSV(HNXY_182)__KC292324.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctccaggggtacagcgagaagatctgccagatcgaccgcctgatccacgtgtccagctggctgcggaaccactcccagttccagggctacgtggggcagcgcggcggccggagccaggtctcctactaccccgcggagaacagctactcccgctggagcgggctcctgtccccctgcgacgccgactggctgggcatgctcgtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctgctcccctccgaccgggtcctgtggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggggaggtcgtggtgagctacggcggcatgcgggtccgcccgaagtgctacgggttcagccggatgatggccaccctcgaggtgaaccagcccgagcagcgcatcggccagtgcacggggtgccacctggagtgcatcaacggcggggtgcggctgatcaccctcacctccgagctgaagtccgcgaccgtctgcgcctcccacttctgcagctccgccacgagcggcaagaagtccaccgagatccagttccacagcggctccctggtggggaagaccgccatccacgtcaagggcgccctcgtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctcctggggtacgccggcctgatgctcctgaccaacgtgctgaaggccatcgggatctggggctcctgggtgatcgcccccgtcaagctcatcttcgcgatcatcaagaagctgatgcggaccgtgagctgcctgatggggaagctcatggaccgcggccgccaggtgatccacgaggagatcggcgagaaccgggaggggaaccaggacgacgtccggatcgagatggcccgcccccgccgggtgcgccactggatgtactcccccgtgatcctgacgatcctggccatcggcctcgccgagagctgcgacgagatggtccacgccgactccaagctggtgagctgccggcaggggtccggcaacatgaaggagtgcgtgaccaccgggcgcgcgctgctcccggccgtcaaccccggccaggaggcctgcctgcacttcaccgcccccggcagccccgacagcaagtgcctgaagatcaaggtgaagcggatcaacctcaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctgaccatgccgtccggggaggtgcggaccttccaccccatgagcggcatccccacgcaggtcttcaagggcgtgtccgtgacctacctcgggagcgacatggaggtctccggcctgaccgacctgtgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctccgggtggacgacgccgtctgctactccaagatcacgagcgtggaggccgtggccaactactccgccatcccgaccaccatcggcgggctgcgcttcgagcggagccacgactcccagggcaagatcagcggcagccccctggacatcaccgcgatccgcgggagcttctccgtcaactaccggggcctccgcctgagcctgtccgagatcacggcgacctgcaccggggaggtgaccaacgtgagcggctgctactcctgcatgaccggggccaaggtcagcatcaagctccactccagcaagaactccacggcccacgtgcgctgcaagggcgacgagaccgccttcagcgtgctggagggcgtccacagctacaccgtgtccctgagcttcgaccacgccgtggtcgacgagcagtgccagctcaactgcgggggccacgagtcccaggtgaccctgaaggggaacctgatcttcctcgacgtgcccaagttcgtcgacggcagctacatgcagacgtaccactccaccgtgcccaccggggccaacatcccgagccccaccgactggctgaacgccctgttcggcaacggcctctcccggtggatcctggggctgatcggcgtgctcctcgggggcctggccctgttcttcatgatcatgagcctgttcaagctgggcacgaagcaggtcttccgctcccggaccaagctcgcgtga

SEQ ID NO: 13219 - RNA, 3222 nt, synthetic construct
  misc_feature 1..3222: note = derived and/or modified CDS sequence (opt1) from SFTSV(HNXY_188)__KC292301.1__GP
  source 1..3222: mol_type = other RNA
atgatgaaggtgatctggttcagctccctgatctgcctcgtcatccagtgcggcgggggcaccgggcccatcatctgcgccggcccgatccacagcaacaagtccgccgacatcccccacctcctggggtacagcgagaagatctgccagatcgaccgcctgatccacgtgtccagctggctgcggaaccactcccagttccagggctacgtgggccagcgcgggggccggagccaggtctcctactaccccgcggagaacagctactcccgctggagcgggctgctctccccctgcgacgccgactggctgggcatgctggtggtgaagaaggccaaggggagcgacatgatcgtcccgggcccctcctacaagggcaaggtgttcttcgagcggcccaccttcgacgggtacgtgggctgggggtgcggcagcggcaagtcccgcacggagagcggggagctctgctccagcgacagcggcacctccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggcgaggtcgtggtgagctacgggggcatgcgggtccgcccgaagtgctacgggttctcccggatgatggccacgctggaggtgagccagcccgagcagcgcatcggccagtgcaccgggtgccacctcgagtgcatcaacggcggcgtgcggctgatcaccctgaccagcgagctcaagtccgcgacggtctgcgccagccacttctgctccagcgccacctccgggaagaagtccaccgagatccagttccactccggcagcctggtggggaagaccgccatccacgtcaagggcgccctggtggacggcacggagttcaccttcgaggggtcctgcatgttccccgacggctgcgacgcggtggactgcaccttctgccgcgagttcctcaagaacccccagtgctacccggccaagaagtggctgttcatcatcatcgtcatcctgctcgggtacgccggcctgatgctgctcaccaacgtgctgaaggccatcggggtgtggggcagctgggtcatcgcccccgtgaagctggtgttcgcgatcatcaagaagctcatgcgggccgtctcctgcctgatgggcaagctgatggaccgcgggcgccaggtgatccacgaggagatcggcgagaaccgggaggggaaccaggacgacgtgcggatcgagatggcccgcccccgccgggtccgccactggatgtacagccccgtgatcctcacgatcctggccatcggcctggccgaggggtgcgacgagatggtgcacgcggactccaagctcgtcagctgccggcagggctccggcaacatgaaggagtgcgtgaccaccgggcgcgccctgctgccggccgtgaaccccggccaggaggcctgcctccacttcaccgcccccgggagccccgactccaagtgcctgaagatcaaggtcaagcggatcaacctgaagtgcaagaagtccagcagctacttcgtgccggacgcgcgcagccggtgcacgtccgtgcgccggtgccgctgggccggcgactgccagagcgggtgcccgccccacttcacctccaacagcttctccgacgactgggccggcaagatggaccgggccggcctcgggttcagcggctgctccgacgggtgcggcggggcggcctgcggctgcttcaacgccgcccccagctgcatcttctggcgcaagtgggtcgagaacccccacggcatcatctggaaggtgtccccctgcgccgcgtgggtgcccagcgccgtcatcgagctgaccatgccgtccggggaggtgcggaccttccaccccatgagcggcatccccacccaggtgttcaagggggtctccgtgacctacctgggcagcgacatggaggtgtccggcctcaccgacctgtgcgagatcgaggagctcaagagcaagaagctggccctggccccctgcaaccaggccgggatgggcgtcgtggggaaggtgggcgagatccagtgctccagcgaggagagcgcgcgcaccatcaagaaggacgggtgcatctggaacgccgacctggtcggcatcgagctgcgggtggacgacgccgtgtgctactccaagatcacgagcgtcgaggccgtggccaactactccgcgatcccgaccaccatcggcgggctccgcttcgagcggagccacgactcccagggcaagatcagcgggagccccctggacatcaccgccatccgcggcagcttctccgtgaactaccgggggctgcgcctcagcctgtccgagatcacggccacgtgcaccggcgaggtcaccaacgtgagcggctgctactcctgcatgaccggggccaaggtgagcatcaagctgcactccagcaagaactccacggcgcacgtccgctgcaagggcgacgagaccgccttcagcgtgctcgagggggtgcactcctacagcgtcagcctgtccttcgaccacgccgtggtggacgagcagtgccagctgaactgcggcgggcacgagagccaggtcaccctccggggcaacctgatcttcctggacgtgcccaagttcgtggacggctcctacatgcagacctaccacagcacggtccccaccggggccaacatcccgtcccccaccgactggctcaacgccctgttcggcaacgggctgagccgctggatcctcggcgtgatcggcgtcctgctcgggggcctggcgctgttcttcctgatcatgtccctcttcaagctggggaccaagcagatcttccggagccgcacgaagctggcctga

SEQ ID NO: 13220 - RNA, 3222 nt, synthetic construct
  misc_feature 1..3222: note = derived and/or modified CDS sequence (opt1) from SFTSV(HNXY_191)__KC292323.1__GP
  source 1..3222: mol_type = other RNA
atgatgaaggtgatctggttcagctccctgatctgcctcgtcatccagtgcggcggggacaccggccccatcatctgcgccgggccgacccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccacgttcgacggctacgtggggtggggctgcgggagcggcaagtcccgcaccgagagcggcgagctctgctccagcgacagcgggacctccagcggcctgctgccctccgaccgggtcctctggatcggggacgtggcctgccagccgatgacccccatccccgaggagacgttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagaccaagtgggtgcaggagtccagctccaaggacttcgtctgctacaaggagggcaccgggccctgcagcgagtccgaggagaagacctgcaagacgagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccaccctggaggtgagccagcccgagcagcgcatcgggcagtgcaccggctgccacctcgagtgcatcaacgggggcgtgcggctgatcaccctgacgagcgagctcaagtccgcgaccgtctgcgccagccacttctgctccagcgccacctccggcaagaagtccaccgagatccagttccactccgggagcctggtgggcaagacggccatccacgtcaagggggccctggtggacggcaccgagttcaccttcgagggctcctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcacgaacgtgctgaaggccatcggcgtgtgggggagctgggtcatcgcccccgtgaagctggtgttcgcgatcatcaagaagctcatgcgggccgtctcctgcctgatgggcaagctgatggaccgcggccgccaggtgatccacgaggagatcggggagaaccgggagggcaaccaggacgacgtgcggatcgagatggcccgcccccgccgggtccgccactggatgtacagccccgtgatcctcaccatcctggccatcgggctggccgagggctgcgacgagatggtgcacgcggactccaagctcgtcagctgccggcaggggtccggcaacatgaaggagtgcgtgaccaccggccgcgccctgctgccggccgtgaaccccgggcaggaggcctgcctccacttcacggcccccggcagccccgactccaagtgcctgaagatcaaggtcaagcggatcaacctgaagtgcaagaagtccagcagctacttcgtgccggacgcgcgcagccggtgcacctccgtgcgccggtgccgctgggccggggactgccagagcggctgcccgccccacttcacctccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtcgagaacccccacggcatcatctggaaggtgtccccctgcgccgcgtgggtgcccagcgccgtcatcgagctgaccatgccgtccggcgaggtgcggacgttccaccccatgagcgggatccccacccaggtgttcaagggcgtctccgtgacctacctggggagcgacatggaggtgtccggcctcaccgacctgtgcgagatcgaggagctcaagagcaagaagctggccctggccccctgcaaccaggccggcatgggggtcgtgggcaaggtgggggagatccagtgctccagcgaggagagcgcgcgcacgatcaagaaggacggctgcatctggaacgccgacctggtcgggatcgagctgcgggtggacgacgccgtgtgctactccaagatcaccagcgtcgaggccgtggccaactactccgcgatcccgaccaccatcggcggcctccgcttcgagcggagccacgactcccaggggaagatcagcggcagccccctggacatcacggccatccgcgggagcttctccgtgaactaccggggcctgcgcctcagcctgtccgagatcaccgcgacctgcaccggggaggtcaccaacgtgagcggctgctactcctgcatgacgggcgccaaggtgagcatcaagctgcactccagcaagaactccaccgcccacgtccgctgcaagggggacgagaccgccttcagcgtgctcgagggcgtgcactcctacagcgtcagcctgtccttcgaccacgccgtggtggacgagcagtgccagctgaactgcgggggccacgagagccaggtcaccctccgggggaacctgatcttcctggacgtgcccaagttcgtggacggctcctacatgcagacgtaccacagcaccgtccccaccggcgccaacatcccgtcccccaccgactggctcaacgccctgttcgggaacggcctgagccgctggatcctcggggtgatcggcgtcctgctgggcgggctcgcgctgttcttcctgatcatgtccctcttcaagctgggcacgaagcagatcttccggagccgcaccaagctggcctga

SEQ ID NO: 13221 - RNA, 3222 nt, synthetic construct
  misc_feature 1..3222: note = derived and/or modified CDS sequence (opt1) from SFTSV(HNXY_195)__KC292326.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctccaggggtacagcgagaagatctgccagatcgaccgcctgatccacgtgtccagctggctgcggaaccactcccagttccagggctacgtggggcagcgcggcggccggagccaggtctcctactaccccgcggagaacagctactcccgctggagcgggctcctgtccccctgcgacgccgactggctgggcatgctcgtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctgctcccctccgaccgggtcctgtggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggggaggtcgtggtgagctacggcggcatgcgggtccgcccgaagtgctacgggttcagccggatgatggccaccctcgaggtgaaccagcccgagcagcgcatcggccagtgcacggggtgccacctggagtgcatcaacggcggggtgcggctgatcaccctcacctccgagctgaagtccgcgaccgtctgcgcctcccacttctgcagctccgccacgagcggcaagaagtccaccgagatccagttccacagcggctccctggtggggaagaccgccatccacgtcaagggcgccctcgtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctcctggggtacgccggcctgatgctcctgaccaacgtgctgaaggccatcgggatctggggctcctgggtgatcgcccccgtcaagctcatcttcgcgatcatcaagaagctgatgcggaccgtgagctgcctgatggggaagctcatggaccgcggccgccaggtgatccacgaggagatcggcgagaaccgggaggggaaccaggacgacgtccggatcgagatggcccgcccccgccgggtgcgccactggatgtactcccccgtgatcctgacgatcctggccatcggcctcgccgagagctgcgacgagatggtccacgccgactccaagctggtgagctgccggcaggggtccggcaacatgaaggagtgcgtgaccaccgggcgcgcgctgctcccggccgtcaaccccggccaggaggcctgcctgcacttcaccgcccccggcagccccgacagcaagtgcctgaagatcaaggtgaagcggatcaacctcaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctgaccatgccgtccggggaggtgcggaccttccaccccatgagcggcatccccacgcaggtcttcaagggcgtgtccgtgacctacctcgggagcgacatggaggtctccggcctgaccgacctgtgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctccgggtggacgacgccgtctgctactccaagatcacgagcgtggaggccgtggccaactactccgccatcccgaccaccatcggcgggctgcgcttcgagcggagccacgactcccagggcaagatcagcggcagccccctggacatcaccgcgatccgcgggagcttctccgtcaactaccggggcctccgcctgagcctgtccgagatcacggcgacctgcaccggggaggtgaccaacgtgagcggctgctactcctgcatgaccggggccaaggtcagcatcaagctccactccagcaagaactccacggcccacgtgcgctgcaagggcgacgagaccgccttcagcgtgctggagggcgtccacagctacaccgtgtccctgagcttcgaccacgccgtggtcgacgagcagtgccagctcaactgcgggggccacgagtcccaggtgaccctgaaggggaacctgatcttcctcgacgtgcccaagttcgtcgacggcagctacatgcagacgtaccactccaccgtgcccaccggggccaacatcccgagccccaccgactggctgaacgccctgttcggcaacggcctctcccggtggatcctgggggtgatcggcgtcctgctcgggggcctggccctgttcttcatgatcatgagcctcttcaagctgggcacgaagcaggtcttccgctcccggaccaagctggcgtga

SEQ ID NO: 13222 - RNA, 3222 nt, synthetic construct
  misc_feature 1..3222: note = derived and/or modified CDS sequence (opt1) from SFTSV(HNXY_2)__KC292318.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccggggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcatgtcccggtggatcctgggggtgatcggcgtcctgctcgggggcctggccctgttcttcatgatcatgagcctcttcaagctgggcacgaagcaggtcttccgctcccggaccaagctggcgtga

SEQ ID NO: 13223 - RNA, 3222 nt, synthetic construct
  misc_feature 1..3222: note = derived and/or modified CDS sequence (opt1) from SFTSV(HNXY_202)__KC292325.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccaaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctccggatcaaggtgaagaagatcaacctgaagtgcaagcgctccagctcctacttcgtgccggacgcccggagccgctgcacgtccgtccggcgctgccggtgggcgggggactgccagagcggctgcccgccccacttcacctccaacagcttctccgacgactgggccgggaagatggaccgcgccggcctggggttcagcggctgctccgacggctgcgggggcgccgcgtgcgggtgcttcaacgccgcccccagctgcatcttctggcggaagtgggtggagaacccccacggcatcatctggaaggtgtccccctgcgccgcctgggtccccagcgcggtgatcgagctcaccatgccgtccggggaggtgcgcaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccggaccatcaagaaggacggctgcatctggaacgcggacctggtggggatcgagctgcgcgtggacgacgccgtctgctactccaagatcacgagcgtggaggccgtggccaactactccgccatcccgaccaccatcggcgggctgcggttcgagcgcagccacgactcccagggcaagatcagcggcagccccctcgacatcaccgcgatccgggggagcttctccgtcaactaccgcggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcggtgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcctgtcccgctggatcctgggggtgatgggcgtcctcctcgggggcctggccctgttcttcatgatcatgagcctgttcaagctgggcacgaagcaggtcttccggtcccgcaccaagctcgcgtga

SEQ ID NO: 13224 - RNA, 3222 nt, synthetic construct
  misc_feature 1..3222: note = derived and/or modified CDS sequence (opt1) from SFTSV(HNXY_206)__KC292302.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgagccagcccgagcagcgcatcgggcagtgcaccggctgccacctcgagtgcatcaacgggggcgtgcggctgatcaccctgaccagcgagctcaagtccgcgacggtctgcgccagccacttctgctccagcgccacctccggcaagaagtccaccgagatccagttccactccgggagcctggtgggcaagaccgccatccacgtcaagggggccctggtggacggcacggagttcaccttcgagggctcctgcatgttccccgacgggtgcgacgcggtggactgcaccttctgccgcgagttcctcaagaacccccagtgctacccgaccaagaagtggctgttcatcatcatcgtcatcctgctcggctacgccgggctgatgctgctcacgaacgtgctgaaggccatcggcgtgtgggggagctgggtcatcgcccccgtgaagctggtgttcgccatcatcaagaagctcatgcgggcggtctcctgcctgatgggcaagctgatggaccgcggccgccaggtgatccacgaggagatcggggagaaccgggagggcaaccaggacgacatccggatcgagatggcccgcccccgccgggtgcgccactggatgtacagccccgtcatcctcaccatcctggccatcgggctggccgagggctgcgacgagatggtgcacgccgactccaagctcgtgagctgccggcaggggtccggcaacatgaaggagtgcgtcaccaccggccgcgcgctgctgccggccgtgaaccccgggcaggaggcctgcctccacttcacgacccccggcagccccgactccaagtgcctgaagatcaaggtgaagcggatcaacctgaagtgcaagaagtccagcagctacttcgtcccggacgcccgcagccggtgcacctccgtgcgccggtgccgctgggccggggactgccagagcggctgcccgccccacttcacctccaacagcttctccgacgactgggcggggaagatggaccgggccggcctcggcttcagcgggtgctccgacggctgcgggggcgccgcctgcgggtgcttcaacgcggcccccagctgcatcttctggcgcaagtgggtggagaacccccacggcatcatctggaaggtctccccctgcgccgcctgggtgcccagcgccgtgatcgagctgacgatgccgtccggcgaggtccggaccttccaccccatgagcgggatccccacccaggtgttcaagggcgtgtccgtcacctacctggggagcgacatggaggtgtccggcctcacggacctgtgcgagatcgaggagctcaagagcaagaagctggcgctggccccctgcaaccaggccggcatgggggtggtcggcaaggtgggggagatccagtgctccagcgaggagagcgcccgcaccatcaagaaggacggctgcatctggaacgccgacctggtggggatcgagctgcgggtcgacgacgcggtgtgctactccaagatcaccagcgtggaggccgtcgccaactactccgccatcccgaccacgatcggcggcctccgcttcgagcggagccacgactcccaggggaagatcagcggcagccccctggacatcaccgccatccgcgggagcttctccgtgaactaccggggcctgcgcctcagcctgtccgagatcaccgcgacctgcaccggggaggtgacgaacgtcagcggctgctactcctgcatgaccggcgccaaggtgagcatcaagctgcactccagcaagaactccaccgcccacgtgcgctgcaagggggacgagaccgccttcagcgtcctcgagggcgtgcactcctacagcgtgagcctgtccttcgaccacgcggtcgtggacgagcagtgccagctgaactgcgggggccacgagagccaggtgacgctccgggggaacctgatcttcctggacgtccccaagttcgtggacggctcctacatgcagacctaccacagcaccgtgcccaccggcgccaacatcccgtcccccacggactggctcaacgccctgttcgggaacggcctgagccgctggatcctcggggtcatcggcgtgctgctgggcgggctcgccctgttcttcctgatcatgtccctcttcaagctgggcaccaagcagatcttccggagccgcaccaagctggcctga

SEQ ID NO: 13225 - RNA, 3222 nt, synthetic construct
  misc_feature 1..3222: note = derived and/or modified CDS sequence (opt1) from SFTSV(HNXY_207)__KC292315.1__GP
  source 1..3222: mol_type = other RNA
atgatgaaggtgatctggttccccagcctgatctgcttcgtgatccagtgctccggcgacagcgggccgatcatctgcgccggccccatccactccaacaagagcgccgacatcccccacctcctggggtactccgagaagatctgccagatcgaccgcctgatccacgtgagctcctggctccggaaccacagccagttccagggctacgtggggcagcgcggcggccggtcccaggtcagctactaccccgcggagaactcctacagccgctggtccgggctgctgagcccgtgcgacgccgactggctcggcatgctggtggtgaagaaggccaaggggtccgacatgatcgtccccggccccagctacaaggggaaggtgttcttcgagcggcccaccttcgacggctacgtgggctgggggtgcggctccggcaagagccgcaccgagtccggggagctgtgcagcagcgactccggcacgagctccgggctcctgccgagcgaccgggtcctgtggatcggcgacgtggcctgccagcccatgacccccatccccgaggagaccttcctcgagctgaagtccttcagccagtccgagttcccggacatctgcaagatcgacgggatcgtgttcaaccagtgcgagggcgagagcctgccccagcccttcgacgtcgcctggatggacgtggggcactcccacaagatcatcatgcgcgagcacaagaccaagtgggtgcaggagagctccagcaaggacttcgtctgctacaaggagggcacgggcccctgctccgagagcgaggagaagacctgcaagacctccgggagctgccggggcgacatgcagttctgcaaggtggcggggtgcgagcacggcgaggaggcctccgaggccaagtgccgctgcagcctcgtgcacaagccgggggaggtcgtggtgtcctacggcggcatgcgggtccgccccaagtgctacgggttcagccggatgatggccaccctggaggtgaaccagcccgagcagcgcatcggccagtgcacggggtgccacctggagtgcatcaacggcggggtgcggctcatcaccctgaccagcgagctgaagtccgcgaccgtctgcgccagccacttctgctccagcgccacgtccggcaagaagtccaccgagatccagttccacagcggcagcctcgtggggaagaccgccatccacgtcaagggcgccctggtggacgggaccgagttcacgttcgagggctcctgcatgttccccgacggctgcgacgcggtggactgcaccttctgccgcgagttcctgaagaacccgcagtgctaccccgccaagaagtggctgttcatcatcatcgtcatcctgctggggtacgccggcctcatgctgctgaccaacgtgctcaaggccatcgggatctggggcagctgggtgatcgcccccgtcaagctgatgttcgcgatcatcaagaagctgatgcggaccgtgtcctgcctcatggggaagctgatggaccgcggccgccaggtgatccacgaggagatcggcgagaaccgggaggggaaccaggacgacgtccggatcgagatggcccgcccccgccgggtgcgccactggatgtacagcccggtgatcctgacgatcctcgccatcggcctggccgagtcctgcgacgagatggtccacgccgacagcaagctggtgtcctgccggcaggggagcggcaacatgaaggagtgcgtgaccaccgggcgcgcgctcctgcccgccgtcaaccccggccaggaggcctgcctgcacttcaccgcccccggctccccggacagcaagtgcctcaagatcaaggtgaagcggatcaacctgaagtgcaagaagtccagcagctacttcgtgcccgacgcccgctcccggtgcacgagcgtccgccggtgccgctgggcgggggactgccagtccggctgcccgccccacttcaccagcaactccttcagcgacgactgggccgggaagatggaccgggccggcctggggttctccggctgcagcgacggctgcgggggcgccgcgtgcgggtgcttcaacgccgccccctcctgcatcttctggcgcaagtgggtggagaacccccacggcatcatctggaaggtgagcccctgcgccgcctgggtcccgtccgcggtgatcgagctcaccatgcccagcggggaggtgcggaccttccaccccatgtccggcatccccacgcaggtcttcaagggcgtgagcgtgacctacctggggtccgacatggaggtcagcggcctgaccgacctctgcgagatcgaggagctgaagtccaagaagctggccctggccccgtgcaaccaggccgggatgggcgtggtgggcaaggtcggggagatccagtgcagcagcgaggagtccgcccgcaccatcaagaaggacggctgcatctggaacgcggacctcgtggggatcgagctgcgggtggacgacgccgtctgctacagcaagatcacgtccgtggaggccgtggccaactacagcgccatccccaccaccatcggcgggctgcgcttcgagcggtcccacgacagccagggcaagatctccggcagccccctcgacatcaccgcgatccgcgggtccttcagcgtcaactaccggggcctgcgcctgtccctcagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttctccgtgctggagggcgtccacagctacaccgtgagcctctccttcgaccacgccgtggtcgacgagcagtgccagctgaactgcgggggccacgagagccaggtgaccctgaaggggaacctcatcttcctggacgtgcccaagttcgtcgacggctcctacatgcagacgtaccacagcaccgtgccgaccggggccaacatcccctcccccaccgactggctgaacgccctcttcggcaacggcctgagccggtggatcctgggggtgatcggcgtcctcctcgggggcctggccctcttcttcatgatcatgtccctgttcaagctgggcacgaagcaggtcttccgcagccggaccaagctcgcgtga

SEQ ID NO: 13226 - RNA, 3222 nt, synthetic construct
  misc_feature 1..3222: note = derived and/or modified CDS sequence (opt1) from SFTSV(HNXY_224)__KC292317.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcgtcgtgatcctgctggggtacgccggcctcatgctgctgaccaacgtgctcaaggccatcgggatctggggctcctgggtcatcgcccccgtgaagctgatgttcgcgatcatcaagaagctgatgcggaccgtgagctgcctcatggggaagctgatggaccgcggccggcaggtcatccacgaggagatcggcgagaaccgcgaggggaaccaggacgacgtgcggatcgagatggcccgcccccgccgggtgcgccactggatgtactcccccgtcatcctgacgatcctcgccatcggcctgaccgagagctgcgacgagatggtgcacgccgactccaagctggtgagctgccggcaggggtccggcaacatgaaggagtgcgtcaccaccgggcgcgccctcctgccggcggtgaaccccggccaggaggcctgcctgcacttcacggcccccggcagccccgacagcaagtgcctcaagatcaaggtgaagcggatcaacctgaagtgcaagaagtccagctcctacttcgtcccggacgcccgcagccggtgcacctccgtgcgccggtgccgctgggccggggactgcgagagcggctgcccgccccacttcacctccaacagcttctccgacgactgggcggggaagatggaccgggccggcctggggttcagcggctgctccgacggctgcgggggcgccgcctgcgggtgcttcaacgcggcccccagctgcatcttctggcgcaagtgggtggagaacccccacggcatcatctggaaggtctccccctgcgccgcctgggtgcccagcgccgtgatcgagctcaccatgccgtccggggaggtccggacgttccagcccatgagcggcatccccacccaggtgttcaagggcgtgtccgtcacctacctggggagcgacatggaggtgtccggcctgaccgacctctgcgagatcgaggagctcaagagcaagaagctggcgctggccccctgcaaccaggccgggatgggcgtggtcggcaaggtgggggagatccagtgcagctccgaggagagcgcccgcacgatcaagaaggacggctgcatctggaacgccgacctggtggggatcgagctgcgggtcgacgacgcggtgtgctactccaagatcaccagcgtggaggccgtcgccaactactccgccatcccgaccaccatcggcgggctgcgcttcgagcggagccacgactcccagggcaagatcagcggcagccccctcgacatcacggccatccgcgggagcttctccgtgaactaccggggcctgcgcctgagcctctccgagatcaccgcgacctgcaccggggaggtgaccaacgtcagcggctgctactcctgcatgacgggggccaaggtgagcatcaagctgcactccagcaagaactccaccgcccacgtgcgctgcaagggcgacgagaccgccttcagcgtcctggagggcgtgcacagctacaccgtgtccctcagcttcgaccacgcggtcgtggacgagcagtgccagctgaactgcgggggccacgagtcccaggtgacgctgaaggggaacctcatcttcctggacgtccccaagttcgtggacggcagctacatgcagacctaccactccaccgtgcccaccggggccaacatcccgagccccacggactggctgaacgccctcttcggcaacggcctgtcccggtggatcctgggggtcatcggcgtgctcctcgggggcctggccctgttcttcatgatcatgagcctgttcaagctgggcaccaagcaggtcttccgctcccggaccaagctcgcctga

SEQ ID NO: 13227 - RNA, 3222 nt, synthetic construct
  misc_feature 1..3222: note = derived and/or modified CDS sequence (opt1) from SFTSV(HNXY_231)__KC292313.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgggatcccccacctcctgggctacagcgagaagatctgccagatcgaccgcctgatccacgtgtccagctggctccggaaccactcccagttccaggggtacgtgggccagcgcggcgggcggagccaggtctcctactaccccgcggagaacagctactcccgctggagcggcctgctgtccccctgcgacgccgactggctcgggatgctggtggtgaagaaggccaagggcagcgacatgatcgtcccggggccctcctacaagggcaaggtgttcttcgagcggcccaccttcgacggctacgtggggtggggctgcgggagcggcaagtcccgcaccgagagcggcgagctgtgcagctccgacagcgggacgtccagcggcctcctgccctccgaccgggtcctgtggatcggggacgtggcctgccagccgatgacccccatccccgaggagaccttcctcgagctgaagtccttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagaccaagtgggtgcaggagtccagctccaaggacttcgtctgctacaaggagggcacggggccctgcagcgagtccgaggagaagacctgcaagaccagcggctcctgccgcggggacatgcagttctgcaaggtggcgggctgcgagcacggggaggaggccagcgaggccaagtgccggtgctccctcgtgcacaagcccggcgaggtcgtggtgagctacggcgggatgcgggtccgcccgaagtgctacggcttcagccggatgatggccaccctggaggtgaaccagcccgagcagcgcatcgggcagtgcacgggctgccacctggagtgcatcaacgggggcgtgcggctcatcaccctgacctccgagctcaagagcgcgaccgtctgcgcctcccacttctgcagctccgccacgagcggcaagaagtccaccgagatccagttccacagcgggtccctcgtgggcaagaccgccatccacgtcaagggggccctggtggacggcaccgagttcacgttcgagggcagctgcatgttccccgacgggtgcgacgcggtggactgcaccttctgccgcgagttcctgaagaacccccagtgctacccggccaagaagtggctgttcatcatcatcgtcatcctgctgggctacgccgggctcatgctgctgaccaacgtgctcaaggccatcggcatctgggggtcctgggtgatcgcccccgtcaagctgatcttcgcgatcatcaagaagctgatgcggaccgtgagctgcctcatgggcaagctgatggaccgcggccgccaggtgatccacgaggagatcggggagaaccgggagggcaaccaggacgacgtccggatcgagatggcccgcccccgccgggtgcgccactggatgtactcccccgtgatcctgacgatcctcgccatcgggctggccgagagctgcgacgagatggtccacgccgactccaagctggtgagctgccggcagggctccgggaacatgaaggagtgcgtgaccaccggccgcgcgctcctgccggccgtcaaccccggccaggaggcctgcctgcacttcaccgcccccgggagccccgacagcaagtgcctcaagatcaaggtgaagcggatcaacctgaagtgcaagaagtccagctcctacttcgtgccggacgcccgcagccggtgcacgtccgtccgccggtgccgctgggcgggcgactgccagagcgggtgcccgccccacttcacctccaacagcttctccgacgactgggccggcaagatggaccgggccgggctgggcttcagcggctgctccgacgggtgcggcggggccgcgtgcggctgcttcaacgccgcccccagctgcatcttctggcgcaagtgggtggagaacccccacgggatcatctggaaggtgtccccctgcgccgcctgggtccccagcgcggtgatcgagctcaccatgccgtccggcgaggtgcggaccttccaccccatgagcggcatccccacgcaggtcttcaagggggtgtccgtgacctacctgggcagcgacatggaggtctccgggctgaccgacctctgcgagatcgaggagctcaagagcaagaagctggccctggccccctgcaaccaggccggcatgggcgtggtggggaaggtcggcgagatccagtgcagctccgaggagagcgcccgcaccatcaagaaggacgggtgcatctggaacgcggacctggtgggcatcgagctgcgggtggacgacgccgtctgctactccaagatcacgagcgtggaggccgtggccaactactccgccatcccgaccaccatcgggggcctgcgcttcgagcggagccacgactcccagggcaagatcagcgggagccccctcgacatcaccgcgatccgcggcagcttctccgtcaactaccgggggctgcgcctgagcctctccgagatcacggcgacctgcaccggcgaggtgaccaacgtgagcgggtgctactcctgcatgaccggcgccaaggtcagcatcaagctgcactccagcaagaactccacggcccacgtgcgctgcaagggcgacgagaccgccttcagcgtgctggagggggtccacagctacaccgtgtccctcagcttcgaccacgccgtggtcgacgagcagtgccagctgaactgcggcgggcacgagtcccaggtgaccctgaagggcaacctcatcttcctggacgtgcccaagttcgtcgacgggagctacatgcagacgtaccactccaccgtgcccaccggcgccaacatcccgagccccaccgactggctgaacgccctcttcggcaacgggctgtcccggtggatcctgggcgtgatcggggtcctcctgggcggcctggccctcttcttcatgatcatgagcctgttcaagctggggacgaagcaggtcttccgctcccggaccaagctcgcgtga

SEQ ID NO: 13228 - RNA, 3222 nt, synthetic construct
  misc_feature 1..3222: note = derived and/or modified CDS sequence (opt1) from SFTSV(HNXY_245)__KC292320.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccaaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctccggatcaaggtgaagcgcatcaacctgaagtgcaagaagtccagctcctacttcgtgccggacgcccggagccgctgcacgtccgtccggcgctgccggtgggcgggggactgccagagcggctgcccgccccacttcacctccaacagcttctccgacgactgggccgggaagatggaccgcgccggcctggggttcagcggctgctccgacggctgcgggggcgccgcgtgcgggtgcttcaacgccgcccccagctgcatcttctggcggaagtgggtggagaacccccacggcatcatctggaaggtgtccccctgcgccgcctgggtccccagcgcggtgatcgagctcaccatgccgtccggggaggtgcgcaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccggaccatcaagaaggacggctgcatctggaacgcggacctggtggggatcgagctgcgcgtggacgacgccgtctgctactccaagatcacgagcgtggaggccgtggccaactactccgccatcccgaccaccatcggcgggctgcggttcgagcgcagccacgactcccagggcaagatcagcggcagccccctcgacatcaccgcgatccgggggagcttctccgtcaactaccgcggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcggtgcaagggcgacgagaccgccttcagcgtgctggagggcgtccacagctacaccatctccctcagcttcgaccacgccgtggtggacgagcagtgccagctgaactgcgggggccacgagtcccaggtcaccctgaaggggaacctcatcttcctggacgtgcccaagttcgtggacggcagctacatgcagacgtaccactccaccgtccccaccggggccaacatcccgagccccaccgactggctgaacgccctcttcggcaacggcctgtcccgctggatcctgggggtgatgggcgtgctcctcgggggcctggccctgttcttcatgatcatgagcctgttcaagctgggcacgaagcaggtcttccggtcccgcaccaagctcgcgtga

SEQ ID NO: 13229 - RNA, 3222 nt, synthetic construct
  misc_feature 1..3222: note = derived and/or modified CDS sequence (opt1) from SFTSV(HNXY_262)__KC292309.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccgcgtctcctactaccccgcggagaacagctactcccggtggagcgggctgctgtccccctgcgacgccgactggctcggcatgctggtggtgaagaaggccaaggggagcgacatgatcgtcccgggcccctcctacaaggggaaggtgttcttcgagcgccccaccttcgacggctacgtgggctgggggtgcggcagcgggaagtcccggaccgagagcggcgagctgtgcagctccgacagcggcacgtccagcgggctcctgccctccgaccgcgtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgggagcacaagaccaagtgggtgcaggagtccagctccaaggacttcgtctgctacaaggagggcacgggcccctgcagcgagtccgaggagaagacctgcaagaccagcgggtcctgccgcggcgacatgcagttctgcaaggtggcggggtgcgagcacggcgaggaggccagcgaggccaagtgccggtgctccctcgtgcacaagcccggggaggtcgtggtgagctacggcggcatgcgcgtccggccgaagtgctacgggttcagccgcatgatggccaccctggaggtgaaccagcccgagcagcggatcggccagtgcacggggtgccacctggagtgcatcaacggcggggtgcgcctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgggagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcgcaccgtgagctgcctcatggggaagctgatggaccggggccgccaggtgatccacgaggagatcggcgagaaccgggaggggaaccaggacgacgtccgcatcgagatggcccgcccccggcgcgtgcggcactggatgtactcccccgtgatcctgacgatcctcgccatcggcctggccgagagctgcgacgagatggtccacgccgactccaagctggtgagctgccgccaggggtccggcaacatgaaggagtgcgtgaccaccgggcgggcgctcctgccggccgtcaaccccggccaggaggcctgcctgcacttcaccgcccccggcagccccgacagcaagtgcctcaagatcaaggtgaagcgcatcaacctgaagtgcaagaagtccagctcctacttcgtgccggacgcccggagccgctgcacgtccgtccggcgctgccggtgggcgggggactgccagagcggctgcccgccccacttcacctccaacagcttctccgacgactgggccgggaagatggaccgcgccggcctggggttcagcggctgctccgacggctgcgggggcgccgcgtgcgggtgcttcaacgccgcccccagctgcatcttctggcggaagtgggtggagaacccccacggcatcatctggaaggtgtccccctgcgccgcctgggtccccagcgcggtgatcgagctcaccatgccgtccggggaggtgcgcaccttccaccccatgagcggcatccccacgcaggtcttcaagggcgtgtccgtgacctacctggggagcgacatggaggtctccggcctgaccgacctctgcgagatcgaggagctgcggagcaagaagctggccctggccccctgcaaccaggccgggatgggcgtggtgggcaaggtcggggagatccagtgcagctccgaggagagcgcccgcaccatcaagaaggacggctgcatctggaacgcggacctcgtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccgcggcctgcggctgagcctctccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcctgtcccggtggatcctgggggtgatgggcgtcctcctcgggggcctggccctgttcttcatgatcatgagcctgttcaagctgggcacgaagcaggtcttccgctcccggaccaagctcgcgtga

SEQ ID NO: 13230 - RNA, 3222 nt, synthetic construct
  misc_feature 1..3222: note = derived and/or modified CDS sequence (opt1) from SFTSV(HNXY_278)__KC292322.1__GP
  source 1..3222: mol_type = other RNA
atgatgaaggtgatctggttcagctccctgatctgcctcgtcatccagtgcggcggggacaccggccccatcatctgcgccgggccgacccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccacgttcgacggctacgtggggtggggctgcgggagcggcaagtcccgcaccgagagcggcgagctctgctccagcgacagcgggacctccagcggcctgctgccctccgaccgggtcctctggatcggggacgtggcctgccagccgatgacccccatccccgaggagacgttcctggagctgaagtccttctcccagagcgagttccccgacatctgcaagatcgacggcatcgtgttcaaccagtgcgagggggagtccctcccgcagcccttcgacgtcgcctggatggacgtgggccacagccacaagatcatcatgcgcgagcacaagaccaagtgggtgcaggagtccagctccaaggacttcgtctgctacaaggagggcaccgggccctgcagcgagtccgaggagaagacctgcaagacgggcgggagctgccggggcgacatgcagttctgcaaggtggcggggtgcgagcacggcgaggaggcctccgaggccaagtgccgctgcagcctggtgcacaagcccggcgaggtcgtggtgtcctacgggggcatgcgggtccgcccgaagtgctacgggttcagccggatgatggccaccctggaggtgtcccagcccgagcagcgcatcggccagtgcaccgggtgccacctcgagtgcatcaacggcggcgtgcggctgatcaccctgacgagcgagctcaagagcgcgaccgtctgcgcctcccacttctgcagctccgccaccagcgggaagaagtccaccgagatccagttccacagcggctccctggtggggaagacggccatccacgtcaagggcgccctggtggacggcaccgagttcaccttcgaggggagctgcatgttccccgacggctgcgacgcggtggactgcaccttctgccgcgagttcctcaagaacccccagtgctacccggccaagaagtggctgttcatcatcatcgtcatcctgctcgggtacgccggcctgatgctgctcacgaacgtgctgaaggccatcggggtgtggggctcctgggtcatcgcccccgtgaagctggtgttcgcgatcatcaagaagctcatgcgggccgtcagctgcctgatgggcaagctgatggaccgcgggcgccaggtgatccacgaggagatcggcgagaaccgggaggggaaccaggacgacgtgcggatcgagatggcccgcccccgccgggtccgccactggatgtactcccccgtgatcctcaccatcctggccatcggcctggccgaggggtgcgacgagatgatccacgcggacagcaagctcgtgtcctgccggcagggcagcggcaacatgaaggagtgcgtcaccaccgggcgcgccctgctgccggccgtgaaccccggccaggaggcctgcctccacttcacggcccccgggtcccccgacagcaagtgcctgaagatcaaggtgaagcggatcaacctgaagtgcaagaagtccagcagctacttcgtcccggacgcgcgctcccggtgcaccagcgtgcgccggtgccgctgggccggcgactgccagtccgggtgcccgccccacttcacccccaacagcttctccgacgactgggccggcaagatggaccgggccggcctcgggttcagcggctgctccgacgggtgcggcggggcggcctgcggctgcttcaacgccgcccccagctgcatcttctggcgcaagtgggtggagaacccccacggcatcatctggaaggtctccccctgcgccgcgtgggtgccgagcgccgtgatcgagctgaccatgccctccggggaggtccggacgttccaccccatgagcggcatccccacccaggtgttcaagggggtgtccgtcacctacctgggcagcgacatggaggtgtccggcctcaccgacctgtgcgagatcgaggagctcaagagcaagaagctggccctggccccgtgcaaccaggccgggatgggcgtggtcgggaaggtgggcgagatccagtgctccagcgaggagtccgcgcgcacgatcaagaaggacgggtgcatctggaacgccgacctggtgggcatcgagctgcgggtcgacgacgccgtgtgctacagcaagatcaccagcgtggaggccgtcgccaactactccgcgatccccaccaccatcggcgggctccgcttcgagcggagccacgactcccagggcaagatcagcgggagccccctggacatcacggccatccgcggcagcttctccgtgaactaccgggggctgcgcctcagcctgtccgagatcaccgcgacctgcaccggcgaggtgaccaacgtcagcggctgctactcctgcatgacgggggccaaggtgagcatcaagctgcactccagcaagaactccaccgcccacgtgcgctgcaagggcgacgagaccgccttcagcgtcctcgagggggtgcactcctacagcgtgtccctgagcttcgaccacgccgtcgtggacgagcagtgccagctgaactgcggcgggcacgagagccaggtgaccctccggggcaacctgatcttcctggacgtccccaagttcgtggacggctcctacatgcagacgtaccacagcaccgtgccgaccggggccaacatcccctcccccaccgactggctcaacgccctgttcggcaacgggctgagccgctggatcctcggcgtcatcggcgtgctgctcgggggcctggcgctgttcttcctgatcatgtccctcttcaagctggggacgaagcagatcttccggagccgcaccaagctggcctga

SEQ ID NO: 13231 - RNA, 3222 nt, synthetic construct
  misc_feature 1..3222: note = derived and/or modified CDS sequence (opt1) from SFTSV(HNXY_31)__KC292310.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccggggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctggagggcgtccacagctactccgtgagcctctccttcgaccacgccgtggtcgacgagcagtgccagctgaactgcgggggccacgagagccaggtgaccctgcgggggaacctcatcttcctggacgtgcccaagttcgtcgacggctcctacatgcagacctaccacagcacggtgcccaccggggccaacatcccgtcccccaccgactggctgaacgccctcttcggcaacggcctgagccgctggatcctgggggtgatcggcgtcctcctcgggggcctggccctgttcttcatgatcatgtccctgttcaagctgggcaccaagcaggtcttccggagccgcacgaagctcgcgtga

SEQ ID NO: 13232 - RNA, 3222 nt, synthetic construct
  misc_feature 1..3222: note = derived and/or modified CDS sequence (opt1) from SFTSV/FTLSV(2011YGS5)__KF711925.1__GP
  source 1..3222: mol_type = other RNA
atgatgaaggtgatctggttcagctccctggtgtgcctcgtgatccagtgcagcggcgactccgggcccatcatctgcgccggcccgatccacagcaacaagtccgccgcgatcccccacctcctggggtacagcgagaagatctgccagatcgaccgcctcatccacgtgtccagctggctgcggaaccactcccagttccagggctacgtcgggcagcgcggcggccggagccaggtgtcctactaccccgccgagaacagctactcccgctggagcgggctgctctccccctgcgacgccgactggctgggcatgctggtggtcaagaaggccaaggggagcgacatgatcgtgccgggcccctcctacaaggggaaggtgttcttcgagcggcccaccttcgacggctacgtcggctgggggtgcggcagcgggaagtcccgcaccgagagcggcgagctctgcagctccgacagcggcacgtccagcgggctgctgccctccgaccgggtgctctggatcggcgacgtggcctgccagccgatgacccccatccccgaggagaccttcctggagctcaagagcttctcccagagcgagttccccgacatctgcaagatcgacgggatcgtcttcaaccagtgcgagggcgagtccctcccgcagcccttcgacgtggcgtggatggacgtggggcacagccacaagatcatcatgcgcgagcacaagaccaagtgggtccaggagtccagctccaaggacttcgtgtgctacaaggagggcacgggcccctgcagcgagtccgaggagaaggcctgcaagaccagcgggtcctgccggggcgacatgcagttctgcaaggtggccgggtgcgagcacggcgaggaggccagcgaggcgaagtgccgctgctccctggtccacaagcccggggaggtggtggtcagctacggcggcatgcgggtgcgcccgaagtgctacgggttcagccggatgatggccaccatggaggtgaacccgcccgagcagcgcatcggccagtgcaccgggtgccacctggagtgcatcaacggcggggtccggctcatcacgctgacctccgagctcaagagcgccaccgtgtgcgcctcccacttctgcagctccgccaccagcggcaagaagtccacggagatccacttccacagcggctccctggtcgggaagaccgcgatccacgtgaagggcgccctggtggacgggaccgagttcaccttcgagggcagctgcatgttccccgacggctgcaacgccgtcgactgcacgttctgccgcgagttcctgaagaacccccagtgctaccccgccaagaagtggctgttcatcatcatcgtgatcctgctggggtacgccggcctcatgctgctgaccaacgtgctcaaggcgatcggggtctggggctcctgggtgatcgcccccgtgaagctgatgttcgccatcatgaagaagctgatgcggaccgtcagctgcctcgtggggaagctgatggaccgcggccgccaggtgatccacgaggagatcggcgagaacggggagggcaaccacgacgacgtccggatcgagatggcccggccccgccgcgtgcggcactggatgtactccccggtgatcctgaccatcctcgccatcgggctggcggagggctgcgacgagatggtccacgccgacagcaagctggtgtcctgccgccaggggagcggcaacatgaaggagtgcgtgacgaccggccgggccctcctgcccgccgtcaaccccgggcaggaggcctgcctgcacttcaccgcgcccggctccccggacagcaagtgcctcaagatcaaggtgaagcgcatcaacctgaagtgcaagaagtccagcagctacttcgtgcccgacgcccggaaccgctgcacctccgtccggcgctgccggtgggccggggactgccagagcggctgcccgccccacttcacgtccaacagcttctccgacgactgggccgggaagatggaccgcgcgggcctgggcttcagcgggtgctccgacggctgcgggggcgccgcctgcgggtgcttcaacgccgcccccagctgcatcttctggcggaagtgggtggagaactcccacggcatcatctggaaggtgagcccctgcgcggcctgggtcccctccgccgtgatcgagctcaccatgccgagcggcgaggtgcgcaccttccaccccatgtccgggatccccacccaggtcttcaagggcgtgagcgtgacgtacctggggtccgacatggaggtcagcggcctgaccgacctctgcgagatcgaggagctgaagtccaagaagctggccctggccccctgcaaccaggcgggcatgggggtggtgggcaaggtcggggagatccagtgcagcagcgaggagtccgcccggaccatcaagaaggacggctgcatctggaacgccgacctcgtggggatcgagctgcgcgtggacgacgccgtctgctacagcaagatcacctccgtggaggccgtggcgaactacagcgccatcccgacgaccatcggcggcctgcggttcgagcgctcccacgacagccaggggaagatctccggcagccccctcgacatcaccgccatccgggggtccttcagcgtcaactaccgcggcctgcggctgtccctcagcgagatcaccgccacgtgcaccggggaggtgaccaacgtgtccggctgctacagctgcatgaccggcgcgaaggtctccatcaagctgcacagctccaagaacagcaccgcccacgtgcgctgcaagggggacgagacggccttctccgtgctggagggcgtccacagctacaccgtgagcctctccttcgaccacgccgtggtcgacgagcagtgccagctgaactgcgggggccacgagagccaggtgaccctgaaggggaacctcatcttcctggacgtgcccaagttcgtcgacggctcctacatgcagacctaccacagcacggtgcccaccggcgccaacatcccgtcccccaccgactggctgaacgcgctgttcgggaacggcctgagccgctggatcctgggggtcatcggcgtgctcctgggcgggctggccctcttcttcctgatcatgttcctgttcaagctcggcaccaagcaggtcttccggtcccgcacgaagctggcctga

SEQ ID NO: 13233 - RNA, 3222 nt, synthetic construct
  misc_feature 1..3222: note = derived and/or modified CDS sequence (opt1) from SFTSV/FTLSV(2011YGS7)__KF711922.1__GP
  source 1..3222: mol_type = other RNA
atgatgaaggtgatctggttcagctccctggtgtgcctcgtgatccagtgcagcggcgactccgggcccatcatctgcgccggcccgatccacagcaacaagtccgccgcgatcccccacctcctggggtacagcgagaagatctgccagatcgaccgcctcatccacgtgtccagctggctgcggaaccactcccagttccagggctacgtcgggcagcgcggcggccggagccaggtgtcctactaccccgccgagaacagctactcccgctggagcgggctgctctccccctgcgacgccgactggctgggcatgctggtggtcaagaaggccaaggggagcgacatgatcgtgccgggcccctcctacaaggggaaggtgttcttcgagcggcccaccttcgacggctacgtcggctgggggtgcggcagcgggaagtcccgcaccgagagcggcgagctctgcagctccgacagcggcacgtccagcgggctgctgccctccgaccgggtgctctggatcggcgacgtggcctgccagccgatgacccccatccccgaggagaccttcctggagctgaagtccttctcccagagcgagttccccgacatctgcaagatcgacgggatcgtcttctaccagtgcgagggcgagtccctcccgcagcccttcgacgtggcgtggatggacgtggggcacagccacaagatcatcatgcgcgagcacaagaccaagtgggtccaggagtccagctccaaggacttcgtgtgctacaaggagggcacgggcccctgcagcgagtccgaggagaaggcctgcaagaccagcgggtcctgccggggcgacatgcagttctgcaaggtggccgggtgcgagcacggcgaggaggccagcgaggcgaagtgccgctgctccctggtccacaagcccggggaggtggtggtcagctacggcggcatgcgggtgcgcccgaagtgctacgggttcagccggatgatggccaccatggaggtgaacccgcccgagcagcgcatcggccagtgcaccgggtgccacctggagtgcatcaacggcggggtccggctcatcacgctgacctccgagctcaagagcgccaccgtgtgcgcctcccacttctgcagctccgccaccagcggcaagaagtccacggagatccacttccacagcggctccctcgtcgggaagaccgcgatccacgtgaagggcgccctggtggacgggaccgagttcaccttcgagggcagctgcatgttccccgacggctgcaacgccgtcgactgcacgttctgccgcgagttcctgaagaacccccagtgctaccccgccaagaagtggctgttcatcatcatcgtgatcctgctggggtacgccggcctcatgctgctgaccaacgtgctcaaggcgatcggggtctggggctcctgggtgatcgcccccgtgaagctgatgttcgccatcatgaagaagctgatgcggaccgtcagctgcctcgtggggaagctgatggaccgcggccgccaggtgatccacgaggagatcggcgagaacggggagggcaaccacgacgacgtccggatcgagatggcccggccccgccgcgtgcggcactggatgtactccccggtgatcctgaccatcctcgccatcgggctggcggagggctgcgacgagatggtccacgccgacagcaagctggtgtcctgccgccaggggagcggcaacatgaaggagtgcgtgacgaccggccgggccctcctgccctccgtcaaccccgggcaggaggcctgcctgcacttcaccgcccccggcagcccggacagcaagtgcctcaagatcaaggtgaagcgcatcaacctgaagtgcaagaagtccagctcctacttcgtgcccgacgcgcggaaccgctgcaccagcgtccggcgctgccggtgggccggggactgccagtccggctgcccgccccacttcacgagcaactccttcagcgacgactgggccgggaagatggaccgcgccggcctgggcttctccgggtgcagcgacggctgcgggggcgcggcctgcgggtgcttcaacgccgccccctcctgcatcttctggcggaagtgggtggagaacagccacggcatcatctggaaggtgtccccctgcgccgcgtgggtccccagcgccgtgatcgagctcaccatgccgtccggcgaggtgcgcaccttccaccccatgagcgggatccccacccaggtcttcaagggcgtgtccgtgacgtacctggggagcgacatggaggtctccggcctgaccgacctctgcgagatcgaggagctcaagagcaagaagctggccctggccccctgcaaccaggccggcatgggggtggtgggcaaggtcggggagatccagtgcagctccgaggagagcgcgcggaccatcaagaaggacggctgcatctggaacgccgacctggtggggatcgagctgcgcgtggacgacgccgtctgctactccaagatcaccagcgtggaggccgtggccaactactccgcgatcccgacgaccatcggcggcctgcggttcgagcgcagccacgactcccaggggaagatcagcggcagccccctcgacatcaccgccatccgggggagcttctccgtcaactaccgcggcctgcggctgagcctctccgagatcaccgccacgtgcaccggggaggtgaccaacgtgagcggctgctactcctgcatgaccggcgccaaggtcagcatcaagctgcactccagcaagaactccaccgcgcacgtgcgctgcaagggggacgagacggccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacctaccactccacggtgcccaccggcgccaacatcccgagccccaccgactggctgaacgccctcttcgggaacggcctgtcccgctggatcctgggggtcatcggcgtgctcctgggcgggctggcgctgttcttcctgatcatgttcctgttcaagctcggcaccaagcaggtcttccggagccgcacgaagctggcctga

SEQ ID NO: 13234 - RNA, 3222 nt, synthetic construct
  misc_feature 1..3222: note = derived and/or modified CDS sequence (opt1) from SFTSV/FTLSV(2011YPQ11)__KF711926.1__GP
  source 1..3222: mol_type = other RNA
atgatgaaggtgatctggttcagctccctggtgtgcctcgtgatccagtgcagcggcgactccgggcccatcatctgcgccggcccgatccacagcaacaagtccgccgcgatcccccacctcctggggtacagcgagaagatctgccagatcgaccgcctcatccacgtgtccagctggctgcggaaccactcccagttccagggctacgtcgggcagcgcggcggccggagccaggtgtcctactaccccgccgagaacagctactcccgctggagcgggctgctctccccctgcgacgccgactggctgggcatgctggtggtcaagaaggccaaggggagcgacatgatcgtgccgggcccctcctacaaggggaaggtgttcttcgagcggcccaccttcgacggctacgtcggctgggggtgcggcagcgggaagtcccgcaccgagagcggcgagctctgcagctccgacagcggcacgtccagcgggctgctgccctccgaccgggtgctctggatcggcgacgtggcctgccagccgatgacccccatccccgaggagaccttcctggagctgaagtccttctcccagagcgagttccccgacatctgcaagatcgacgggatcgtcttcaaccagtgcgagggcgagtccctcccgcagcccttcgacgtggcgtggatggacgtggggcacagccacaagatcatcatgcgcgagcacaagaccaagtgggtccaggagtccagctccaaggacttcgtgtgctacaaggagggcacgggcccctgcagcgagtccgaggagaaggcctgcaagaccagcgggtcctgccggggcgacatgcagttctgcaaggtggccgggtgcgagcacggcgaggaggccagcgaggcgaagtgccgctgctccctggtccacaagcccggggaggtggtggtcagctacggcggcatgcgggtgcgcccgaagtgctacgggttcagccggatgatggccaccatggaggtgaacccgcccgagcagcgcatcggccagtgcaccgggtgccacctggagtgcatcaacggcggggtccggctcatcacgctgacctccgagctcaagagcgccaccgtgtgcgcctcccacttctgcagctccgccaccagcggcaagaagtccacggagatccacttccacagcggctccctggtcgggaagaccgcgatccacgtgaagggcgccctggtggacgggaccgagttcaccttcgagggcagctgcatgttccccgacggctgcaacgccgtcgactgcacgttctgccgcgagttcctgaagaacccccagtgctaccccgccaagaagtggctgttcatcatcatcgtgatcctgctggggtacgccggcctcatgctgctgaccaacgtgctcaaggcgatcggggtctggggctcctgggtgatcgcccccgtgaagctgatgttcgccatcatgaagaagctgatgcggaccgtcagctgcctcgtggggaagctgatggaccgcggccgccaggtgatccacgaggagatcggcgagaacggggagggcaaccacgacgacgtccggatcgagatggcccggccccgccgcgtgcggcactggatgtactccccggtgatcctgaccatcctcgccatcgggctggcggagggctgcgacgagatggtccacgccgacagcaagctggtgtcctgccgccaggggagcggcaacatgaaggagtgcgtgacgaccggccgggccctcctgccctccgtcaaccccgggcaggaggcctgcctgcacttcaccgcccccggcagcccggacagcaagtgcctcaagatcaaggtgaagcgcatcaacctgaagtgcaagaagtccagctcctacttcgtgcccgacgcgcggtaccgctgcaccagcgtccggcgctgcccctgggccggggactgccagtccggctgcccgccccacttcacgagcaactccttcagcgacgactgggccgggaagatggaccgggccggcctgggcttctccgggtgcagcgacggctgcgggggcgcggcctgcgggtgcttcaacgccgccccctcctgcatcttctggcgcaagtgggtggagaacagccacggcatcatctggaaggtgtccccctgcgccgcgtgggtcccgagcgccgtgatcgagctcaccatgccctccggcgaggtgcggaccttccaccccatgagcgggatccccacccaggtcttcaagggcgtgtccgtgacgtacctggggagcgacatggaggtctccggcctgaccgacctctgcgagatcgaggagctcaagagcaagaagctggccctggccccgtgcaaccaggccggcatgggggtggtgggcaaggtcggggagatccagtgcagctccgaggagagcgcgcgcaccatcaagaaggacggctgcatctggaacgccgacctggtggggatcgagctgcgggtggacgacgccgtctgctactccaagatcaccagcgtggaggccgtggccaactactccgcgatccccacgaccatcggcggcctgcgcttcgagcggagccacgactcccaggggaagatcagcggcagccccctcgacatcaccgccatccgcgggagcttctccgtcaactaccggggcctgcgcctgagcctctccgagatcaccgccacgtgcaccggggaggtgaccaacgtgagcggctgctactcctgcatgaccggcgccaaggtcagcatcaagctgcactccagcaagaactccaccgcgcacgtgcggtgcaagggggacgagacggccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacctaccactccacggtgccgaccggcgccaacatccccagccccaccgactggctgaacgccctcttcgggaacggcatgtcccgctggatcctgggggtcatcggcgtgctgctcggcgggctggcgctgttcttcctcatcatgttcctgttcaagctgggcaccaagcaggtcttccgcagccggacgaagctcgcctga

SEQ ID NO: 13235 - RNA, 3222 nt, synthetic construct
  misc_feature 1..3222: note = derived and/or modified CDS sequence (opt1) from SFTSV/FTLSV(2011YPQ12)__KF711930.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccaaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgtcccagcccgagcagcgcatcggccagtgcacggggtgccacctggagtgcatcaacggcggggtgcggctcatcaccctgaccagcgagctgaagtccgcgaccgtctgcgccagccacttctgctccagcgccacgtccggcaagaagtccaccgagatccagttccacagcggcagcctcgtggggaagaccgccatccacgtcaagggcgccctggtggacgggaccgagttcacgttcgagggctcctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcggggtgtggggcagctgggtcatcgcccccgtgaagctggtgttcgcgatcatcaagaagctgatgcgggccgtctcctgcctcatggggaagctgatggaccgcggccgccaggtgatccacgaggagatcggcgagaaccgggaggggaaccaggacgacgtgcggatcgagatggcccgcccccgccgggtccgccactggatgtacagccccgtgatcctgaccatcctcgccatcggcctggccgaggggtgcgacgagatggtgcacgcggactccaagctggtcagctgccggcagggctccgggaacatgaaggagtgcgtgacgaccggccgcgccctcctgccggccgtgaaccccggccaggaggcctgcctgcacttcaccgcccccgggagccccgacagcaagtgcctcaagatcaaggtcaagcggatcaacctgaagtgcaagaagtccagctcctacttcgtgccggtggcgcgctaccggtgcaccagcgtccgccggtgccgctgggccggcgactgccagtccgggtgcccgccccacttcacgagcaactccttcagcgacgactgggccggcaagatggaccgggccgggctgggcttctccggctgcagcgacgggtgcggcggggcggcctgcggctgcttcaacgccgccccctcctgcatcttctggcgcaagtgggtggagaacccccacgggatcatctggaaggtgagcccctgcgccgcgtgggtcccctccgccgtgatcgagctcaccatgccgagcggcgaggtgcggaccttccaccccatgtccggcatccccacccaggtcttcaagggggtgagcgtgacgtacctgggctccgacatggaggtcagcgggctgaccgacctctgcgagatcgaggagctgaagtccaagaagctggccctggccccctgcaaccaggccggcatgggcgtggtggggaaggtcggcgagatccagtgcagcagcgaggagtccgcgcgcaccatcaagaaggacgggtgcatctggaacgccgacctcgtgggcatcgagctgcgggtggacgacgccgtctgctacagcaagatcacctccgtggaggccgtggccaactacagcgcgatcccgacgaccatcgggggcctgcgcttcgagcggtcccacgacagccagggcaagatctccgggagccccctcgacatcaccgccatccgcggctccttcagcgtcaactaccgggggctgcgcctgtccctcagcgagatcaccgccacgtgcaccggcgaggtgaccaacgtgtccgggtgctacagctgcatgaccggcgccaaggtctccatcaagctgcacagctccaagaacagcaccgcgcacgtgcgctgcaagggcgacgagacggccttctccgtgctggagggggtccacagctacagcgtgtccctcagcttcgaccacgccgtggtcgacgagcagtgccagctgaactgcggcgggcacgagtcccaggtgaccctgcggggcaacctcatcttcctggacgtgcccaagttcgtcgacgggagctacatgcagacctaccactccaccgtgcccacgggcgccaacatcccgagccccaccgactggctgaacgccctcttcggcaacgggctgtcccgctggatcctgggcgtcatcggggtgctcctgggcggcctggccctcttcttcctgatcatgagcctgttcaagctcgggaccaagcagatcttccggtcccgcaccaagctggcgtga

SEQ ID NO: 13236 - RNA, 3222 nt, synthetic construct
  misc_feature 1..3222: note = derived and/or modified CDS sequence (opt1) from SFTSV/FTLSV(2011YPQ17)__KF711923.1__GP
  source 1..3222: mol_type = other RNA
atgatgaaggtgatctggttcagctccctggtgtgcctcgtgatccagtgcagcggcgactccgggcccatcatctgcgccggcccgatccacagcaacaagtccgccgcgatcccccacctcctggggtacagcgagaagatctgccagatcgaccgcctgatccacgtgtccagctggctgcggaaccactcccagttccagggctacgtcgggcagcgcggcggccggagccaggtgtcctactaccccgccgagaacagctactcccgctggagcgggctgctctccccctgcgacgccgactggctgggcatgctggtggtcaagaaggccaaggggagcgacatgatcgtgccgggcccctcctacaaggggaaggtgttcttcgagcggcccaccttcgacggctacgtcggctgggggtgcggcagcgggaagtcccgcaccgagagcggcgagctctgcagctccgacagcggcacgtccagcgggctgctgccctccgaccgggtgctctggatcggcgacgtggcctgccagccgatgacccccatccccgaggagaccttcctggagctgaagtccttctcccagagcgagttccccgacatctgcaagatcgacgggatcgtcttcaaccagtgcgagggcgagtccctcccgcagcccttcgacgtggcgtggatggacgtggggcacagccacaagatcatcatgcgcgagcacaagaccaagtgggtccaggagtccagctccaaggacttcgtgtgctacaaggagggcacgggcccctgcagcgagtccgaggagaaggcctgcaagaccagcgggtcctgccggggcgacatgcagttctgcaaggtggccgggtgcgagcacggcgaggaggccagcgaggcgaagtgccgctgctccctggtccacaagcccggggaggtggtggtcagctacggcggcatgcgggtgcgcccgaagtgctacgggttcagccggatgatggccaccatggaggtgaacccgcccgagcagcgcatcggccagtgcaccgggtgccacctggagtgcatcaacggcggggtccggctcatcacgctgacctccgagctcaagagcgccaccgtgtgcgcctcccacttctgcagctccgccaccagcggcaagaagtccacggagatccacttccacagcggctccctggtcgggaagaccgcgatccacgtgaagggcgccctggtggacgggaccgagttcaccttcgagggcagctgcatgttccccgacggctgcaacgccctggactgcacgttctgccgcgagttcctcaagaacccccactgctaccccgccaagaagtggctgttcatcatcatcgtcatcctgctcgggtacgccggcctgatgctgctcaccaacgtgctgaaggcgatcggggtgtggggctcctgggtcatcgcccccgtgaagctgatgttcgccatcatgaagaagctcatgcggaccgtgagctgcctggtcgggaagctgatggaccgcggccgccaggtgatccacgaggagatcggcgagaacggggagggcaaccacgacgacgtgcggatcgagatggcccggccccgccgcgtccggcactggatgtactccccggtgatcctcaccatcctggccatcgggctggcggagggctgcgacgagatggtgcacgccgacagcaagctcgtctcctgccgccaggggagcggcaacatgaaggagtgcgtgacgaccggccgggccctgctgccctccgtgaaccccgggcaggaggcctgcctccacttcaccgcccccggcagcccggacagcaagtgcctgaagatcaaggtcaagcgcatcaacctgaagtgcaagaagtccagctcctacttcgtgcccgacgcgcggaaccgctgcaccagcgtgcggcgctgccggtgggccggggactgccagtccggctgcccgccccacttcacgagcaactccttcagcgacgactgggccgggaagatggaccgcgccggcctcggcttctccgggtgcagcgacggctgcgggggcgcggcctgcgggtgcttcaacgccgccccctcctgcatcttctggcggaagtgggtcgagaacagccacggcatcatctggaaggtgtccccctgcgccgcgtgggtgcccagcgccgtcatcgagctgaccatgccgtccggcgaggtgcgcaccttccaccccatgagcgggatccccacccaggtgttcaagggcgtctccgtgacgtacctggggagcgacatggaggtgtccggcctcaccgacctgtgcgagatcgaggagctcaagagcaagaagctggccctggccccctgcaaccaggccggcatgggggtcgtgggcaaggtgggggagatccagtgcagctccgaggagagcgcgcggaccatcaagaaggacggctgcatctggaacgccgacctggtcgggatcgagctgcgcgtggacgacgccgtgtgctactccaagatcaccagcgtcgaggccgtggccaactactccgcgatcccgacgaccatcggcggcctccggttcgagcgcagccacgactcccaggggaagatcagcggcagccccctggacatcaccgccatccgggggagcttctccgtgaactaccgcggcctgcggctcagcctgtccgagatcaccgccacgtgcaccggggaggtcaccaacgtgagcggctgctactcctgcatgaccggcgccaaggtgagcatcaagctgcactccagcaagaactccaccgcgcacgtccgctgcaagggggacgagacggccttcagcgtgctcgagggcgtgcacagctacaccgtctccctgagcttcgaccacgccgtggtggacgagcagtgccagctgaactgcgggggccacgagtcccaggtcaccctcaaggggaacctgatcttcctggacgtgcccaagttcgtggacggcagctacatgcagacctaccactccacggtccccaccggcgccaacatcccgagccccaccgactggctcaacgccctgttcgggaacggcctgtcccgctggatcctcggggtgatcggcgtcctgctgggcgggctcgcgctgttcttcctgatcatgttcctcttcaagctgggcaccaagcaggtcttccggagccgcacgaagctggcctga

SEQ ID NO: 13237 - RNA, 3222 nt, synthetic construct
  misc_feature 1..3222: note = derived and/or modified CDS sequence (opt1) from SFTSV/FTLSV(2011YSC22)__KF711927.1__GP
  source 1..3222: mol_type = other RNA
atgatgaaggtgatctggttcagctccctggtctgcctcgtgatccagtgcagcggcgactccgggcccatcatctgcgccggcccgatccacagcaacaagtccgccgcgatcccccacctcctggggtacagcgagaagatctgccagatcgaccgcctcatccacgtgtccagctggctgcggaaccactcccagttccagggctacgtcgggcagcgcggcggccggagccaggtgtcctactaccccgccgagaacagctactcccgctggagcgggctgctctccccctgcgacgccgactggctgggcatgctggtggtcaagaaggccaaggggagcgacatgatcgtgccgggcccctcctacaaggggaaggtgttcttcgagcggcccaccttcgacggctacgtcggctgggggtgcggcagcgggaagtcccgcaccgagagcggcgagctctgcagctccgacagcggcacgtccagcgggctgctgccctccgaccgggtgctctggatcggcgacgtggcctgccagccgatgacccccatccccgaggagaccttcctggagctgaagtccttctcccagagcgagttccccgacatctgcaagatcgacgggatcgtcttcaaccagtgcgagggcgagtccctcccgcagcccttcgacgtggcgtggatggacgtggggcacagccacaagatcatcatgcgcgagcacaagaccaagtgggtccaggagtccagctccaaggacttcgtgtgctacaaggagggcacgggcccctgcagcgagtccgaggagaaggcctgcaagaccagcgggtcctgccggggcgacatgcagttctgcaaggtggccgggtgcgagcacggcgaggaggccagcgaggcgaagtgccgctgctccctggtccacaagcccggggaggtggtggtcagctacggcggcatgcgggtgcgcccgaagtgctacgggttcagccggatgatggccaccatggaggtgaacccgcccgagcagcgcatcggccagtgcaccgggtgccacctggagtgcatcaacggcggggtccggctcatcacgctgacctccgagctcaagagcgccaccgtgtgcgcctcccacttctgcagctccgccaccagcggcaagaagtccacggagatccacttccacagcggctccctggtcgggaagaccgcgatccacgtgaagggcgccctggtggacgggaccgagttcaccttcgagggcagctgcatgttccccgacggctgcaacgccgtcgactgcacgttctgccgcgagttcctgaagaacccccagtgctaccccgccaagaagtggctgttcatcatcatcgtgatcctgctggggtacgccggcctcatgctgctgaccaacgtgctcaaggcgatcggggtctggggctcctgggtgatcgcccccgtgaagctgatgttcgccatcatgaagaagctgatgcggaccgtcagctgcctcgtggggaagctgatggaccgcggccgccaggtgatccacgaggagatcggcgagaacggggagggcaaccacgacgacgtccggatcgagatggcccggccccgccgcgtgcggcactggatgtactccccggtgatcctgaccatcctcgccatcgggctggcggagggctgcgacgagatggtccacgccgacagcaagctggtgtcctgccgccaggggagcggcaacatgaaggagtgcgtgacgaccggccgggccctcctgccctccgtcaaccccgggcaggaggcctgcctgcacttcaccgcccccggcagcccggacagcaagtgcctcaagatcaaggtgaagcgcatcaacgtgaagtgcaagaagtccagctcctacttcgtccccgacgcgcggaaccgctgcaccagcgtgcggcgctgccggtgggccggggactgccagtccggctgcccgccccacttcacgagcaactccttcagcgacgactgggccgggaagatggaccgcgccggcctgggcttctccgggtgcagcgacggctgcgggggcgcggcctgcgggtgcttcaacgccgccccctcctgcatcttctggcggaagtgggtggagaacagccacggcatcatctggaaggtctccccctgcgccgcgtgggtgcccagcgccgtgatcgagctgaccatgccgtccggcgaggtccgcaccttccaccccatgagcgggatccccacccaggtgttcaagggcgtgtccgtcacgtacctcgggagcgacatggaggtgtccggcctgaccgacctgtgcgagatcgaggagctcaagagcaagaagctggccctggccccctgcaaccaggccggcatgggggtggtcggcaaggtgggggagatccagtgcagctccgaggagagcgcgcggaccatcaagaaggacggctgcatctggaacgccgacctggtggggatcgagctccgcgtcgacgacgccgtgtgctactccaagatcaccagcgtggaggccgtcgccaactactccgcgatcccgacgaccatcggcggcctgcggttcgagcgcagccacgactcccaggggaagatcagcggcagccccctggacatcaccgccatccgggggagcttctccgtgaactaccgcggcctccggctgagcctgtccgagatcaccgccacgtgcaccggggaggtgaccaacgtcagcggctgctactcctgcatgaccggcgccaaggtgagcatcaagctccactccagcaagaactccaccgcgcacgtgcgctgcaagggggacgagacggccttcagcgtcctggagggcgtgcacagctacaccgtgtccctgagcttcgaccacgccgtcgtggacgagcagtgccagctcaactgcgggggccacgagtcccaggtgaccctgaaggggaacctgatcttcctcgacgtccccaagttcgtggacggcagctacatgcagacctaccactccacggtccccaccggcgccaacatcccgagccccaccgactggctgaacgccctgctcgggaacggcatgtcccgctggatcctgggggtgatcggcgtgctgctcggcgggctggcgctgttcttcctcatcatgttcctgttcaagctgggcaccaagcaggtcttccggagccgcacgaagctcgcctga

SEQ ID NO: 13238 - RNA, 3222 nt, synthetic construct
  misc_feature 1..3222: note = derived and/or modified CDS sequence (opt1) from SFTSV/FTLSV(2011YSC60)__KF711945.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagtacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgaaccagcccgagcagcgcatcgggcagtgcaccggctgccacctcgagtgcatcaacgggggcgtgcggctgatcaccctgaccagcgagctcaagagcgcgacggtctgcgcctcccacttctgcagctccgccaccagcggcaagaagtccaccgagatccagttccacagcgggtccctggtgggcaagaccgccatccacgtcaagggggccctggtggacggcacggagttcaccttcgagggcagctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcatctgggggtcctgggtgatcgcccccgtcaagctgatcttcgcgatcatcaagaagctcatgcggacggtgagctgcctgatgggcaagctgatggaccgcggccgccaggtgatccacgaggagatcggggagaaccgggagggcaaccaggacgacgtccggatcgagatggcccgcccccgccgggtgcgccactggatgtactcccccgtgatcctcaccatcctggccatcgggctggccgagagctgcgacgagatggtccacgccgactccaagctcgtgagctgccggcagggctccgggaacatgaaggagtgcgtgaccaccggccgcgcgctgctgccggccgtcaaccccggccaggaggcctgcctccacttcacggcccccgggagccccgactccaagtgcctgcggatcaaggtgaagcgcatcaacctgaagtgcaagaagtccagcagctacttcgtgccggacgcccggaaccgctgcaccagcgtccggcgctgccggtgggcgggcgactgccagtccgggtgcccgccccacttcaccagcaactccttcagcgacgactgggccggcaagatggaccgcgccgggctcggcttctccggctgcagcgacgggtgcggcggggccgcgtgcggctgcttcaacgccgccccctcctgcatcttctggcggaagtgggtggagaacccccacgggatcatctggaaggtgagcccctgcgccgcctgggtcccctccgcggtgatcgagctgaccatgccgagcggcgaggtgcgcacgttccaccccatgtccggcatccccacccaggtcttcaagggggtgagcgtgacctacctgggctccgacatggaggtcagcgggctcaccgacctgtgcgagatcgaggagctgaagtccaagaagctggccctcgccccctgcaaccaggccggcatgggcgtggtggggaaggtcggcgagatccagtgcagctccgaggagagcgcccggacgatcaagaaggacgggtgcatctggaacgcggacctggtgggcatcgagctgcgcgtggacgacgccgtctgctacagcaagatcacctccgtggaggccgtggccaactacagcgccatcccgaccaccatcgggggcctccggttcgagcgctcccacgacagccagggcaagatctccgggagccccctggacatcacggcgatccggggctccttcagcgtcaactaccgcgggctgcgcctctccctgagcgagatcaccgcgacctgcaccggcgaggtgaccaacgtgtccgggtgctacagctgcatgacgggcgccaaggtctccatcaagctgcacagctccaagaacagcaccgcccacgtgcggtgcaagggcgacgagaccgccttctccgtgctcgagggggtccacagctacaccgtgtccctgagcttcgaccacgccgtggtcgacgagcagtgccagctgaactgcggcgggcacgagagccaggtgacgctcaagggcaacctgatcttcctggacgtgcccaagttcgtcgacgggtcctacatgcagacctaccacagcaccgtgcccaccggcgccaacatcccgtcccccacggactggctcaacgccctgttcggcaacgggctgagccgctgggtgctcggcgtcatgggggtgctgctgggcggcctcgccctgttcttcatgatcatgtccctgttcaagctcgggaccaagcaggtcttccggagccgcaccaagctggcgtga

SEQ ID NO: 13239 - RNA, 3222 nt, synthetic construct
  misc_feature 1..3222: note = derived and/or modified CDS sequence (opt1) from SFTSV/FTLSV(2011YSH45)__KF711947.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctggagtgcaagaagtccagctcctacttcgtgccggacgcccgcaaccggtgcacgagcgtccgccggtgccgctgggcgggggactgccagtccggctgcccgccccacttcaccagcaactccttcagcgacgactgggccgggaagatggaccgggccggcctggggttctccggctgcagcgacggctgcgggggcgccgcgtgcgggtgcttcaacgccgccccctcctgcatcttctggcgcaagtgggtggagaacccccacggcatcatctggaaggtgagcccctgcgccgcctgggtcccctccgcggtgatcgagctcaccatgccgagcggggaggtgcggaccttccaccccatgtccggcatccccacgcaggtcttcaagggcgtgagcgtgacctacctggggtccgacatggaggtcagcggcctgaccgacctctgcgagatcgaggagctgaagtccaagaagctggccctggccccctgcaaccaggccgggatgggcgtggtgggcaaggtcggggagatccagtgcagcagcgaggagtccgcccgcaccatcaagaaggacggctgcatctggaacgcggacctcgtggggatcgagctgcgggtggacgacgccgtctgctacagcaagatcacgtccgtggaggccgtggccaactacagcgccatcccgaccaccatcggcgggctgcgcttcgagcggtcccacgacagccagggcaagatctccggcagccccctcgacatcaccgcgatccgcgggtccttcagcgtcaactaccggggcctgcgcctgtccctcagcgagatcacggcgacctgcaccggggaggtgaccaacgtgtccggctgctacagctgcatgaccggggccaaggtctccatcaagctgcacagctcccgcaacagcacggcccacgtgcggtgcaagggcgacgagaccgccttctccgtgctggagggcgtccacagctacaccgtgagcctctccttcgaccacgccgtggtcgacgagcagtgccagctgaactgcgggggccacgagagccaggtgaccctgaaggggaacctcatcttcctggacgtgcccaagttcgtcgacggctcctacatgcagacgtaccacagcaccgtgcccaccggggccaacatcccgtcccccaccgactggctgaacgccctcttcggcaacggcctgagccgctgggtgctgggggtcatgggcgtgctcctcgggggcctggccctgttcttcatgatcatgtccctgttcaagctgggcacgaagcaggtcttccggagccgcaccaagctcgcgtga

SEQ ID NO: 13240 - RNA, 3222 nt, synthetic construct
  misc_feature 1..3222: note = derived and/or modified CDS sequence (opt1) from SFTSV/FTLSV(2011YSH52)__KF711928.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgagccagcccgagcagcgcatcgggcagtgcaccggctgccacctcgagtgcatcaacgggggcgtgcggctgatcaccctgaccagcgagctcaagtccgcgacggtctgcgccagccacttctgctccagcgccacctccggcaagaagtccaccgagatccagttccacagcgggagcctggtgggcaagaccgccatccacgtcaagggggccctggtggacggcacggagttcaccttcgagggctcctgcatgttccccgacgggtgcgacgcggtggactgcaccttctgccgcgagttcctcaagaacccccagtgctacccggccaagaagtggctgttcatcatcatcgtcatcctgctcggctacgccgggttcatgctgctgaccaacgtgctcaaggccatcggcgtgtgggggagctgggtcatcgcccccgtgaagctggtgttcgcgatcatcaagaagctgatgcgggccgtctcctgcctcatgggcaagctgatggaccgcggccgccaggtgatccacgaggagatcggggagaaccgggagggcaaccaggacgacgtgcggatcgagatggcccgcccccgccgggtccgccactggatgtacagccccgtgatcctgacgatcctcgccatcgggctggccgagggctgcgacgagatggtgcacgcggactccaagctggtcagctgccggcaggggtccggcaacatgaaggagtgcgtgaccaccggccgcgccctcctgccggccgtgaaccccgggcaggaggcctgcctgcacttcaccgcccccggcagccccgactccaagtgcctcaagatcaaggtcaagcggatcaacaagaagtgcaagaagtccagcagctacttcgtgccggacgcgcgctaccggtgcacgagcgtgcgccggtgccgctgggccggggactgccagtccggctgcccgccccacttcaccagcaactccttcagcgacgactgggccgggaagatggaccgggccggcctgggcttctccgggtgcagcgacggctgcgggggcgcggcctgcgggtgcttcaacgccgccccctcctgcatcttctggcgcaagtgggtcgagaacccccacggcatcatctggaaggtgagcccctgcgccgcgtgggtgccctccgccgtcatcgagctgaccatgccgagcggcgaggtgcggaccttccaccccatgtccgggatccccacccaggtgttcaagggcgtcagcgtgacgtacctcgggtccgacatggaggtgagcggcctgtccgacctgtgcgagatcgaggagctcaacagcaagaagctggccctggccccctgcaaccaggccggcatgggggtcgtgggcaaggtgggggagatccagtgctccagcgaggagagcgcgcgcaccatcaagaaggacggctgcatccggaacgccgacctggtcgggatcgaggtgcgcgtggacgacgccgtcttctacttcaagatcacctccgtggaggccgtggccaactacagcgcgatcccgacgaccatcggcggcctccggttcgagcgctcccacgacagccaggggaagatctccggcagccccctggacatcaccgccatccgggggtccttcagcgtcaactaccgcggcctgcgcctctccctgagcgagatcaccgccacgtgcaccggggaggtgaccaacgtgtccggctgctacagctgcatgaccggcgccaaggtctccatcaagctgcacagctccaagaacagcaccgcgcacgtgcggtgcaagggggacgagacggccttctccgtgctcgagggcgtccacagctactccgtgagcctgagcttcgaccacgccgtggtcgacgagcagtgccagctgaactgcgggggccacgagtcccaggtgaccctccgcgggaacctgatcttcctggacgtgcccaagttcgtcgacggcagctacatgcagacctaccactccaccgtgcccacgggcgccaacatcccgagccccaccgactggctcaacgccctgttcgggaacggcctgtcccggtggatcctcggggtcatcggcgtgctgctgggcgggctcgcgctgttcttcctgatcctcagcctgttcaagctgggcaccaagcagatcttccgctcccggaccaagctcgcctga

SEQ ID NO: 13241 - RNA, 3222 nt, synthetic construct
  misc_feature 1..3222: note = derived and/or modified CDS sequence (opt1) from SFTSV/FTLSV(2011YXX9)__KF711924.1__GP
  source 1..3222: mol_type = other RNA
atgatgaaggtgatctggttcagctccctggtgtgcctcgtgatccagtgcagcggcgactccgggcccatcatctgcgccggcccgatccacagcaacaagtccgccgcgatcccccacctcctggggtacagcgagaagatctgccagatcgaccgcctcatccacgtgtccagctggctgcggaaccactcccagttccagggctacgtcgggcagcgcggcggccggagccaggtgtcctactaccccgccgagaacagctactcccgctggagcgggctgctctccccctgcgacgccgactggctgggcatgctggtggtcaagaaggccaaggggagcgacatgatcgtgccgggcccctcctacaaggggaaggtgttcttcgagcggcccaccttcgacggctacgtcggctgggggtgcggcagcgggaagtcccgcaccgagagcggcgagctctgcagctccgacagcggcacgtccagcgggctgctgccctccgaccgggtgctctggatcggcgacgtggcctgccagccgatgacccccatccccgaggagaccttcctggagctgaagtccttctcccagagcgagttccccgacatctgcaagatcgacgggatcgtcttcaaccagtgggagggcgagtccctcccgcagcccttcgacgtggcgtggatggacgtggggcacagccacaagatcatcatgcgcgagcacaagaccaagtgggtccaggagtccagctccaaggacttcgtgtgctacaaggagggcacgggcccctgcagcgagtccgaggagaaggcctgcaagaccagcgggtcctgccggggcgacatgcagttctgcaaggtggccgggtgcgagcacggcgaggaggccagcgaggcgaagtgccgctgctccctggtccacaagcccggggaggtggtggtcagctacggcggcatgcgggtgcgcccgaagtgctacgggttcagccggatgatggccaccatggaggtgaacccgcccgagcagcgcatcggccagtgcaccgggtgccacctggagtgcatcaacggcggggtccggctcatcacgctgacctccgagctcaagagcgccaccgtgtgcgcctcccacttctgcagctccgccaccagcggcaagaagtccacggagatccacttccacagcggctccctcgtcgggaagaccgcgatccacgtgaagggcgccctggtggacgggaccgagttcaccttcgagggcagctgcatgttccccgacggctgcaacgccgtcgactgcacgttctgccgcgagttcctgaagaacccccagtgctaccccgccaagaagtggctgttcatcatcatcgtgatcctgctggggtacgccggcctcatgctgctgaccaacgtgctcaaggcgatcggggtctggggctcctgggtgatcgcccccgtgaagctgatgttcgccatcatgaagaagctgatgcggaccgtcagctgcctcgtggggaagctgatggaccgcggccgccaggtgatccacgaggagatcggcgagaacggggagggcaaccacgacgacgtccggatcgagatggcccggccccgccgcgtgcggcactggatgtactccccggtgatcctgaccatcctcgccatcgggctggcggagggctgcgacgagatggtccacgccgacagcaagctggtgtcctgccgccaggggagcggcaacatgaaggagtgcgtgacgaccggccgggccctcctgccctccgtcaaccccgggcaggaggcctgcctgcacttcaccgcccccggcagcccggacagcaagtgcctcaagatcaaggtgaagcgcatcaacctgaagtgcaagaagtccagctcctacttcgtgcccgacgcgcggaaccgctgcaccagcgtccggcgctgccggtgggccggggactgccagtccggctgcccgccccacttcacgagcaactccttcagcgacgactgggccgggaagatggaccgcgccggcctgggcttctccgggtgcagcgacggctgcgggggcgcggcctgcgggtgcttcaacgccgccccctcctgcatcttctggcggaagtgggtggagaacagccacggcatcatctggaaggtgtccccctgcgccgcgtgggtccccagcgccgtgatcgagctcaccatgccgtccggcgaggtgcgcaccttccaccccatgagcgggatccccacccaggtcttcaagggcgtgtccgtgacgtacctggggagcgacatggaggtctccggcctgaccgacctctgcgagatcgaggagctcaagagcaagaagctggccctggccccctgcaaccaggccggcatgggggtggtgggcaaggtcggggagatccagtgcagctccgaggagagcgcgcggaccatcaagaaggacggctgcatctggaacgccgacctggtggggatcgagctgcgcgtggacgacgccgtctgctactccaagatcaccagcgtggaggccgtggccaactactccgcgatcccgacgaccatcggcggcctgcggttcgagcgcagccacgactcccaggggaagatcagcggcagccccctcgacatcaccgccatccgggggagcttctccgtcaactaccgcggcctgcggctgagcctctccgagatcaccgccacgtgcaccggggaggtgaccaacgtgagcggctgctactcctgcatgaccggcgccaaggtcagcatcaagctgcactccagcaagaactccaccgcgcacgtgcgctgcaagggggacgagacggccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacctaccactccacggtgcccaccggcgccaacatcccgagccccaccgactggctgaacgccctcttcgggaacggcctgtcccgctggatcctgggggtcatcggcgtgctcctgggcgggctggcgctgttcttcctgatcatgttcctgttcaagctcggcaccaagcaggtcttccggagccgcacgaagctggcctga

SEQ ID NO: 13242 - RNA, 3222 nt, synthetic construct
  misc_feature 1..3222: note = derived and/or modified CDS sequence (opt1) from SFTSV/FTLSV(2012YGS10)__KF711937.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacggtcctcgccatcggcctggccgagagctgcgacgagatggtgcacgccgactccaagctggtgagctgccggcaggggtccggcaacatgaaggagtgcgtcaccaccgggcgcgcgctcctgccggccgtgaaccccggccaggaggcctgcctgcacttcaccgcccccggcagccccgacagcaagtgcctcaagatcaaggtgaagcggatcaacctgaagtgcaagaagtccagctcctacttcgtcccggacgcccgcagccggtgcacgtccgtgcgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtctccccctgcgccgcctgggtgcccagcgcggtgatcgagctcaccatgccgtccggggaggtccggaccttccaccccatgagcggcatccccacccaggtgttcaagggcgtgtccgtcacctacctggggagcgacatggaggtgtccggcctgaccgacctctgcgagatcgaggagctcaagagcaagaagctggccctggccccctgcaaccaggccgggatgggcgtggtcggcaaggtgggggagatccagtgcagctccgaggagagcgcccgcaccatcaagaaggacggctgcatctggaacgcggacctggtggggatcgagctgcgggtcgacgacgccgtgtgctactccaagatcacgagcgtggaggccgtcgccaactactccgccatcccgaccaccatcggcgggctgcgcttcgagcggagccacgactcccagggcaagatcagcggcagccccctcgacatcaccgcgatccgcgggagcttctccgtgaactaccggggcctgcgcctgagcctctccgagatcacggccacgtgcaccggggaggtgaccaacgtcagcggctgctactcctgcatgaccggggccaaggtgagcatcaagctgcactccagcaagaactccacggcccacgtgcgctgcaagggcgacgagaccgcgttcagcgtcctggagggcgtgcacagctacaccgtgtccctcagcttcgaccacgccgtcgtggacgagcagtgccagctgaactgcgggggccacgagtcccaggtgaccctgaaggggaacctcatcttcctggacgtccccaagttcgtggacggcagctacatgcagacgtaccactccaccgtgcccaccggggccaacatcccgagccccaccgactggctgaacgccctcttcggcaacggcctgtcccggtggatcctgggggtcatcggcgtgctcctcgggggcctggccctgttcttcatgatcatgagcctgttcaagctgggcacgaagcaggtcttccgctcccggaccaagctcgcgtga

SEQ ID NO: 13243 - RNA, 3222 nt, synthetic construct
  misc_feature 1..3222: note = derived and/or modified CDS sequence (opt1) from SFTSV/FTLSV(2012YGS4)__KF711933.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcatccccctcgacatcaccgcgatccgcgggtccttcagcgtcaactaccggggcctgcgcctgtccctcagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttctccgtgctggagggcgtccacagctacaccgtgagcctctccttcgaccacgccgtggtcgacgagcagtgccagctgaactgcgggggccacgagagccaggtgaccctgaaggggaacctcatcttcctggacgtgcccaagttcgtcgacggctcctacatgcagacgtaccacagcaccgtgcccaccggggccaacatcccgtcccccaccgactggctgaacgccctcttcggcaacggcctgagccggtggatcctgggggtgatcggcgtcctcctcgggggcctggccctgttcttcatgatcatgtccctgttcaagctgggcacgaagcaggtcttccgcagccggaccaagctcgcgtga

SEQ ID NO: 13244 - RNA, 3222 nt, synthetic construct
  misc_feature 1..3222: note = derived and/or modified CDS sequence (opt1) from SFTSV/FTLSV(2012YSC6)__KF711931.1__GP
  source 1..3222: mol_type = other RNA
atgatgaaggtgatctggttcagctccctgatctgcttcgtgatccagtgcagcggcgggtccggccccatcatctgcgccgggccgatccacagcaacaagtccgccgacatcccccacctcctgggctacagcgagaagatctgccagatcgaccgcctgatccacgtgtccagctggctccggaaccactcccagttccaggggtacgtgggccagcgcggcgggcggagccaggtctcctactaccccgcggagaacagctactcccgctggagcggcctgctgtccccctgcgacgccgactggctcgggatgctggtggtgaagaaggccaagggcagcgacatgatcgtcccggggccctcctacaagggcaaggtgttcttcgagcggcccaccttcgacggctacgtggggtggggctgcgggagcggcaagtcccgcaccgagagcggcgagctgtgcagctccgacagcgggacgtccagcggcctcctgccctccgaccgggtcctgtggatcggggacgtggcctgccagccgatgacccccatccccgaggagaccttcctcgagctgaagtccttctcccagagcgagttccccgacatctgcaagatcgacggcatcgtgttcaaccagtgcgagggggagtccctgccgcagcccatcgacgtcgcctggatggacgtgggccacagccacaagatcatcatgcgcgagcacaagaccaagtgggtgcaggagtccagctccaaggacttcgtctgctacaaggagggcacggggccctgcagcgagtccgaggagaagacctgcaagaccagcggctcctgccgcggggacatgcagttctgcaaggtggcgggctgcgagcacggggaggaggccagcgaggccaagtgccggtgctccctcgtgcacaagcccggcgaggtcgtggtgagctacggcgggatgcgggtccgcccgaagtgctacggcttcagccggatgatggccaccctggaggtgaaccagcccgagcagcgcatcgggcagtgcacgggctgccacctggagtgcatcaacgggggcgtgcggctcatcaccctgacctccgagctcaagagcgcgaccgtctgcgcctcccacttctgcagctccgccacgagcggcaagaagtccaccgagatccagttccacagcgggtccctcgtgggcaagaccgccatccacgtcaagggggccctggtggacggcaccgagttcacgttcgagggcagctgcatgttccccgacgggtgcgacgcggtggactgcaccttctgccgcgagttcctgaagaacccccagtgctacccggccaagaagtggctgttcatcatcatcgtcatcctgctgggctacgccgggctcatgctgctgaccaacgtgctcaaggccatcggcatctgggggtcctgggtgatcgcccccgtcaagctgatcttcgcgatcatcaagaagctgatgcggaccgtgagctgcctcatgggcaagctgatggaccgcggccgccaggtgatccacgaggagatcggggagaaccgggagggcaaccaggacgacgtccggatcgagatggcccgcccccgccgggtgcgccactggatgtactcccccgtgatcctgacgatcctcgccatcgggctggccgagagctgcgacgagatggtccacgccgactccaagctggtgagctgccggcagggctccgggaacatgaaggagtgcgtgaccaccggccgcgcgctcctgccggccgtcaaccccggccaggaggcctgcctgcacttcaccgcccccgggagccccgacagcaagtgcctcaagatcaaggtgaagcggatcaacctgaagtgcaagaagtccagctcctacttcgtgccggacgcccgcagccggtgcacgtccgtccgccggtgccgctgggcgggcgactgccagagcgggtgcccgccccacttcacctccaacagcttctccgacgactgggccggcaagatggaccgggccgggctgggcttcagcggctgctccgacgggtgcggcggggccgcgtgcggctgcttcaacgccgcccccagctgcatcttctggcgcaagtgggtggagaacccccacgggatcatctggaaggtgtccccctgcgccgcctgggtccccagcgcggtgatcgagctcaccatgccgtccggcgaggtgcggaccttccaccccatgagcggcatccccacgcaggtcttcaagggggtgtccgtgacctacctgggcagcgacatggaggtctccgggctgaccgacctctgcgagatcgaggagctcaagagcaagaagctggccctggccccctgcaaccaggccggcatgggcgtggtggggaaggtcggcgagatccagtgcagctccgaggagagcgcccgcaccatcaagaaggacgggtgcatctggaacgcggacctggtgggcatcgagctgcgggtggacgacgccgtctgctactccaagatcacgagcgtggaggccgtggccaactactccgccatcccgaccaccatcgggggcctgcgcttcgagcggagccacgactcccagggcaagatcagcgggagccccctcgacatcaccgcgatccgcggcagcttctccgtcaactaccgggggctgcgcctgagcctctccgagatcacggcgacctgcaccggcgaggtgaccaacgtgagcgggtgctactcctgcatgaccggcgccaaggtcagcatcaagctgcactccagcaagaactccacggcccacgtgcgctgcaagggcgacgagaccgccttcagcgtgctggagggggtccacagctacaccgtgtccctcagcttcgaccacgccgtggtcgacgagcagtgccagctgaactgcggcgggcacgagtcccaggtgaccctgaagggcaacctcatcttcctggacgtgcccaagttcgtcgacgggagctacatgcagacgtaccactccaccgtgcccaccggcgccaacatcccgagccccaccgactggctgaacgccctcttcggcaacgggctgtcccggtggatcctgggcgtgatcggggtcctcctgggcggcctggccctcttcttcatgatcatgagcctgttcaagctggggacgaagcaggtcttccgctcccggaccaagctcgcgtga

SEQ ID NO: 13245 - RNA, 3222 nt, synthetic construct
  misc_feature 1..3222: note = derived and/or modified CDS sequence (opt1) from SFTSV/FTLSV(2012YSH10)__KF711940.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccaaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccatgagcggcaagaagtccacggagatccagttccacagcggctccctcgtggggaagaccgccatccacgtcaagggcgccctggtggacgggaccgagttcaccttcgagggcagctgcatgttccccgacggctgcgacgcggtggactgcacgttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgaccatcctcgccatcggcctggccgagagctgcgacgagatggtccacgccgactccaagctggtgagctgccggcaggggtccggcaacatgaaggagtgcgtgacgaccgggcgcgcgctcctgccggccgtcaaccccggccaggaggcctgcctgcacttcaccgcccccggcagccccgacagcaagtgcctccggatcaaggtgaagcgcatcaacctgaagtgcaagaagtccagctcctacttcgtgccggacgcccggagccgctgcacctccgtccggcgctgccggtgggcgggggactgccagagcggctgcccgccccacttcacgtccaacagcttctccgacgactgggccgggaagatggaccgcgccggcctggggttcagcggctgctccgacggctgcgggggcgccgcgtgcgggtgcttcaacgccgcccccagctgcatcttctggcggaagtgggtggagaacccccacggcatcatctggaaggtgtccccctgcgccgcctgggtccccagcgcggtgatcgagctcaccatgccgtccggggaggtgcgcaccttccaccccatgagcggcatccccacccaggtcttcaagggcgtgtccgtgacgtacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccggaccatcaagaaggacggctgcatctggaacgcggacctggtggggatcgagctgcgcgtggacgacgccgtctgctactccaagatcaccagcgtggaggccgtggccaactactccgccatcccgacgaccatcggcgggctgcggttcgagcgcagccacgactcccagggcaagatcagcggcagccccctcgacatcaccgcgatccgggggagcttctccgtcaactaccgcggcctgcgcctgagcctctccgagatcaccgccacgtgcaccggggaggtgaccaacgtgagcggctgctactcctgcatgaccggggccaaggtcagcatcaagctgcactccagcaagaactccaccgcccacgtgcggtgcaagggcgacgagacggcgttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacctaccactccacggtgcccaccggggccaacatcccgagccccaccgactggctgaacgccctcttcggcaacggcctgtcccgctgggtgctgggggtcatgggcgtgctcctcgggggcctggccctgttcttcatgatcatgagcctgttcaagctgggcaccaagcaggtcttccggtcccgcacgaagctcgcgtga

SEQ ID NO: 13246 - RNA, 3222 nt, synthetic construct
  misc_feature 1..3222: note = derived and/or modified CDS sequence (opt1) from SFTSV/FTLSV(2012YSH104)__KF711943.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccaaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgcaagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgacccggacggtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgaccatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcacggcccccggcagccccgacagcaagtgcctccggatcaaggtgaagcgcatcaacctgaagtgcaagaagtccagctcctacttcgtgccggacgcccggtaccgctgcaccagcgtccggcgctgccggtgggcgggggactgccagtccggctgcccgccccacttcaccagcaactccttcagcgacgactgggccgggaagatggaccgcgccggcctggggttctccggctgcagcgacggctgcgggggcgccgcgtgcgggtgcttcaacgccgccccctcctgcatcttctggcggaagtgggtggagaacccccacggcatcatctggaaggtgagcccctgcgccgcctgggtcccctccgcggtgatcgagctcaccatgccgagcggggaggtgcgcacgttccaccccatgtccggcatccccacccaggtcttcaagggcgtgagcgtgacctacctggggtccgacatggaggtcagcggcctgaccgacctctgcgagatcgaggagctgaagtccaagaagctggccctggccccctgcaaccaggccgggatgggcgtggtgggcaaggtcggggagatccagtgcagcagcgaggagtccgcccggacgatcaagaaggacggctgcatctggaacgcggacctcgtggggatcgagctgcgcgtggacgacgccgtctgctacagcaagatcacctccgtggaggccgtggccaactacagcgccatcccgaccaccatcggcgggctgcggttcgagcgctcccacgacagccagggcaagatctccggcagccccctcgacatcacggcgatccgggggtccttcagcgtcaactaccgcggcctgcgcctgtccctcagcgagatcaccgcgacctgcaccggggaggtgaccaacgtgtccggctgctacagctgcatgacgggggccaaggtctccatcaagctgcacagctccaagaacagcaccgcccacgtgcggtgcaagggcgacgagaccgccttctccgtgctggagggcgtccacagctacaccgtgagcctctccttcgaccacgccgtggtcgacgagcagtgccagctgaactgcgggggccacgagagccaggtgacgctgaaggggaacctcatcttcctggacgtgcccaagttcgtcgacggctcctacatgcagacctaccacagcaccgtgcccaccggggccaacatcccgtcccccacggactggctgaacgccctcttcggcaacggcctgagccgctgggtgctgggggtcatgggcgtgctcctcgggggcctggccctgttcttcatgatcatgtccctgttcaagctgggcaccaagcaggtcttccggagccgcaccaagctcgcgtga

SEQ ID NO: 13247 - RNA, 3222 nt, synthetic construct
  misc_feature 1..3222: note = derived and/or modified CDS sequence (opt1) from SFTSV/FTLSV(2012YSH105)__KF711944.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccaaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctccggatcaaggtgaagcgcatcaacctgaagtgcaagaagtccagctcctacttcgtgccggacgcccggagccgctgcacgtccgtccggcgctgccggtgggcgggggactgccagagcggctgcccgccccacttcacctccaacagcttctccggggactgggccggcaagatggaccgcgccgggctgggcttcagcggctgctccgacgggtgcggcggggccgcgtgcggctgcttcaacgccgcccccagctgcatcttctggcggaagtgggtggagaacccccacgggatcatctggaaggtgtccccctgcgccgcctgggtccccagcgcggtgatcgagctcaccatgccgtccggcgaggtgcgcaccttccaccccatgagcggcatccccacgcaggtcttcaagggggtgtccgtgacctacctgggcagcgacatggaggtctccgggctgaccgacctctgcgagatcgaggagctcaagagcaagaagctggccctggccccctgcaaccaggccggcatgggcgtggtggggaaggtcggcgagatccagtgcagctccgaggagagcgcccggaccatcaagaaggacgggtgcatctggaacgcggacctggtgggcatcgagctgcgcgtggacgacgccgtctgctactccaagatcacgagcgtggaggccgtggccaactactccgccatcccgaccaccatcgggggcctgcggttcgagcgcagccacgactcccagggcaagatcagcgggagccccctcgacatcaccgcgatccggggcagcttctccgtcaactaccgcgggctgcgcctgagcctctccgagatcacggcgacctgcaccggcgaggtgaccaacgtgagcgggtgctactcctgcatgaccggcgccaaggtcagcatcaagctgcactccagcaagaactccacggcccacgtgcggtgcaagggcgacgagaccgccttcagcgtgctggagggggtccacagctacaccgtgtccctcagcttcgaccacgccgtggtcgacgagcagtgccagctgaactgcggcgggcacgagtcccaggtgaccctgaagggcaacctcatcttcctggacgtgcccaagttcgtcgacgggagctacatgcagacgtaccactccaccgtgcccaccggcgccaacatcccgagccccaccgactggctgaacgccctcttcggcaacgggctgtcccgctggatcctgggcgtgatgggggtcctcctgggcggcctggccctcttcttcatgatcatgagcctgttcaagctggggacgaagcaggtcttccggtcccgcaccaagctcgcgtga

SEQ ID NO: 13248 - RNA, 3222 nt, synthetic construct
  misc_feature 1..3222: note = derived and/or modified CDS sequence (opt1) from SFTSV/FTLSV(2012YSH107)__KF711942.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccaaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagaccgggaagaccagcggctcctgccgcggggacatgcagttctgcaaggtggcgggctgcgagcacggggaggaggccagcgaggccaagtgccggtgctccctcgtgcacaagcccggcgaggtcgtggtgagctacggcgggatgcgggtccgcccgaagtgctacggcttcagccggatgatggccaccctggaggtgaaccagcccgagcagcgcatcgggcagtgcacgggctgccacctggagtgcatcaacgggggcgtgcggctcatcaccctgacctccgagctcaagagcgcgaccgtctgcgcctcccacttctgcagctccgccacgagcggcaagaagtccaccgagatccagttccacagcgggtccctggtgggcaagaccgccatccacgtcaagggggccctggtggacggcaccgagttcacgttcgagggcagctgcatgttccccgacgggtgcgacgcggtggactgcaccttctgccgcgagttcctgaagaacccccagtgctacccggccaagaagtggctgttcatcatcatcgtcatcctgctgggctacgccgggctcatgctgctgaccaacgtgctcaaggccatcggcatctgggggtcctgggtgatcgcccccgtcaagctgatcttcgcgatcatcaagaagctgatgcggaccgtgagctgcctcatgggcaagctgatggaccgcggccgccaggtgatccacgaggagatcggggagaaccgggagggcaaccaggacgacgtccggatcgagatggcccgcccccgccgggtgcgccactggatgtactcccccgtgatcctgacgatcctcgccatcgggctggccgagagctgcgacgagatggtccacgccgactccaagctggtgagctgccggcagggctccgggaacatgaaggagtgcgtgaccaccggccgcgcgctcctgccggccgtcaaccccggccaggaggcctgcctgcacttcaccgcccccgggagccccgacagcaagtgcctccggatcaaggtgaagcgcatcaacctgaagtgcaagaagtccagctcctacttcgtgccggacgcccggtaccgctgcacgagcgtccggcgctgccggtgggcgggcgactgccagtccgggtgcccgccccacttcaccagcaactccttcagcgacgactgggccggcaagatggaccgcgccgggctgggcttctccggctgcagcgacgggtgcggcggggccgcgtgcggctgcttcaacgccgccccctcctgcatcttctggcggaagtgggtggagaacccccacgggatcatctggaaggtgagcccctgcgccgcctgggtcccctccgcggtgatcgagctcaccatgccgagcggcgaggtgcgcaccttccaccccatgtccggcatccccacgcaggtcttcaagggggtgagcgtgacctacctgggctccgacatggaggtcagcgggctgaccgacctctgcgagatcgaggagctgaagtccaagaagctggccctggccccctgcaaccaggccggcatgggcgtggtggggaaggtcggcgagatccagtgcagcagcgaggagtccgcccggaccatcaagaaggacgggtgcatctggaacgcggacctcgtgggcatcgagctgcgcgtggacgacgccgtctgctacagcaagatcacgtccgtggaggccgtggccaactacagcgccatcccgaccaccatcgggggcctgcggttcgagcgctcccacgacagccagggcaagatctccgggagccccctcgacatcaccgcgatccggggctccttcagcgtcaactaccgcgggctgcgcctgtccctcagcgagatcacggcgacctgcaccggcgaggtgaccaacgtgtccgggtgctacagctgcatgaccggcgccaaggtctccatcaagctgcacagctccaagaacagcacggcccacgtgcggtgcaagggcgacgagaccgccttctccgtgctggagggggtccacagctacaccgtgagcctctccttcgaccacgccgtggtcgacgagcagtgccagctgaactgcggcgggcacgagagccaggtgaccctgaagggcaacctcatcttcctggacgtgcccaagttcgtcgacgggtcctacatgcagacgtaccacagcaccgtgcccaccggcgccaacatcccgtcccccaccgactggctgaacgccctcttcggcaacgggctgagccgctgggtgctgggcgtcatgggggtgctcctgggcggcctggccctcttcttcatgatcatgtccctgttcaagctggggacgaagcaggtcttccggagccgcaccaagctcgcgtga

SEQ ID NO: 13249 - RNA, 3222 nt, synthetic construct
  misc_feature 1..3222: note = derived and/or modified CDS sequence (opt1) from SFTSV/FTLSV(2012YSH14)__KF711938.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcatcggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccggggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcctgtcccggtggatcctgggggtgatcggcgtcctcctcgggggcctggccctgttcttcatgatcatgagcctgttcaagctgggcacgaagcaggtcttccgctcccggaccaagctcgcgtga

SEQ ID NO: 13250 - RNA, 3222 nt, synthetic construct
  misc_feature 1..3222: note = derived and/or modified CDS sequence (opt1) from SFTSV/FTLSV(2012YSH16)__KF711934.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgctaccggtgcacgagcgtccgccggtgccgctgggcgggggactgccagtccggctgcccgccccacttcaccagcaactccttcagcgacgactgggccgggaagatggaccgggccggcctggggttctccggctgcagcgacggctgcgggggcgccgcgtgcgggtgcttcaacgccgccccctcctgcatcttctggcgcaagtgggtggagaacccccacggcatcatctggaaggtgagcccctgcgccgcctgggtcccctccgcggtgatcgagctcaccatgccgagcggggaggtgcggaccttccaccccatgtccggcatccccacgcaggtcttcaagggcgtgagcgtgacctacctggggtccgacatggaggtcagcggcctgaccgacctctgcgagatcgaggagctgaagtccaagaagctggccctggccccctgcaaccaggccgggatgggcgtggtgggcaaggtcggggagatccagtgcagcagcgaggagtccgcccgcaccatcaagaaggacggctgcatctggaacgcggacctcgtggggatcgagctgcgggtggacgacgccgtctgctacagcaagatcacgtccgtggaggccgtggccaactacagcgccatcccgaccaccatcggcgggctgcgcttcgagcggtcccacgacagccagggcaagatctccggcagccccctcgacatcaccgcgatccgcgggtccttcagcgtcaactaccggggcctgcgcctgtccctcagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttctccgtgctggagggcgtccacagctacaccgtgagcctctccttcgaccacgccgtggtcgacgagcagtgccagctgaactgcgggggccacgagagccaggtgaccctgaaggggaacctcatcttcctggacgtgcccaagttcgtcgacggctcctacatgcagacgtaccacagcaccgtgcccaccggggccaacatcccgtcccccaccgactggctgaacgccctcttcggcaacggcctgagccggtggatcctgggggtgatcggcgtcctcctcgggggcctggccctgttcttcatgatcatgtccctgttcaagctgggcacgaagcaggtcttccgcagccggaccaagctcgcgtga

SEQ ID NO: 13251 - RNA, 3222 nt, synthetic construct
  misc_feature 1..3222: note = derived and/or modified CDS sequence (opt1) from SFTSV/FTLSV(2012YSH6)__KF711921.1__GP
  source 1..3222: mol_type = other RNA
atgatgaaggtgatctggttcagctccctgatctgcctcgtgatccagtgcagcggcgactccgggcccatcatctgcgccggcccgatccacagcaacaagtccgccgggatcccccacctcctgggctacagcgagaagatctgccagatcgaccgcctcatccacgtgtccagctggctgcggaaccactcccagttccaggggtacgtgggccagcgcggcgggcggagccaggtctcctactaccccgcggagaacagctactcccgctggaacggcctgctcagcccctgcgacgccgactggctggggatgctggtggtgaagaaggccaaggagtccgacatgatcgtcccgggccccagctacaaggggaaggtgttcttcgagcggcccaccttcgacggctacgtgggctgggggtgcggctccggcaagagccgcaccgagtccggggagctctgcagcagcgactccggcacgagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagggcgagagcctcccgcagcccttcgacgtcgcctggatggacgtggggcactcccacaagatcatcatgcgcgagcacaagaccaagtgggtgcaggagagctccagcaaggacttcgtctgctacaaggagggcacgggcccctgctccgagagcgaggagaaggcgtgcaagacctccgggagctgccggggcgacatgcagttctgcaaggtggccgggtgcgagcacggcgaggaggcctccgaggccaagtgccgctgcagcctggtgcacaagcccggggaggtcgtggtgtcctacggcggcatgcgggtccgcccgaagtgctacgggttcagccggatgatggcgaccctggaggtgaacccgcccgagcagcgcatcggccagtgcaccgggtgccacctcgagtgcatcaacggcggggtgcggctgatcacgctgaccagcgagctccgctccgccaccgtctgcgccagccacttctgctccagcgccacctccggcaagaagtccacggagatccacttccactccggcagcctggtggggaagaccgccatccacgtcaagggcgcgctggtggacgggaccgagttcaccttcgagggctcctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctggtgaccaacgtgctcaaggccatcggggtctggggcagctgggtgatcgcgcccgtgaagctgatgttcgccatcatcaagaagctgatgcgcaccgtctcctgcctcgtggggaagctgatggaccggggccgccaggtgatccacgaggagatcggcgagaacggggagggcaaccaggacgacgtccggatcgagatggcccgcccccgccgggtgcgccactggatgtacagcccggtgatcctgaccatcctcgccatcgggctggccgagggctgcgacgagatggtccacgcggactccaagctggtgagctgccggcaggggtccggcaacatgaaggagtgcatcacgaccggccgcgccctcctgcccgccgtgaaccccgggcaggaggcctgcctgcacttcaccgcccccggcagcccggactccaagtgcctcaagatcaaggtcaagcggatcaacctgaagtgcaagaagtccagcagctacttcgtgcccgacgcgcgcagccggtgcacctccgtgcgccggtgccgctgggccggggactgccagagcggctgcccgccccacttcacgtccaacagcttctccgacgactgggccgggaagatggaccgggccggcctgggcttcagcgggtgctccgacggctgcgggggcgcggcctgcgggtgcttcaacgccgcccccagctgcatcttctggcgcaagtgggtcgagaacccccacggcatcatctggaaggtgtccccctgcgccgcgtgggtgccgagcgccgtcatcgagctcaccatgccctccggcgaggtgcggaccttccaccccatgagcgggatccccacccaggtgttcaagggcgtctccgtgacgtacctggggagcgacatggaggtgtccggcctgaccgacctctgcgagatcgaggagctcaagagcaagaagctggccctggccccgtgcaaccaggccggcatgggggtcgtgggcaaggtgggggagatccagtgctccagcgaggagagcgcgcgcaccatcaagaaggacggctgcatctggaacgccgacctggtcgggatcgagctgcgggtggacgacgccgtgtgctactccaagatcaccagcgtcgaggccgtggccaactactccgcgatccccacgaccatcggcggcctgcgcttcgagcggagccacgactcccaggggaagatcagcggcagccccctcgacatcaccgccatccgcgggagcttctccgtgaactaccggggcctgcgcctgagcctctccgagatcaccgccacgtgcaccggggaggtcaccaacgtgagcggctgctactcctgcatgaccggcgccaaggtgagcatcaagctgcactccagcaagaactccaccgcgcacgtccgctgcaagggggacgagacggccttcagcgtgctggagggcgtgcactcctacatcgtcagcctcagcttcgaccacgccgtggtggacgagcagtgccagctgaactgcgggggccacgagtcccaggtcaccctgaaggggaacctcatcttcctggacgtgcccaagttcgtggacggcagctacatgcagacctaccactccaccgtcccgacgggcgccaacatccccagccccaccgactggctgaacgccctcttcgggaacggcctgtcccggtggatcctgggggtgatcggcgtcctcctgggcgggctggcgctgttcttcctgatcatgttcctgctcaagctgggcaccaagcaggtcttccgcagccggaccaagctggcctga

SEQ ID NO: 13252 - RNA, 3222 nt, synthetic construct
  misc_feature 1..3222: note = derived and/or modified CDS sequence (opt1) from SFTSV/FTLSV(2012YSH86)__KF711939.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgccacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatgttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccggggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcctgtcccggtggatcctgggggtgatcggcgtcctcctcgggggcctggccctgttcttcatgatcatgagcctgttcaagctgggcacgaagcaggtcctccgctcccggaccaagctggcgtga

SEQ ID NO: 13253 - RNA, 3222 nt, synthetic construct
  misc_feature 1..3222: note = derived and/or modified CDS sequence (opt1) from SFTSV/FTLSV(2012YSH89)__KF711935.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccggggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcgctgcaagggcgacgaggcggccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacctaccactccacggtgcccaccggggccaacatcccgagccccaccgactggctgaacgccctcttcggcaacggcctgtcccggtggatcctgggggtgatcggcgtcctcctcgggggcctggccctgttcttcatgatcatgagcctgttcaagctgggcaccaagcaggtcttccgctcccggacgaagctcgcctga

SEQ ID NO: 13254 - RNA, 3222 nt, synthetic construct
  misc_feature 1..3222: note = derived and/or modified CDS sequence (opt1) from SFTSV/FTLSV(2012YSH9)__KF711919.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccgcgtctcctactaccccgcggagaacagctactcccggtggagcggcctgctctccccctgcgacgccgactggctggggatgctggtggtgaagaaggccaaggagagcgacatgatcgtcccgggcccctcctacaaggggaaggtgttcttcgagcgccccaccttcgacggctacgtgggctgggggtgcggcagcgggaagtcccggaccgagagcggcgagctctgcagctccgacagcggcacgtccagcgggctgctgccctccgaccgcgtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgggagcacaagaccaagtgggtgcaggagtccagctccaaggacttcgtctgctacaaggagggcacgggcccctgcagcgagtccgaggagaaggcgtgcaagaccagcgggtcctgccgcggcgacatgcagttctgcaaggtggccgggtgcgagcacggcgaggaggccagcgaggccaagtgccggtgctccctggtgcacaagcccggggaggtcgtggtgagctacggcggcatgcgcgtccggccgaagtgctacgggttcagccgcatgatggcgaccctggaggtgaaccggcccgagcagcgcatcggccagtgcaccgggtgccacctcgagtgcatcaacggcggggtgcggctgatcacgctgacctccgagctccgcagcgccaccgtctgcgcctcccacttctgcagctccgccaccagcggcaagaagaacacggagatccacttccactccggcagcctggtggggaagaccgccatccacgtcaagggcgcgctggtggacgggaccgagttcaccttcgagggctcctgcatgttccccgacggctgcgacgccgtggactgcacgttctgccgggagttcctcaagaacccccagtgctacccggccaagaagtggctgttcatcatcatcgtcatcctgctcgggtacgccggcctgatgctgctcaccaacgtgctgaaggccatcggggtgtggggcagctgggtcatcgcgcccgtgaagctgatgttcgccatcatcaagaagctcatgcgcaccgtgtcctgcctggtcgggaagctgatggaccggggccgccaggtgatccacgaggagatcggcgagaacggggagggcaaccaggacgacgtgcgcatcgagatggcccggccccgccgggtccgccactggatgtacagccccgtgatcctcaccatcctggccatcgggctggccgagggctgcgacgagatggtgcacgcggactccaagctcgtcagctgccggcaggggtccggcaacatgaaggagtgcatcacgaccggccgcgccctgctgccggccgtgaaccccgggcaggaggcctgcctccacttcaccgcccccggcagccccgactccaagtgcctgaagatcaaggtgaagcggatcaacctgaagtgcaagaagtccagctcctacttcgtcccggacgcgcgcagccggtgcacctccgtgcgccggtgccgctgggccggggactgccagagcggctgcccgccccacttcacgtccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtggagaacccccacggcatcatctggaaggtctccccctgcgccgcgtgggtgcccagcgccgtgatcgagctgaccatgccgtccggcgaggtccggaccttccaccccatgagcgggatccccacccaggtgttcaagggcgtgtccgtcacgtacctggggagcgacatggaggtgtccggcctcaccgacctgtgcgagatcgaggagctcaagagcaagaagctggccctggccccctgcaaccaggccggcatgggggtggtcggcaaggtgggggagatccagtgctccagcgaggagagcgcgcgcaccatcaagaaggacggctgcatctggaacgccgacctggtggggatcgagctgcgggtcgacgacgccgtgtgctactccaagatcaccagcgtggaggccgtcgccaactactccgcgatcccgacgaccatcggcggcctccgcttcgagcggagccacgactcccaggggaagatcagcggcagccccctggacatcaccgccatccgcgggagcttctccgtgaactaccgcggcctgcggctcagcctgtccgagatcaccgccacgtgcaccggggaggtgaccaacgtcagcggctgctactcctgcatgaccggcgccaaggtgagcatcaagctgcactccagcaagaactccaccgcgcacgtgcgctgcaagggggacgagacggccttcagcgtcctcgagggcgtgcactcctacatcgtgagcctgagcttcgaccacgccgtcgtggacgagcagtgccagctgaactgcgggggccacgagtcccaggtgaccctcaaggggaacctgatcttcctggacgtccccaagttcgtggacggcagctacatgcagacctaccactccaccgtgcccacgggcgccaacatcccgagccccaccgactggctcaacgccctgttcgggaacggcctgtcccggtggatcctcggggtcatcggcgtgctgctgggcgggctcgcgctgttcttcctgatcatgttcctcctgaagctgggcaccaagcaggtcttccgcagccggaccaagctcgcctga

SEQ ID NO: 13255 - RNA, 3222 nt, synthetic construct
  misc_feature 1..3222: note = derived and/or modified CDS sequence (opt1) from SFTSV/FTLSV(2012YSH91)__KF711920.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccacgaggagaccttcctggagctcaagagcttctcccagagcgagttccccgacatctgcaagatcgacgggatcgtgttcaaccagtgcgagggcgagtccctgccccagccgttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgagaaggccagcgagaccaagtgccgctgctccctggtgcacaagcccggggaggtcgtggtgagctacggcggcatgcgggtccgccccaagtgctacgggatcagccggatgatggccaccctggaggtgaacccgcccgagcagcgcatcggccagtgcacggggtgccacctcgagtgcatcaacggcggggtgcggctgatcaccctgacctccgagctccgcagcgcgaccgtctgcgcctcccacttctgcagctccgccagctccggcaagaagtccacggagatccacttccacagcggcagcctggtggggaagaccgccatccacgtcaagggcgccctggtggacgggaccgagttcaccttcgagggctcctgcatgttccccgacggctgcgacgcggtggactgcacgttctgccgggagttcctcaagaacccccagtgctacccggccaagaagtggctgttcatcatcatcgtcatcctgctcgggtacgccggcctgatgctgctcaccaacgtgctgaaggccatcggggtgtggggcagctgggtcatcgcccccgtgaagctgatgttcgcgatcatcaagaagctcatgcgcaccgtgtcctgcctggtcgggaagctgatggaccggggccgccaggtgatccacgaggagatcggcgagaacggggagggcaaccaggacgacgtgcggatcgagatggcccgcccccgccgggtccgccactggatgtacagccccgtgatcctcaccatcctggccatcgggctggccgagggctgcgacgagatggtgcacgccgactccaagctcgtcagctgccggcaggggtccggcaacatgaaggagtgcatcacgaccggccgcgcgctgctgccggccgtgaaccccgggcaggaggcctgcctccacttcaccgcccccggcagccccgacagcaagtgcctgaagatcaaggtgaagcggatcaacatcaagtgcaagaagtccagctcctacttcgtccgcgacgcccggagccgctgcacctccgtgcggcgctgccggtgggcgggggactgccagagcggctgcccgccccacttcacgtccaacagcttctccgacgactgggccgggaagatggaccgcgccggcctgggcttcagcgggtgctccgacggctgcgggggcgccgcgtgcgggtgcttcaacgccgcccccagctgcatcttctggcggaagtgggtggagaacccgcacggcatcatctggaaggtctccccctgcgccgcctgggtgcccagcgcggtgatcgagctcaccatgccctccggcgaggtccgcaccttccacccgatgagcgggatccccacccaggtgttcaagggcgtgtccgtcacgtacctggggagcgacatggaggtgtccggcctgaccgacctctgcgagatcgaggagctcaagagcaagaagctggccctggccccctgcaaccaggccggcatgggggtggtcggcaaggtgggggagaagcagtgcagctccgaggagagcgcccggaccatcaagaaggacggctgcatctggaacgcggacctggtggggatcgagctgcgcgtcgacgacgccgtgtgctactccaagatcaccagcgtggaggccgtcgccaactactccgccatccccacgaccatcggcggcctgcggttcgagcgcagccacgactcccaggggaagatcagcggctccccgctcgacatcaccgcgatccgggggagcttctccgtgaactaccgcggcctgcgcctgagcctctccgagatcaccgccacgtgcaccggggaggtgaccaacgtcagcggctgctactcctgcatgaccggcgccaaggtgagcatcaagctgcactccagcaagaactccaccgcccacgtgcggtgcaagggggacgagacggcgttcagcgtcctggagggcgtgcacagctacatcgtgtccctcagcttcgaccacgccgtcgtggacgagcagtgccagctgaactgcgggggccacgagtcccaggtgaccctgaaggggaacctcatcttcctggacgtccccaagttcgtggacggcagctacatgcagacctaccactccaccgtgcccacgggcgccaacatccccagcccgaccgactggctgaacgccctcttcgggaacggcctgtcccgctggatcctgggggtcatcggcgtgctcctgggcgggctggccctcttcttcctgatcatgttcctgctcaagctgggcaccaagcaggtcttccggagccgcaccaagctggcgtga

SEQ ID NO: 13256 - RNA, 3222 nt, synthetic construct
  misc_feature 1..3222: note = derived and/or modified CDS sequence (opt1) from SFTSV/FTLSV(2012YSH92)__KF711941.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagccactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccaaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctccggatcaaggtgaagcgcatcaacctgaagtgcaagaagtccagctcctacttcgtgccggacgcccggagccgctgcacgtccgtccggcgctgccggtgggcgggggactgccagagcggctgcccgccccacttcacctccaacagcttctccgacgactgggccgggaagatggaccgcgccggcctggggttcagcggctgctccgacggctgcgggggcgccgcgtgcgggtgcttcaacgccgcccccagctgcatcttctggcggaagtgggtggagaacccccacggcatcatctggaaggtgtccccctgcgccgcctgggtccccagcgcggtgatcgagctcaccatgccgtccggggaggtgcgcaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccggaccatcaagaaggacggctgcatctggaacgcggacctggtggggatcgagctgcgcgtggacgacgccgtctgctactccaagatcacgagcgtggaggccgtggccaactactccgccatcccgaccaccatcggcgggctgcggttcgagcgcagccacgactcccagggcaagatcagcggcagccccctcgacatcaccgcgatccgggggagcttctccgtcaactaccgcggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcggtgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcctgtcccgctgggtgctgggggtcatgggcgtgctcctcgggggcctggccctgttcttcatgatcatgagcctgttcaagctgggcacgaagcaggtcttccggtcccgcaccaagctcgcgtga

SEQ ID NO: 13257 - RNA, 3222 nt, synthetic construct
  misc_feature 1..3222: note = derived and/or modified CDS sequence (opt1) from SFTSV/FTLSV(2012YSH93)__KF711946.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccaaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgacccggacggtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgaccatcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcacggcccccggcagccccgacagcaagtgcctcaagatcaaggtgaagcggatcaacctgaagtgcaagaagtccagctcctacttcgtgccggacgcccgctaccggtgcaccagcgtccgccggtgccgctgggcgggggactgccagtccggctgcccgccccacttcaccagcaactccttcagcgacgactgggccgggaagatggaccgggccggcctggggttctccggctgcagcgacggctgcgggggcgccgcgtgcgggtgcttcaacgccgccccctcctgcatcttctggcgcaagtgggtggagaacccccacggcatcatctggaaggtgagcccctgcgccgcctgggtcccctccgcggtgatcgagctcaccatgccgagcggggaggtgcggacgttccaccccatgtccggcatccccacccaggtcttcaagggcgtgagcgtgacctacctggggtccgacatggaggtcagcggcctgaccgacctctgcgagatcgaggagctgaagtccaagaagctggccctggccccctgcaaccaggccgggatgggcgtggtgggcaaggtcggggagatccagtgcagcagcgaggagtccgcccgcacgatcaagaaggacggctgcatctggaacgcggacctcgtggggatcgagctgcgggtggacgacgccgtctgctacagcaagatcacctccgtggaggccgtggccaactacagcgccatcccgaccaccatcggcgggctgcgcttcgagcggtcccacgacagccagggcaagatctccggcagccccctcgacatcacggcgatccgcgggtccttcagcgtcaactaccggggcctgcgcctgtccctcagcgagatcaccgcgacctgcaccggggaggtgaccaacgtgtccggctgctacagctgcatgacgggggccaaggtctccatcaagctgcacagctccaagaacagcaccgcccacgtgcgctgcaagggcgacgagaccgccttctccgtgctggagggcgtccacagctacaccgtgagcctctccttcgaccacgccgtggtcgacgagcagtgccagctgaactgcgggggccacgagagccaggtgacgctgaaggggaacctcatcttcctggacgtgcccaagttcgtcgacggctcctacatgcagacctaccacagcaccgtgcccaccggggccaacatcccgtcccccacggactggctgaacgccctcttcggcaacggcctgagccggtgggtgctgggggtcatgggcgtgctcctcgggggcctggccctgttcttcatgatcatgtccctgttcaagctgggcaccaagcaggtcttccgcagccggaccaagctcgcgtga

SEQ ID NO: 13258 - RNA, 3222 nt, synthetic construct
  misc_feature 1..3222: note = derived and/or modified CDS sequence (opt1) from SFTSV/FTLSV(YGS1)__KF356537.1__GP
  source 1..3222: mol_type = other RNA
atgatgaaggtgatctggttcagctccctggtgtgcctcgtgatccagtgcagcggcgactccgggcccatcatctgcgccggcccgatccacagcaacaagtccgccgcgatcccccacctcctggggtacagcgagaagatctgccagatcgaccgcctcatccacgtgtccagctggctgcggaaccactcccagttccagggctacgtcgggcagcgcggcggccggagccaggtgtcctactaccccgccgagaacagctactcccgctggagcgggctgctctccccctgcgacgccgactggctgggcatgctggtggtcaagaaggccaaggggagcgacatgatcgtgccgggcccctcctacaaggggaaggtgttcttcgagcggcccaccttcgacggctacgtcggctgggggtgcggcagcgggaagtcccgcaccgagagcggcgagctctgcagctccgacagcggcacgtccagcgggctgctgccctccgaccgggtgctctggatcggcgacgtggcctgccagccgatgacccccatccccgaggagaccttcctggagctcaagagcttctcccagagcgagttccccgacatctgcaagatcgacgggatcgtcttcaaccagtgcgagggcgagtccctcccgcagcccttcgacgtggcgtggatggacgtggggcacagccacaagatcatcatgcgcgagcacaagaccaagtgggtccaggagtccagctccaaggacttcgtgtgctacaaggagggcacgggcccctgcagcgagtccgaggagaaggcctgcaagaccagcgggtcctgccggggcgacatgcagttctgcaaggtggccgggtgcgagcacggcgaggaggccagcgaggcgaagtgccgctgctccctggtccacaagcccggggaggtggtggtcagctacggcggcatgcgggtgcgcccgaagtgctacgggttcagccggatgatggccaccatggaggtgaacccgcccgagcagcgcatcggccagtgcaccgggtgccacctggagtgcatcaacggcggggtccggctcatcacgctgacctccgagctcaagagcgccaccgtgtgcgcctcccacttctgcagctccgccaccagcggcaagaagtccacggagatccacttccacagcggctccctggtcgggaagaccgcgatccacgtgaagggcgccctggtggacgggaccgagttcaccttcgagggcagctgcatgttccccgacggctgcaacgccgtcgactgcacgttctgccgcgagttcctgaagaacccccagtgctaccccgccaagaagtggctgttcatcatcatcgtgatcctgctggggtacgccggcctcatgctgctgaccaacgtgctcaaggcgatcggggtctggggctcctgggtgatcgcccccgtgaagctgatgttcgccatcatgaagaagctgatgcggaccgtcagctgcctcgtggggaagctgatggaccgcggccgccaggtgatccacgaggagatcggcgagaacggggagggcaaccacgacgacgtccggatcgagatggcccggccccgccgcgtgcggcactggatgtactccccggtgatcctgaccatcctcgccatcgggctggcggagggctgcgacgagatggtccacgccgacagcaagctggtgtcctgccgccaggggagcggcaacatgaaggagtgcgtgacgaccggccgggccctcctgccctccgtcaaccccgggcaggaggcctgcctgcacttcaccgcccccggcagcccggacagcaagtgcctcaagatcaaggtgaagcgcatcaacctgaagtgcaagaagtccagctcctacttcgtgcccgacgcgcggagccgctgcacctccgtccggcgctgccggtgggccggggactgccagagcggctgcccgccccacttcacgtccaacagcttctccgacgactgggccgggaagatggaccgcgccggcctgggcttcagcgggtgctccgacggctgcgggggcgcggcctgcgggtgcttcaacgccgcccccagctgcatcttctggcggaagtgggtggagaactcccacggcatcatctggaaggtgagcccctgcgccgcgtgggtcccctccgccgtgatcgagctcaccatgccgagcggcgaggtgcgcaccttccaccccatgtccgggatccccacccaggtcttcaagggcgtgagcgtgacgtacctggggtccgacatggaggtcagcggcctgaccgacctctgcgagatcgaggagctcaagagcaagaagctggccctggccccctgcaaccaggccggcatgggggtggtgggcaaggtcggggagatccagtgctccagcgaggagtccgcgcggaccatcaagaaggacggctgcatctggaacgccgacctggtggggatcgagctgcgcgtggacgacgccgtctgctacagcaagatcacctccgtggaggccgtggccaactacagcgcgatcccgacgaccatcggcggcctgcggttcgagcgctcccacgacagccaggggaagatctccggcagccccctcgacatcaccgccatccgggggtccttcagcgtcaactaccgcggcctgcggctgtccctcagcgagatcaccgccacgtgcaccggggaggtgaccaacgtgtccggctgctacagctgcatgaccggcgccaaggtctccatcaagctgcacagctccaagaacagcaccgcgcacgtgcgctgcaagggggacgagacggccttcagcgtgctggagggcgtccactcctacaccgtgagcctctccttcgaccacgccgtggtcgacgagcagtgccagctgaactgcgggggccacgagagccaggtgaccctgaaggggaacctcatcttcctggacgtgcccaagttcgtcgacggctcctacatgcagacctaccacagcacggtgcccaccggcgccaacatcccgtcccccaccgactggctgaacgccctcttcgggaacggcctgagccgctggatcctgggggtcatcggcgtgctcctgggcgggctggcgctgttcttcctgatcatgttcctgttcaagctcggcaccaagcaggtcttccggtcccgcacgaagctggcctga

SEQ ID NO: 13259 - RNA, 3222 nt, synthetic construct
  misc_feature 1..3222: note = derived and/or modified CDS sequence (opt1) from SFTSV/FTLSV(YNY1)__KF356538.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgttcgggtacgccggcctgatgctcctgaccaacgtgctgaaggccatcgggatctggggctcctgggtgatcgcccccgtcaagctcatcttcgcgatcatcaagaagctgatgcggaccgtgagctgcctgatggggaagctcatggaccgcggccgccaggtgatccacgaggagatcggcgagaaccgggaggggaaccaggacgacgtccggatcgagatggcccgcccccgccgggtgcgccactggatgtactcccccgtgatcctgacgatcctggccatcggcctcgccgagagctgcgacgagatggtccacgccgactccaagctggtgagctgccggcaggggtccggcaacatgaaggagtgcgtgaccaccgggcgcgcgctgctcccggccgtcaaccccggccaggaggcctgcctgcacttcaccgcccccggcagccccgacagcaagtgcctgaagatcaaggtgaagcggatcaacctcaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctgaccatgccgtccggggaggtgcggaccttccaccccatgagcggcatccccacgcaggtcttcaagggcgtgtccgtgacctacctcgggagcgacatggaggtctccggcctgaccgacctgtgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctccgggtggacgacgccgtctgctactccaagatcacgagcgtggaggccgtggccaactactccgccatcccgaccaccatcggcgggctgcgcttcgagcggagccacgactcccagggcaagatcagcggcagccccctggacatcaccgcgatccgcgggagcttctccgtcaactaccggggcctccgcctgagcctgtccgagatcacggcgacctgcaccggggaggtgaccaacgtgagcggctgctactcctgcatgaccggggccaaggtcagcatcaagctccactccagcaagaactccacggcccacgtgcgctgcaagggcgacgagaccgccttcagcgtgctggagggcgtccacagctacaccgtgtccctgagcttcgaccacgccgtggtcgacgagcagtgccagctcaactgcgggggccacgagtcccaggtgaccctgaaggggaacctgatcttcctcgacgtgcccaagttcgtcgacggcagctacatgcagacgtaccactccaccgtgcccaccggggccaacatcccgagccccaccgactggctgaacgccctgttcggcaacggcctctcccggtggatcctgggggtgatgggcgtcctgctcgggggcctggccctgttcttcatgatcatgagcctcttcaagctgggcacgaagcaggtcttccgctcccggaccaagctggcgtga

SEQ ID NO: 13260 - RNA, 3222 nt, synthetic construct
  misc_feature 1..3222: note = derived and/or modified CDS sequence (opt1) from SFTSV/FTLSV(YPQ133)__KF356530.1__GP
  source 1..3222: mol_type = other RNA
atgatgaaggtgatctggttcagctccctgatctgcttcgtcatccagtgcagcggcgactccagccccatcatctgcgccgggccgatccactccaacaagagcgccgacatcccccacctcctgggctactccgagaagatctgccagatcgaccgcctgatccacgtgagctcctggctccggaaccacagccagttccaggggtacgtgggccagcgcgggggccggtcccaggtcagctactaccccgcggagaactcctacagccgctggtccggcctgctgagcccctgcgacgccgactggctcgggatgctggtggtgaagaaggccaagggctccgacatgatcgtcccggggcccagctacaagggcaaggtgttcttcgagcggcccaccttcgacgggtacgtgggctggggctgcgggtccggcaagagccgcaccgagagcggggagctgtgctccagcgactccggcacgagctccggcctcctgcccagcgaccgggtcctgtggatcggggacgtggcctgccagccgatgacccccatccccgaggagaccttcctcgagctgaagtccttcagccagtccgagttccccgacatctgcaagatcgacggcatcgtgttcaaccagtgcgagggggagagcctgccgcagcccttcgacgtcgcctggatggacgtgggccactcccagaagatcatcatgcgcgagcacaagaccaagtgggtgcaggagagctccagcaaggacttcgtctgctacaaggaggggacgggcccctgctccgagagcgaggagaagacctgcaagacctccggcagctgccgcggggacatgcagttctgcaaggtggcgggctgcgagcacggggaggaggcctccgaggccaagtgccggtgcagcctcgtgcacaagcccggcgaggtcgtggtgagctacgggggcatgcgggtccgcccgaagtgctacggcttctcccggatgatggccaccctggaggtgaaccagcccgagcagcgcatcgggcagtgcacgggctgccacctggagtgcatcaacgggggcgtgcggctcatcaccctgaccagcgagctgaagtccgcgaccgtctgcgccagccacttctgctccagcgccacgtccgggaagaagtccaccgagatccagttccacagcggcagcctcgtgggcaagaccgccatccacgtcaagggggccctggtggacggcaccgagttcacgttcgaggggtcctgcatgttccccgacggctgcgacgcggtggactgcaccttctgccgcgagttcctgaagaacccccagtgctacccggccaagaagtggctgttcatcatcatcgtcatcctgctgggctacgccgggctcatgctgctgaccaacgtgctcaaggccatcggcatctgggggagctgggtgatcgcccccgtcaagctgatcttcgcgatcatcaagaagctgatgcggaccgtgtcctgcctcatgggcaagctgatggaccgcgggcgccaggtgatccacgaggagatcggcgagaaccgggagggcaaccaggacgacgtccggatcgagatggcccgcccccgccgggtgcgccactggatgtacagccccgtgatcctgacgatcctcgccatcgggctggccgagtcctgcgacgagatggtccacgccgacagcaagctggtgtcctgccggcagggcagcgggaacatgaaggagtgcgtgaccaccggccgcgcgctcctgccggccgtcaaccccgggcaggaggcctgcctgcacttcaccgcccccggcagccccgactccaagtgcctcaagatcaaggtgaagcggatcaacctgaagtgcaagaagtccagcagctacttcgtgccggacgcccgctcccggtgcacgagcgtccgccggtgccgctgggcgggcgactgccagtccgggtgcccgccccacttcaccagcaactccttcagcgacgactgggccggcaagatggaccgggccgggctgggcttctccgggtgcagcgacggctgcggcggggccgcgtgcggctgcttcaacgccgccccctcctgcatcttctggcgcaagtgggtggagaacccccacggggtgatctggaaggtcagcccctgcgccgcctgggtgccctccgcggtgatcgagctcaccatgccgagcggcgaggtccggaccttccaccccatgtccgggatccccacccaggtgttcaagggcgtgagcgtcacctacctgggctccgacatggaggtgagcgggctgaccgacctctgcgagatcgaggagctcaagagcaagaagctggccctggccccctgcaaccaggccggcatgggggtggtcggcaaggtgggcgagatccagtgctccagcgaggagtccgcccgcaccatcaagaaggacgggtgcatctggaacgcggacctcgtgggcatcgagctgcgggtcgacgacgccgtgtgctacagcaagatcacgtccgtggaggccgtcgccaactacagcgccatcccgaccaccatcgggggcctgcgcttcgagcggtcccacgacagccaggggaagatctccggcagccccctcgacatcaccgcgatccgcggctccttcagcgtgaactaccgggggctgcgcctgtccctcagcgagatcacggccacgtgcaccggcgaggtgaccaacgtctccgggtgctacagctgcatgaccggcgccaaggtgtccatcaagctgcacagctccaagaacagcacggcccacgtgcgctgcaagggggacgagaccgcgttcagcgtcctggagggcgtgcactcctacaccgtgagcctctccttcgaccacgccgtcgtggacgagcagtgccagctgaactgcggcgggcacgagagccaggtgaccctgaagggcaacctcatcttcctggacgtccccaagttcgtggacgggtcctacatgcagacgtaccacagcaccgtgcccaccggcgccaacatcccgtcccccaccgactggctgaacgccctcttcgggaacggcctgagccggtggatcctgggcgtcatgggggtgctcctgggcgggctggccctcttcttcatgatcatgtccctgttcaagctgggcacgaagcaggtcttccgcagccggaccaagctcgcgtga

SEQ ID NO: 13261 - RNA, 3222 nt, synthetic construct
  misc_feature 1..3222: note = derived and/or modified CDS sequence (opt1) from SFTSV/FTLSV(YPQ2)__KF356531.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctggtggggaagatcgccatccacgtcaagggcgccctggtggacgggaccgagttcaccttcgagggcagctgcatgttccccgacggctgcgacgcggtggactgcacgttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgaccatcctcgccatcggcctggccgagagctgcgacgagatggtccacgccgactccaagctggtgagctgccggcaggggtccggcaacatgaaggagtgcgtgacgaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccgatggcccgcttccggtgcaccagcgtccgccggtgccgctgggcgggggactgccagtccggctgcccgccccacttcacgagcaactccttcagcgacgactgggccgggaagatggaccgggccggcctggggttctccggctgcagcgacggctgcgggggcgccgcgtgcgggtgcttcaacgccgccccctcctgcatcttctggcgcaagtgggtggagaacccccacggcatcatctggaaggtgagcccctgcgccgcctgggtcccctccgcggtgatcgagctcaccatgccgagcggggaggtgcggaccttccaccccatgtccggcatccccacccaggtcttcaagggcgtgagcgtgacgtacctggggtccgacatggaggtcagcggcctgaccgacctctgcgagatcgaggagctgaagtccaagaagctggccctggccccctgcaaccaggccgggatgggcgtggtgggcaaggtcggggagatccagtgcagcagcgaggagtccgcccgcaccatcaagaaggacggctgcatctggaacgcggacctcgtggggatcgagctgcgggtggacgacgccgtctgctacagcaagatcacctccgtggaggccgtggccaactacagcgccatcccgacgaccatcggcgggctgcgcttcgagcggtcccacgacagccaggtcaagatctccggcagccccctcgacatcaccgcgatgcgcggctccttcagcgtgaactaccgggggctgcgcctgtccctcagcgagatcaccgccacgtgcaccggcgaggtgaccaacgtctccgggtgctacagctgcatgaccggcgccaaggtgtccatcaagctgcacagctccaagaacagcaccgcccacgtgcgctgcaagggggacgagacggcgttctccgtcctggagggcgtgcacagctacaccgtgagcctctccttcgaccacgccgtcgtggacgagcagtgccagctgaactgcggcgggcacgagagccaggtgaccctgaagggcaacctcatcttcctggacgtccccaagttcgtggacgggtcctacatgcagacctaccacagcacggtgcccaccggcgccaacatcccgtcccccaccgactggctgaacgccctcttcgggaacggcctgagccggtggatcctgggcgtcatgggggtgctcctgggcgggctggccctcttcttcatgatcatgtccctgttcaagctgggcaccaagcaggtcttccgcagccggacgaagctcgcgtga

SEQ ID NO: 13262 - RNA, 3222 nt, synthetic construct
  misc_feature 1..3222: note = derived and/or modified CDS sequence (opt1) from SFTSV/FTLSV(YPQ5)__KF356532.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccgcgtctcctactaccccgcggagaacagctactcccggtggagcgggctgctgtccccctgcgacgccgactggctcggcatgctggtggtgaagaaggccaaggggagcgacatgatcgtcccgggcccctcctacaaggggaaggtgttcttcgagcgccccaccttcgacggctacgtgggctgggggtgcggcagcgggaagtcccggaccgagagcggcgagctgtgcagctccgacagcggcacgtccagcgggctcctgccctccgaccgcgtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgggagcacaagaccaagtgggtgcaggagtccagctccaaggacttcgtctgctacaaggagggcacgggcccctgcagcgagtccgaggagaagacctgcaagaccagcgggtcctgccgcggcgacatgcagttctgcaaggtggcggggtgcgagcacggcgaggaggccagcgaggccaagtgccggtgctccctcgtgcacaagcccggggaggtcgtggtgagctacggcggcatgcgcgtccggccgaagtgctacgggttcagccgcatgatggccaccctggaggtgaaccagcccgagcagcggatcggccagtgcacggggtgccacctggagtgcatcaacggcggggtgcgcctcatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgggagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcgcaccgtgagctgcctcatggggaagctgatggaccggggccgccaggtgatccacgaggagatcggcgagaaccgggaggggaaccaggacgacgtccgcatcgagatggcccgcccccggcgcgtgcggcactggatgtactcccccgtgatcctgacgatcctcgccatcggcctggccgagagctgcgacgagatggtccacgccgactccaagctggtgagctgccgccaggggtccggcaacatgaaggagtgcgtgaccaccgggcgggcgctcctgccggccgtcaaccccggccaggaggcctgcctgcacttcaccgcccccggcagccccgacagcaagtgcctcaagatcaaggtgaagcgcatcaacctgaagtgcaagaagtccagctcctacttcgtgccggtcgcccggtaccgctgcacgagcgtgcggcgctgccggtgggcgggggactgccagtccggctgcccgccccacttcaccagcaactccttcagcaacgactgggccgggaagatggaccgcgccggcctggggttctccggctgcagcgacggctgcgggggcgccgcgtgcgggtgcttcaacgccgccccctcctgcatcttctggcggaagtgggtggagaacccccacggcatcatctggaaggtcagcccctgcgccgcctgggtgccctccgcggtgatcgagctcaccatgccgagcggggaggtccgcaccttccaccccatgtccggcatccccacccaggtgttcaagggcgtgagcgtcacctacctggggtcctacatggaggtgagcggcctgaccgacctctgcgagatcgaggagctgcggtccaagaagctggccctggccccctgcaaccaggccgggatgggcgtggtcggcaaggtgggggagatccagtgcagcagcgaggagtccgcccgcaccatcaagaaggacggctgcatctggaacgcggacctcgtggggatcgagctgcgggtcgacgacgccgtgtgctacagcaagatcacgtccgtggaggccgtcgccaactacagcgccatcccgaccaccatcggcgggctgcgcttcgagcggtcccacgacagccagggcaagatctccggcagccccctcgacatcaccgcgatccgcgggtccttcagcgtgaactaccgcggcctgcggctgtccctcagcgagatcacggccacgtgcaccggggaggtgaccaacgtctccggctgctacagctgcatgaccggggccaaggtgtccatcaagctgcacagctccaagaacagcacggcccacgtgcgctgcaagggcgacgagaccgcgttctccgtcctggagggcgtgcacagctacaccgtgagcctctccttcgaccacgccgtcgtggacgagcagtgccagctgaactgcgggggccacgagagccaggtgaccctgaaggggaacctcatcttcctggacgtccccaagttcgtggacggctcctacatgcagacgtaccacagcaccgtgcccaccggggccaacatcccgtcccccaccgactggctgaacgccctcttcggcaacggcctgagccggtggatcctgggggtcatgggcgtgctcctcgggggcctggccctgttcttcatgatcatgtccctgttcaagctgggcacgaagcaggtcttccgcagccggaccaagctcgcgtga

SEQ ID NO: 13263 - RNA, 3222 nt, synthetic construct
  misc_feature 1..3222: note = derived and/or modified CDS sequence (opt1) from SFTSV/FTLSV(YSC19)__KF356536.1__GP
  source 1..3222: mol_type = other RNA
atgatgaaggtgatctggttcagctccctggtgtgcctcgtgatccagtgcagcggcgactccgggcccatcatctgcgccggcccgatccacagcaacaagtccgccgcgatcccccacctcctggggtacagcgagaagatctgccagatcgaccgcctcatccacgtgtccagctggctgcggaaccactcccagttccagggctacgtcgggcagcgcggcggccggagccaggtgtcctactaccccgccgagaacagctactcccgctggagcgggctgctctccccctgcgacgccgactggctgggcatgctggtggtcaagaaggccaaggggagcgacatgatcgtgccgggcccctcctacaaggggaaggtgttcttcgagcggcccaccttcgacggctacgtcggctgggggtgcggcagcgggaagtcccgcaccgagagcggcgagctctgcagctccgacagcggcacgtccagcgggctgctgccctccgaccgggtgctctggatcggcgacgtggcctgccagccgatgacccccatccccgaggagaccttcctggagctgaagtccttctcccagagcgagttccccgacatctgcaagatcgacgggatcgtcttcaaccagtgcgagggcgagtccctcccgcagcccttcgacgtggcgtggatggacgtggggcacagccacaagatcatcatgcgcgagcacaagaccaagtgggtccaggagtccagctccaaggacttcgtgtgctacaaggagggcacgggcccctgcagcgagtccgaggagaaggcctgcaagaccagcgggtcctgccggggcgacatgcagttctgcaaggtggccgggtgcgagcacggcgaggaggccagcgaggcgaagtgccgctgctccctggtccacaagcccggggaggtggtggtcagctacggcggcatgcgggtgcgcccgaagtgctacgggttcagccggatgatggccaccatggaggtgaacccgcccgagcagcgcatcggccagtgcaccgggtgccacctggagtgcatcaacggcggggtccggctcatcacgctgacctccgagctcaagagcgccaccgtgtgcgcctcccacttctgcagctccgccaccagcggcaagaagtccacggagatccacttccacagcggctccctcgtcgggaagaccgcgatccacgtgaagggcgccctggtggacgggaccgagttcaccttcgagggcagctgcatgttccccgacggctgcaacgccgtcgactgcacgttctgccgcgagttcctgaagaacccccagtgctaccccgccaagaagtggctgttcatcatcatcgtgatcctgctggggtacgccggcctcatgctgctgaccaacgtgctcaaggcgatcggggtctggggctcctgggtgatcgcccccgtgaagctgatgttcgccatcatgaagaagctgatgcggaccgtcagctgcctcgtggggaagctgatggaccgcggccgccaggtgatccacgaggagatcggcgagaacggggagggcaaccacgacgacgtccggatcgagatggcccggccccgccgcgtgcggcactggatgtactccccggtgatcctgaccatcctcgccatcgggctggcggagggctgcgacgagatggtccacgccgacagcaagctggtgtcctgccgccaggggagcggcaacatgaaggagtgcgtgacgaccggccgggccctcctgccctccgtcaaccccgggcaggaggcctgcctgcacttcaccgcccccggcagcccggacagcaagtgcctcaagatcaaggtgaagcgcatcaacctgaagtgcaagaagtccagctcctacttcgtgcccatcgcgcggaaccgctgcaccagcgtccggcgctgccggtgggccggggactgccagtccggctgcccgccccacttcacgagcaactccttcagcgacgactgggccgggaagatggaccgcgccggcctgggcttctccgggtgcagcgacggctgcgggggcgcggcctgcgggtgcttcaacgccgccccctcctgcatcttctggcggaagtgggtggagaacagccacggcatcatctggaaggtgtccccctgcgccgcgtgggtccccagcgccgtgatcgagctcaccatgccgtccggcgaggtgcgcaccttccaccccatgagcgggatccccacccaggtcttcaagggcgtgtccgtgacgtacctggggagcgacatggaggtctccggcctgaccgacctctgcgagatcgaggagctcaagagcaagaagctggccctggccccctgcaaccaggccggcatgggggtggtgggcaaggtcggggagatccagtgcagctccgaggagagcgcgcggaccatcaagaaggacggctgcatctggaacgccgacctggtggggatcgagctgcgcgtggacgacgccgtctgctactccaagatcaccagcgtggaggccgtggccaactactccgcgatcccgacgaccatcggcggcctgcggttcgagcgcagccacgactcccaggggaagatcagcggcagccccctcgacatcaccgccatccgggggagcttctccgtcaactaccgcggcctgcggctgagcctctccgagatcaccgccacgtgcaccggggaggtgaccaacgtgagcggctgctactcctgcatgaccggcgccaaggtcagcatcaagctgcactccagcaagaactccaccgcgcacgtgcgctgcaagggggacgagacggccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacctaccactccacggtgcccaccggcgccaacatcccgagccccaccgactggctgaacgccctcttcgggaacggcctgtcccgctggatcctgggggtcatcggcgtgctcctgggcgggctggcgctgttcttcctgatcatgttcctgttcaagctcggcaccaagcaggtcttccggagccgcacgaagctggcctga

SEQ ID NO: 13264 - RNA, 3222 nt, synthetic construct
  misc_feature 1..3222: note = derived and/or modified CDS sequence (opt1) from SFTSV/FTLSV(YSC3)__KF356535.1__GP
  source 1..3222: mol_type = other RNA
atgatgaaggtgatctggttcagctccctggtgtgcctcgtgatccagtgcagcggcgactccgggcccatcatctgcgccggcccgatccacagcaacaagtccgccgcgatcccccacctcctggggtacagcgagaagatctgccagatcgaccgcctgatccacgtgtccagctggctgcggaaccactcccagttccagggctacgtcgggcagcgcggcggccggagccaggtgtcctactaccccgccgagaacagctactcccgctggagcgggctgctctccccctgcgacgccgactggctgggcatgctggtggtcaagaaggccaaggggagcgacatgatcgtgccgggcccctcctacaaggggaaggtgttcttcgagcggcccaccttcgacggctacgtcggctgggggtgcggcagcgggaagtcccgcaccgagagcggcgagctctgcagctccgacagcggcacgtccagcgggctgctgccctccgaccgggtgctctggatcggcgacgtggcctgccagccgatgacccccatccccgaggagaccttcctggagctgaagtccttctcccagagcgagttccccgacatctgcaagatcgacgggatcgtcttcaaccagtgcgagggcgagtccctcccgcagcccttcgacgtggcgtggatggacgtggggcacagccacaagatcatcatgcgcgagcacaagaccaagtgggtccaggagtccagctccaaggacttcgtgtgctacaaggagggcacgggcccctgcagcgagtccgaggagaagacctgcaagaccagcgggtcctgccggggcgacatgcagttctgcaaggtggccgggtgcgagcacggcgaggaggccagcgaggccaagtgccgctgctccctggtccacaagcccggggaggtggtggtcagctacggcggcatgcgggtgcgcccgaagtgctacgggttcagccggatgatggcgaccctggaggtgaaccagcccgagcagcgcatcggccagtgcacggggtgccacctcgagtgcatcaacggcggggtccggctgatcaccctgacctccgagctcaagagcgccaccgtgtgcgcctcccacttctgcagctccgccacgagcggcaagaagtccaccgagatccagttccacagcggctccctggtcgggaagaccgccatccacgtgaagggcgcgctggtggacgggaccgagttcacgttcgagggcagctgcatgttccccgacggctgcgacgccgtcgactgcaccttctgccgcgagttcctcaagaacccccagtgctacccggccaagaagtggctgttcatcatcatcgtgatcctgctcgggtacgccggcctgatgctgctcaccaacgtgctgaaggccatcgggatctggggctcctgggtcatcgcgcccgtgaagctgatcttcgccatcatcaagaagctcatgcggaccgtgagctgcctgatggggaagctgatggaccgcggccggcaggtcatccacgaggagatcggcgagaaccgcgaggggaaccaggacgacgtgcggatcgagatggcccgcccccgccggatccgccactggatgtactcccccgtgatcctcacgatcctggccatcggcctggccgagagctgcgacgagatggtccacgcggactccaagctcgtgagctgccggcaggggtccggcaacatgaaggagtgcgtgaccaccgggcgcgccctgctgccggccgtcaaccccggccaggaggcctgcctccacttcaccgcccccggcagccccgacagcaagtgcctgaagatcaaggtgaagcggatcaacctgaagtgcaagaagtccagctcctacttcgtgccggacgcgcgcagccggtgcacgtccgtccgccggtgccgctgggccggggactgccagagcggctgcccgccccacttcacctccaacagcttctccgacgactgggccgggaagatggaccgggccggcctcgggttcagcggctgctccgacggctgcgggggcgcggcctgcgggtgcttcaacgccgcccccagctgcatcttctggcgcaagtgggtggagaacccccacggcatcatctggaaggtgtccccctgcgccgcgtgggtccccagcgccgtgatcgagctgaccatgccgtccggggaggtgcggaccttccaccccatgagcggcatccccacgcaggtcttcaagggcgtgtccgtgacctacctggggagcgacatggaggtctccggcctcaccgacctgtgcgagatcgaggagctcaagagcaagaagctggccctggccccctgcaaccaggccgggatgggcgtggtgggcaaggtcggggagatccagtgcagctccgaggagagcgcgcgcaccatcaagaaggacggctgcatctggaacgccgacctggtggggatcgagctgcgggtggacgacgccgtctgctactccaagatcacgagcgtggaggccgtggccaactactccgcgatcccgaccaccatcggcgggctccgcttcgagcggagctacgactcccagggcaagatcagcggcagccccctggacatcaccgccatccgcgggagcttctccgtcaactaccggggcctgcgcctcagcctgtccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctcgagggcgtccacagctacaccgtgtccctgagcttcgaccacgccgtggtcgacgagcagtgccagctgaactgcgggggccacgagtcccaggtgaccctcaaggggaacctgatcttcctggacgtgcccaagttcgtcgacggcagctacatgcagacgtaccactccaccgtgcccaccggggccaacatcccgagccccaccgactggctcaacgccctgttcggcaacggcctgtcccggtggatcctcggggtgatcggcgtcctgctcgggggcctggcgctgttcttcatgatcatgagcctgttcaagctcggcacgaagcaggtcttccgctcccggaccaagctggcctga

SEQ ID NO: 13265 - RNA, 3222 nt, synthetic construct
  misc_feature 1..3222: note = derived and/or modified CDS sequence (opt1) from SFTSV/FTLSV(YSH39)__KF356529.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcatggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggggaggtcgtggtgagctacggcggcatgcggatccgcccgaagtgctacgggttcagccggatgatggccaccctcgaggtcaaccagcccgagcagcgcatcggccagtgcacggggtgccacctggagtgcatcaacggcggggtgcggctgatcaccctcacctccgagctgaagtccgcgaccgtgtgcgcctcccacttctgcagctccgccacgagcggcaagaagtccaccgagatccagttccacagcggctccctggtcgggaagaccgccatccacgtgaagggcgccctcgtcgacgggaccgagttcacgttcgagggcagctgcatgttccccgacggctgcgacgcggtggactgcaccttctgccgcgagttcctgaagaacccccagtgctacccggccaagaagtggctgttcatcatcatcgtgatcctcctggggcacgccggcctgatgctcctgaccaacgtcctgaaggccatcgggatctggggctcctgggtgatcgcccccgtgaagctcatcttcgcgatcatcaagaagctgatgcggaccgtcagctgcctgatggggaagctcatggaccgcggccgccaggtgatccacgaggagatcggcgagaaccgggaggggaaccaggacgacgtgcggatcgagatggcccgcccccgccgggtccgccactggatgtactcccccgtgatcctgacgatcctggccatcggcctcgccgagagctgcgacgagatggtgcacgccgactccaagctggtcagctgccggcaggggtccggcaacatgaaggagtgcgtgaccaccgggcgcgcgctgctcccggccgtgaaccccggccaggaggcctgcctgcacttcaccgcccccggcagccccgacagcaagtgcctgaagatcaaggtcaagcggatcaacctcaagtgcaagaagtccagctcctacttcgtgccggacgcccgcagccggtgcacgtccgtgcgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtcgagaacccccacggcatcatctggaaggtgtccccctgcgccgcctgggtgcccagcgcggtcatcgagctgaccatgccgtccggggaggtgcggaccttccaccccatgagcggcatccccacccaggtgttcaagggcgtctccgtgacctacctcgggagcgacatggaggtgtccggcctgaccgacctgtgcgagatcgaggagctcaagagcaagaagctggccctggccccctgcaaccaggccgggatgggcgtcgtgggcaaggtgggggagatccagtgcagctccgaggagagcgcccgcaccatcaagaaggacggctgcatctggaacgcggacctggtcgggatcgagctccgggtggacgacgccgtgtgctactccaagatcacgagcgtcgaggccgtggccaactactccgccatcccgaccaccatcggcgggctgcgcttcgagcggagccacgactcccagggcaagatcagcggcagccccctggacatcaccgcgatccgcgggagcttctccgtgaactaccggggcctccgcctgagcctgtccgagatcacggccacgtgcaccggggaggtcaccaacgtgagcggctgctactcctgcatgaccggggccaaggtgagcatcaagctccactccagcaagaactccacggcccacgtccgctgcaagggcgacgagaccgcgttcagcgtgctggagggcgtgcacagctacaccgtctccctgagcttcgaccacgccgtggtggacgagcagtgccagctcaactgcgggggccacgagtcccaggtcaccctgaaggggaacctgatcttcctcgacgtgcccaagttcgtggacggcagctacatgcagacgtaccactccaccgtccccaccggggccaacatcccgagccccaccgactggctgaacgccctgttcggcaacggcctctcccggtggatcctgggggtgatcggcgtgctgctcgggggcctggccctgttcttcatgatcatgagcctcttcaagctgggcacgaagcaggtcttccgctcccggaccaagctggcgtga

SEQ ID NO: 13266 - RNA, 3222 nt, synthetic construct
  misc_feature 1..3222: note = derived and/or modified CDS sequence (opt1) from SFTSV/FTLSV(YSHX002)__KF356540.1__GP
  source 1..3222: mol_type = other RNA
atgatgaaggtgatctggttcagctccctgatctgcctcgtgatccagtgcagcggcgactccgggcccatcatctgcgccggcccgatccacagcaacaagtccgccgggatcccccacctcctgggctacagcgagaagatctgccagatcgaccgcctcatccacgtgtccagctggctgcggaaccactcccagttccaggggtacgtgggccagcgcggcgggcggagccaggtctcctactaccccgcggagaacagctactcccgctggaacggcctgctcagcccctgcgacgccgactggctggggatgctggtggtgaagaaggccaaggagtccgacatgatcgtcccgggccccagctacaaggggaaggtgttcttcgagcggcccaccttcgacggctacgtgggctgggggtgcggctccggcaagagccgcaccgagtccggggagctctgcagcagcgactccggcacgagctccgggctgctgcccagcgaccgggtcctctggatcggcgacgtggcctgccagccgatgacccccatccccgaggagaccttcctggagctgaagtccttcagccagtccgagttccccgacatctgcaagatcgacgggatcgtgttcaaccagtgcgagggcgagagcctcccgcagcccttcgacgtcgcctggatggacgtggggcactcccacaagatcatcatgcgcgagcacaagaccaagtgggtgcaggagagctccagcaaggacttcgtctgctacaaggagggcacgggcccctgctccgagagcgaggagaaggcgtgcaagacctccgggagctgccggggcgacatgcagttctgcaaggtggccgggtgcgagcacggcgaggaggcctccgaggccaagtgccgctgcagcctggtgcacaagcccggggaggtcgtggtgtcctacggcggcatgcgggtccgcccgaagtgctacgggttcagccggatgatggcgaccctggaggtgaacccgcccgagcagcgcatcggccagtgcaccgggtgccacctcgagtgcatcaacggcggggtgcggctgatcacgctgaccagcgagctccgctccgccaccgtctgcgccagccacttctgctccagcgccacctccggcaagaagtccacggagatccacttccactccggcagcctggtggggaagaccgccatccacgtcaagggcgcgctggtggacgggaccgagttcaccttcgagggctcctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctggtgaccaacgtgctcaaggccatcggggtctggggcagctgggtgatcgcgcccgtgaagctgatgttcgccatcatcaagaagctgatgcgcaccgtctcctgcctcgtggggaagctgatggaccggggccgccaggtgatccacgaggagatcggcgagaacggggagggcaaccaggacgacgtccggatcgagatggcccgcccccgccgggtgcgccactggatgtacagcccggtgatcctgaccatcctcgccatcgggctggccgagggctgcgacgagatggtccacgcggactccaagctggtgagctgccggcaggggtccggcaacatgaaggagtgcatcacgaccggccgcgccctcctgcccgccgtgaaccccgggcaggaggcctgcctgcacttcaccgcccccggcagcccggactccaagtgcctcaagatcaaggtcaagcggatcaacctgaagtgcaagaagtccagcagctacttcgtgcccgacgcgcgcagccggtgcacctccgtgcgccggtgccgctgggccggggactgccagagcggctgcccgccccacttcacgtccaacagcttctccgacgactgggccgggaagatggaccgggccggcctgggcttcagcgggtgctccgacggctgcgggggcgcggcctgcgggtgcttcaacgccgcccccagctgcatcttctggcgcaagtgggtcgagaacccccacggcatcatctggaaggtgtccccctgcgccgcgtgggtgccgagcgccgtcatcgagctcaccatgccctccggcgaggtgcggaccttccaccccatgagcgggatccccacccaggtgttcaagggcgtctccgtgacgtacctggggagcgacatggaggtgtccggcctgaccgacctctgcgagatcgaggagctcaagagcaagaagctggccctggccccgtgcaaccaggccggcatgggggtcgtgggcaaggtgggggagaagcagtgctccagcgaggagagcgcgcgcaccatcaagaaggacggctgcatctggaacgccgacctggtcgggatcgagctgcgggtggacgacgccgtgtgctactccaagatcaccagcgtcgaggccgtggccaactactccgcgatccccacgaccatcggcggcctgcgcttcgagcggagccacgactcccaggggaagatcagcggcagccccctcgacatcaccgccatccgcgggagcttctccgtgaactaccggggcctgcgcctgagcctctccgagatcaccgccacgtgcaccggggaggtcaccaacgtgagcggctgctactcctgcatgaccggcgccaaggtgagcatcaagctgcactccagcaagaactccaccgcgcacgtccgctgcaagggggacgagacggccttcagcgtgctggagggcgtgcactcctacatcgtcagcctcagcttcgaccacgccgtggtggacgagcagtgccagctgaactgcgggggccacgagtcccaggtcaccctgaaggggaacctcatcttcctggacgtgcccaagttcgtggacggcagctacatgcagacctaccactccaccgtcccgacgggcgccaacatccccagccccaccgactggctgaacgccctcttcgggaacggcctgtcccggtggatcctgggggtgatcggcgtcctcctgggcgggctggcgctgttcttcctgatcatgttcctgctcaagctgggcaccaagcaggtcttccgcagccggaccaagctggcctga

SEQ ID NO: 13267 - RNA, 3222 nt, synthetic construct
  misc_feature 1..3222: note = derived and/or modified CDS sequence (opt1) from SFTSV/FTLSV(YXX2)__KF356534.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgagccagcccgagcagcgcatcgggcagtgcaccggctgccacctcgagtgcatcaacgggggcgtgcggctgatcaccctgaccagcgagctcaagtccgcgacggtctgcgccagccacttctgctccagcgccacctccggcaagaagtccaccgagatccagttccactccgggagcctggtgggcaagaccgccatccacgtcaagggggccctggtggacggcacggagttcaccttcgagggctcctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggagctgggtcatcgcccccgtgaagctggtgttcgcgatcatcaagaagctcatgcgggccgtctcctgcctgatgggcaagctgatggaccgcggccgccaggtgatccacgaggagatcggggagaaccgggagggcaaccaggacgacgtgcggatcgagatggcccgcccccgccgggtccgccactggatgtacagccccgtgatcctcacgatcctggccatcgggctggccgagggctgcgacgagatggtgcacgcggactccaagctcgtcagctgccggcaggggtccggcaacatgaaggagtgcgtgaccaccggccgcgccctgctgccggccgtgaaccccgggcaggaggcctgcctccacttcaccgcccccggcagccccgactccaagtgcctgaagatcaaggtcaagcggatcaacctgaagtgcaagaagtccagcagctacttcgtgccggacgcgcgcagccggtgcacgtccgtgcgccggtgccgctgggccggggactgccagagcggctgcccgccccacttcacctccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtcgagaacccccacggcatcatctggaaggtgtccccctgcgccgcgtgggtgcccagcgccgtcatcgagctgaccatgccgtccggcgaggtgcggaccttccaccccatgagcgggatccccacccaggtgttcaagggcgtctccgtgacctacctggggagcgacatggaggtgtccggcctcaccgacctgtgcgagatcgaggagctcaagagcaagaagctggccctggccccctgcaaccaggccggcatgggggtcgtgggcaaggtgggggagatccagtgctccagcgaggagagcgcgcgcaccatcaagaaggacggctgcatctggaacgccgacctggtcgggatcgagctgcgggtggacgacgccgtgtgctactccaagatcacgagcgtcgaggccgtggccaactactccgcgatcccgaccaccatcggcggcctccgcttcgagcggagccacgactcccaggggaagatcagcggcagccccctggacatcaccgccatccgcgggagcttctccgtgaactaccggggcctgcgcctcagcctgtccgagatcacggccacgtgcaccggggaggtcaccaacgtgagcggctgctactcctgcatgaccggcgccaaggtgagcatcaagctgcactccagcaagaactccacggcgcacgtccgctgcaagggggacgagaccgccttcagcgtgctcgagggcgtgcactcctacagcgtcagcctgtccttcgactacgccgtggtggacgagcagtgccagctgaactgcgggggccacgagagccaggtcaccctccgggggaacctgatcttcctggacgtgcccaagttcgtggacggctcctacatgcagacctaccacagcacggtccccaccggcgccaacatcccgtcccccaccgactggctcaacgccctgttcgggaacggcctgagccgctggatcctcggggtgatcggcgtcctgctgggcgggctcgcgctgttcttcctgatcatgtccctcttcaagctgggcaccaagcagatcttccggagccgcacgaagctggcctga

SEQ ID NO: 13268 - RNA, 3222 nt, synthetic construct
  misc_feature 1..3222: note = derived and/or modified CDS sequence (opt1) from SFTSV/Huaiyangshan virus(2010-FQM)__HQ419236.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaaggcgtgcaaggccagcggctcctgccgcggggacatgcagttctgcaaggtggccggctgcgagcacggggaggaggccagcgaggcgaagtgccggtgctccctggtgcacaagcccggcgaggtcgtggtgagctacggcgggatgcgggtccgcccgaagtgctacggcttctcccggatgatggccaccctggaggtgagccagcccgagcagcgcatcgggcagtgcaccggctgccacctcgagtgcatcaacgggggcgtgcggctgatcacgctgaccagcgagctcaagtccgccaccgtctgcgccagccacttctgctccagcgccacctccggcaagaagtccacggagatccagttccactccgggagcctggtgggcaagaccgcgatccacgtcaagggggccctggtggacggcaccgagttcaccttcgagggctcctgcatgttccccgacgggtgcgacgccgtggactgcacgttctgccgcgagttcctcaagaacccccagtgctacccggccaagaagtggctgttcatcatcatcgtcatcctgctcggctacgccgggctgatgctgctcaccaacgtgctgaaggcgatcggcgtgtgggggagctgggtcatcgcccccgtgaagctggtgttcgccatcatcaagaagctcatgcgggccgtctcctgcctgatgggcaagctgatggaccgcggccgccaggtgatccacgaggagatcggggagaaccgggagggcaaccaggacgacgtgcggatcgagatggcccgcccccgccgggtccgccactggatgtacagccccgtgatcctcaccatcctggcgatcgggctggccgagggctgcgacgagatggtgcacgccgactccaagctcgtcagctgccggcaggggtccggcaacatgaaggagtgcgtgaccacgggccgcgccctgctgccggccgtgaaccccgggcaggaggcgtgcctccacttcaccgcccccggcagccccgactccaagtgcctgaagatcaaggtcaagcggatcaacctgaagtgcaagaagtccagcagctacttcgtgccggacgcccgcagccggtgcacctccgtgcgccggtgccgctgggccggggactgccagagcggctgcccgccccacttcacctccaacagcttctccgacgactgggcggggaagatggaccgggccggcctcggcttcagcgggtgctccgacggctgcgggggcgccgcctgcgggtgcttcaacgccgcgcccagctgcatcttctggcgcaagtgggtcgagaacccccacggcatcatctggaaggtgtccccctgcgccgcctgggtgcccagcgccgtcatcgagctgacgatgccgtccggcgaggtgcggaccttccaccccatgagcgggatccccacccaggtgttcaagggcgtctccgtgacctacctggggagcgacatggaggtgtccggcctcacggacctgtgcgagatcgaggagctcaagagcaagaagctggccctggcgccctgcaaccaggccggcatgggggtcgtgggcaaggtgggggagatccagtgctccagcgaggagagcgcccgcaccatcaagaaggacggctgcatctggaacgccgacctggtcgggatcgagctgcgggtggacgacgccgtgtgctactccaagatcaccagcgtcgaggcggtggccaactactccgccatcccgaccacgatcggcggcctccgcttcgagcggagccacgactcccaggggaagatcagcggcagccccctggacatcaccgccatccgcgggagcttctccgtgaactaccggggcctgcgcctcagcctgtccgagatcaccgcgacctgcacgggggaggtcaccaacgtgagcggctgctactcctgcatgaccggcgccaaggtgagcatcaagctgcactccagcaagaactccaccgcccacgtccgctgcaagggggacgagaccgccttcagcgtgctcgagggcgtgcactcctacagcgtcagcctgtccttcgaccacgccgtggtggacgagcagtgccagctgaactgcgggggccacgagagccaggtcacgctccgggggaacctgatcttcctggacgtgcccaagttcgtggacggctcctacatgcagacctaccacagcaccgtccccaccggcgcgaacatcccgtcccccacggactggctcaacgccctgttcgggaacggcctgagccgctggatcctcggggtgatcggcgtcctgctgggcgggctcgccctgttcttcctgatcatgttcctcttcaagctgggcaccaagcagatcttccggtcccgcaccaagctggcctga

SEQ ID NO: 13269 - RNA, 3222 nt, synthetic construct
  misc_feature 1..3222: note = derived and/or modified CDS sequence (opt1) from SFTSV/Huaiyangshan virus(2010-LZR)__HQ419237.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgagccagcccgagcagcgcatcgggcagtgcaccggctgccacctcgagtgcatcaacgggggcgtgcggctgatcaccctgaccagcgagctcaagtccgcgacggtctgcgccagccacttctgctccagcgccacctccggcaagaagtccaccgagatccagttccactccgggagcctggtgggcaagaccgccatccacgtcaagggggccctggtggacggcacggagttcaccttcgagggctcctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggagctgggtcatcgcccccgtgaagctggtgttcgcgatcatcaagaagctcatgcgggccgtctcctgcctgatgggcaagctgatggaccgcggccgccaggtgatccacgaggagatcggggagaaccgggagggcaaccaggacgacgtgcggatcgagatggcccgcccccgccgggtccgccactggatgtacagccccgtgatcctcacgatcctggccatcgggctggccgagggctgcgacgagatggtgcacgcggactccaagctcgtcagctgccggcaggggtccggcaacatgaaggagtgcgtgaccaccggccgcgccctgctgccggccgtgaaccccgggcaggaggcctgcctccacttcaccgcccccggcagccccgactccaagtgcctgaagatcaaggtcaagcggatcaacctgaagtgcaagaagtccagcagctacttcgtgccggacgcgcgcagccggtgcacgtccgtgcgccggtgccgctgggccggggactgccagagcggctgcccgccccacttcacctccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtcgagaacccccacggcatcatctggaaggtgtccccctgcgccgcgtggatccccagcgccgtgatcgagctgaccatgccgtccggcgaggtccggaccttccaccccatgagcgggatccccacccaggtgttcaagggcgtgtccgtcacctacctggggagcgacatggaggtgtccggcctcaccgacctgtgcgagatcgaggagctcaagagcaagaagctggccctggccccctgcaaccaggccggcatgggggtggtcggcaaggtgggggagatccagtgctccagcgaggagagcgcgcgcaccatcaagaaggacggctgcatctggaacgccgacctggtggggatcgagctgcgggtcgacgacgccgtgtgctactccaagatcacgagcgtggaggccgtcgccaactactccgcgatcccgaccaccatcggcggcctccgcttcgagcggagccacgactcccaggggaagatcagcggcagccccctggacatcaccgccatccgcgggagcttctccgtgaactaccggggcctgcgcctcagcctgtccgagatcacggccacgtgcaccggggaggtgaccaacgtcagcggctgctactcctgcatgaccggcgccaaggtgagcatcaagctgcactccagcaagaactccacggcgcacgtgcgctgcaagggggacgagaccgccttcagcgtcctcgagggcgtgcactcctacagcgtgagcctgtccttcgaccacgccgtcgtggacgagcagtgccagctgaactgcgggggccacgagagccaggtgaccctccgggggaacctgatcttcctggacgtccccaagttcgtggacggctcctacatgcagacctaccacagcacggtgcccaccggcgccaacatcccgtcccccaccgactggctcaacgccctgttcgggaacggcctgagccgctggatcctcggggtcatcggcgtgctgctgggcgggctcgcgctgttcttcctgatcatgtccctcttcaagctgggcaccaagcagatcttccggagccgcacgaagctggcctga

SEQ ID NO: 13270 - RNA, 3222 nt, synthetic construct
  misc_feature 1..3222: note = derived and/or modified CDS sequence (opt1) from SFTSV/Huaiyangshan virus(2010-T112)__HQ419238.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgtgcagcgcatcggccagtgcacggggtgccacctggagtgcatcaacggcggggtccggctcatcaccctgacctccgagctcaagagcgcgaccgtgtgcgcctcccacttctgcagctccgccacgagcggcaagaagtccaccgagatccagttccacagcggctccctggtcgggaagaccgccatccacgtgaagggcgccctggtggacgggaccgagttcacgttcgagggcagctgcatgttccccgacggctgcgacgcggtcgactgcaccttctgccgcgagttcctgaagaacccccagtgctacccggccaagaagtggctgttcatcatcatcgtgatcctgctggggtacgccggcctcatgctgctgaccaacgtgctcaaggccatcgggatctggggctcctgggtcatcgcccccgtgaagctgatcttcgcgatcatcaagaagctgatgcggaccgtgagctgcctcatggggaagctgatggaccgcggccggcaggtcatccacgaggagatcggcgagaaccgcgaggggaaccaggacgacgtgcggatcgagatggcccgcccccgccgggtgcgccactggatgtacgcccccgtcatcctgacgatcctcgccatgggcctggccgagtcctgcgacgagatggtgcacgcggacagcaagctggtgtcctgccggcaggggagcggcaacatgaaggagtgcgtcaccaccgggcgcgccctcctgccggccgtgaaccccggccaggaggcctgcctgcacttcaccgcccccggctcccccgacagcaagtgcctcaagatcaaggtgaagcggatcaacctgaagtgcaagaagtccagcagctacttcgtcccggacgcgcgctcccggtgcacgagcgtgcgccggtgccgctgggccggggactgccagtccggctgcccgccccacttcaccagcaactccttcagcgacgactgggccgggaagatggaccgggccggcctggggttctccggctgcagcgacggctgcgggggcgcggcctgcgggtgcttcaacgccgccccctcctgcatcttctggcgcaagtgggtggagaacccccacggcatcatctggaaggtcagcccctgcgtggcctgggtgccctccgcggtcatcgagctcaccatgccgagcggggaggtgcggaccttccaccccatgtccggcatccccacccaggtgttcaagggcgtcagcgtgacctacctggggtccgacatggaggtgagcggcctgaccgacctctgcgagatcgaggagctgaagtccaagaagctggccctggccccctgcaaccaggccgggatgggcgtcgtgggcaaggtgggggagatccagtgcagcagcgaggagtccgcccgcaccatcaagaaggacggctgcatctggaacgcggacctcgtcgggatcgagctgcgggtggacgacgccgtgtgctacagcaagatcacgtccgtcgaggccgtggccaactacagcgccatcccgaccaccatcggcgggctgcgcttcgagcggtcccacgacagccagggcaagatctccggcagccccctcgacatcaccgcgatccgcgggtccttcagcgtgaactaccggggcctgcgcctgtccctcagcgagatcacggccacgtgcaccggggaggtcaccaacgtgtccggctgctacagctgcatgaccggggccaaggtgtccatcaagctgcacagctccaagaacagcacggcccacgtccgctgcaagggcgacgagaccgcgttctccgtgctggagggcgtgcacagctacaccgtcagcctctccttcgaccacgccgtggtggacgagcagtgccagctgaactgcgggggccacgagagccaggtcaccctgaaggggaacctcatcttcctggacgtgcccaagttcgtggacggctcctacatgcagacgtaccacagcaccgtccccaccggggccaacatcccgtcccccaccgactggctgaacgccctcttcggcaacggcctgagccggtggatcctgggggtgatcggcgtcctcctcgggggcctggccctgttcttcatgatcatgtccctgttcaagctgggcacgaagcaggtcttccgcagccggaccaagctcgcgtga

SEQ ID NO: 13271 - RNA, 3222 nt, synthetic construct
  misc_feature 1..3222: note = derived and/or modified CDS sequence (opt1) from SFTSV/Huaiyangshan virus(2010-WJ)__HQ419229.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggaagcgcggcggccggagccaggtctcctactacctggcggagaacagctactcccgctggagcgggctgctctccccctgcgacgccgactggctgggcatgctggtggtgaagaaggccaaggggagcgacatgatcgtccccggcccgtcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagcccatgaccccgatccccgaggagaccttcctggagctcaagagcttctcccagagcgagttccccgacatctgcaagatcgacgggatcgtgttcaaccagtgcgagggcgagtccctgccccagccgttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggggaggtcgtggtgagctacggcggcatgcgggtccgccccaagtgctacgggttcagccggatgatggccaccctggaggtgaaccagccggagcagcgcatcggccagtgcacggggtgccacctcgagtgcatcaacggcggggtgcggctgatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgcgagttcctcaagaacccccagtgctaccccgccaagaagtggctgttcatcatcatcgtcatcctgctcgggtacgccggcctgatgctgctcaccaacgtgctgaaggccatcgggatctggggctcctgggtgatcgccccggtcaagctgatcttcgcgatcatcaagaagctcatgcggaccgtgagctgcctgatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctcacgatcctggccatcggcctggccgagagctgcgacgagatggtccacgccgactccaagctcgtgagctgccggcaggggtccggcaacatgaaggagtgcgtgaccaccgggcgcgcgctgctgcccgccgtcaacccgggccaggaggcctgcctccacttcaccgcccccggcagccccgacagcaagtgcctgaagatcaaggtgaagcggatcaacctgaagtgcaagaagtccagctcctacttcgtgcccgacgcccgcagccggtgcacgtccgtccgccggtgccgctgggcgggggactgccagagcggctgcccgccccacttcacccccaactccttcagcgacgactgggccgggaagatggaccgggccggcctcgggttctccggctgcagcgacggctgcgggggcgccgcgtgcgggtgcttcaacgccgccccgtcctgcatcttctggcgcaagtgggtggagaacccccacggcatcatctggaaggtgagcccctgcgccgcctgggtcccctccgcggtgatcgagctgaccatgccgagcggggaggtgcggaccttccaccccatgtccggcatccccacgcaggtcttcaagggcgtgagcgtgacctacctggggtccgacatggaggtcagcggcctcaccgacctgtgcgagatcgaggagctgaagtccaagaagctggccctcgccccctgcaaccaggccgggatgggcgtggtgggcaaggtcggggagatccagtgcagcagcgaggagtccgcccgcaccatcaagaaggacggctgcatctggaacgcggacctggtggggatcgagctgcgggtggacgacgccgtctgctacagcaagatcacgtccgtggaggccgtggccaactacagcgccatcccgaccaccatcggcgggctccgcttcgagcggtcccacgacagccagggcaagatctccggcagccccctggacatcaccgcgatccgcgggtccttcagcgtcaactaccggggcctgcgcctctccctgagcgagatcacggcgacctgcaccggggaggtgaccaacgtgtccggctgctacagctgcatgaccggggccaaggtctccatcaagctgcacagctccaagaacagcacggcccacgtgcgctgcaagggcgacgagaccgccttctccgtgctcgagggcgtccacagctacaccgtgagcctgtccttcgaccacgccgtggtcgacgagcagtgccagctgaactgcgggggccacgagagccaggtgaccctcaaggggaacctgatcttcctggacgtgcccaagttcgtcgacggctcctacatgcagacgtaccacagcaccgtgcccaccggggccaacatcccgtcccccaccgactggctcaacgccctgttcggcaacggcctgagccggtggatcctcggggtgatcggcgtcctgctcgggggcctggccctgttcttcatgatcatgtccctgttcaagctcggcacgaagcaggtcttccgcagccggaccaagctggcgtga

SEQ ID NO: 13272 - RNA, 3222 nt, synthetic construct
  misc_feature 1..3222: note = derived and/or modified CDS sequence (opt1) from SFTSV/Huaiyangshan virus(2010-WJQ)__HQ419230.1__GP
  source 1..3222: mol_type = other RNA
atgatgaaggtgatctggttcagctccctgatctgcctcgtcatccagtgcggcggggacaccggccccatcatctgcgccgggccgacccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccacgttcgacggctacgtggggtggggctgcgggagcggcaagtcccgcaccgagagcggcgagctctgctccagcgacagcgggacctccagcggcctgctgccctccgaccgggtcctctggatcggggacgtggcctgccagccgatgacccccatccccgaggagacgttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagaccaagtgggtgcaggagtccagctccaaggacttcgtctgctacaaggagggcaccgggccctgcagcgagtccgaggagaagacctgcaagacgagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccaccctggaggtgagccagcccgagcagcgcatcgggcagtgcaccggctgccacctcgagtgcatcaacgggggcgtgcggctgatcaccctgacgagcgagctcaagtccgcgaccgtctgcgccagccacttctgctccagcgccacctccggcaagaagtccaccgagatccagttccactccgggagcctggtgggcaagacggccatccacgtcaagggggccctggtggacggcaccgagttcaccttcgagggctcctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcacgaacgtgctgaaggccatcggcgtgtgggggagctgggtcatcgcccccgtgaagctggtgttcgcgatcatcaagaagctcatgcgggccgtctcctgcctgatgggcaagctgatggaccgcggccgccaggtgatccacgaggagatcggggagaaccgggagggcaaccaggacgacgtgcggatcgagatggcccgcccccgccgggtccgccactggatgtacagccccgtgatcctcaccatcctggccatcgggctggccgagggctgcgacgagatggtgcacgcggactccaagctcgtcagctgccggcaggggtccggcaacatgaaggagtgcgtgaccaccggccgcgccctgctgccggccgtgaaccccgggcaggaggcctgcctccacttcacggcccccggcagccccgactccaagtgcctgaagatcaaggtcaagcggatcaacctgaagtgcaagaagtccagcagctacttcgtgccggacgcgcgcagcgggtgcacctccgtgcggcgctgccggtgggccggcgactgccagagcgggtgcccgccccacttcacctccaacagcttctccgacgactgggccggcaagatggaccgcgccggcctcgggttcagcggctgctccgacgggtgcggcggggcggcctgcggctgcttcaacgccgcccccagctgcatcttctggcggaagtgggtcgagaacccccacggcatcatctggaaggtgtccccctgcgccgcgtgggtgcccagcgccgtcatcgagctgaccatgccgtccggggaggtgcgcacgttccaccccatgagcggcatccccacccaggtgttcaagggggtctccgtgacctacctgggcagcgacatggaggtgtccggcctcaccgacctgtgcgagatcgaggagctcaagagcaagaagctggccctggccccctgcaaccaggccgggatgggcgtcgtggggaaggtgggcgagatccagtgctccagcgaggagagcgcgcggacgatcaagaaggacgggtgcatctggaacgccgacctggtcggcatcgagctgcgcgtggacgacgccgtgtgctactccaagatcaccagcgtcgaggccgtggccaactactccgcgatcccgaccaccatcggcgggctccggttcgagcgcagccacgactcccagggcaagatcagcgggagccccctggacatcacggccatccggggcagcttctccgtgaactaccgcgggctgcggctcagcctgtccgagatcaccgcgacctgcaccggcgaggtcaccaacgtgagcggctgctactcctgcatgacgggggccaaggtgagcatcaagctgcactccagcaagaactccaccgcccacgtccgctgcaagggcgacgagaccgccttcagcgtgctcgagggggtgcactcctacagcgtcagcctgtccttcgaccacgccgtggtggacgagcagtgccagctgaactgcggcgggcacgagagccaggtcaccctccgcggcaacctgatcttcctggacgtgcccaagttcgtggacggctcctacatgcagacgtaccacagcaccgtccccaccggggccaacatcccgtcccccaccgactggctcaacgccctgttcggcaacgggctgagccggtggatcctcggcgtgatcggcgtcctgctcgggggcctggcgctgttcttcctgatcatgtccctcttcaagctggggacgaagcagatcttccgcagccggaccaagctggcctga

SEQ ID NO: 13273 - RNA, 3222 nt, synthetic construct
  misc_feature 1..3222: note = derived and/or modified CDS sequence (opt1) from SFTSV/Huaiyangshan virus(2010-WSQ)__HQ419235.1__GP
  source 1..3222: mol_type = other RNA
atgatgaaggtgatctggttcagctccctgatctgcctcgtgatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagcgggcgtgcaagaccagcgggtcctgccgcggcgacatgcagttctgcaaggtggccgggtgcgagcacggcgaggaggccagcgaggccaagtgccggtgctccctggtgcacaagcccggggaggtcgtggtgagctacggcggcatgcgcgtccggccgaagtgctacgggttcagccgcatgatggcgaccctggaggtgaacccgcccgagcagcggatcggccagtgcaccgggtgccacctcgagtgcatcaacggcggggtgcgcctgatcacgctgacctccgagctccggagcgccaccgtctgcgcctcccacttctgcagctccgccaccagcggcaagaagtccacggagatccacttccacagcggctccctgatcgggaagaccgccatccacgtgaagggcgcgctggtcgacgggaccgagttcaccttcgagggcagctgcatgttccccgacggctgcgacgccgtggactgcacgttctgccgcgagttcctcaagaacccccagtgctaccccgccaagaagtggctgttcatcatcatcgtgatcctgctcgggtacgccggcctgatgctgctcaccaacgtcctgaaggccatcggggtgtggggctcctgggtgatcgcgcccgtcaagctgatgttcgccatcatcaagaagctcatgcggaccgtgagctgcctggtggggaagctgatggaccgcggccggcaggtcatccacgaggagatcggcgagaacggggagggcaaccaggacgacgtgcgcatcgagatggcccgcccccggcgcgtgcggcactggatgtactccccggtcatcctcaccatcctggccatcgggctggccgaggactgcgacgagatggtgcacgcggacagcaagctcgtgtcctgccgccagggcagcgggaacatgaaggagtgcatcacgaccggccgggccctgctgcccgccgtcaaccccggccaggaggcctgcctccacttcaccgcccccgggtccccggacagcaagtgcctgaagatcaaggtgaagcgcatcaacctgaagtgcaagaagtccagcagctacttcgtgcccgacgcgcggtcccgctgcaccagcgtccggcgctgccggtgggccggcgactgccagtccgggtgcccgccccacttcacgagcaactccttcagcgacgactgggccggcaagatggaccgcgccgggctcggcttctccggctgcagcgacgggtgcggcggggcggcctgcggctgcttcaacgccgccccctcctgcatcttctggcggaagtgggtggagaacccccacgggatcatctggaaggtgagcccctgcgccgcgtgggtcccgtccgccgtgatcgagctgaccatgcccagcggcgaggtgcgcaccttccaccccatgtccggcatccccacccaggtcttcaagggggtgagcgtgacgtacctgggctccgacatggaggtcagcgggctcaccgacctgtgcgagatcgaggagctgaagtccaagaagctggccctcgccccgtgcaaccaggccggcatgggcgtggtggggaaggtcggcgagatccagtgcagcagcgaggagtccgcgcggaccatcaagaaggacgggtgcatctggaacgccgacctggtgggcatcgagctgcgcgtggacgacgccgtctgctacagcaagatcacctccgtggaggccgtggccaactacagcgcgatccccacgaccatcgggggcctccggttcgagaagtcccacgacagccagggcaagatctccgggagccccctggacatcaccgccatccgcggctccttcagcgtcaactaccgggggctgcgcctctccctgagcgagatcaccgccacgtgcaccggcgaggtgaccaacgtgtccgggtgctacagctgcatgaccggcgccaaggtctccatcaagctgcacagctccaagaacagcaccgcgcacgtgcgctgcaagggcgacgagacggccttctccgtgctcgagggggtccacagctacatcgtgagcctgtccttcgaccacgccgtggtcgacgagcagtgccagctgaactgcggcgggcacgagagccaggtgaccctcaagggcaacctgatcttcctggacgtgcccaagttcgtcgacgggtcctacatgcagacctaccacagcaccgtgccgacgggcgccaacatcccctcccccaccgactggctcaacgccctgttcggcaacgggctgagccggtggatcctcggcgtgatcggggtcctgctgggcggcctcgcgctgttcttcctgatcatgttcctcctgaagctggggaccaagcaggtcttccgctcccggaccaagctcgcctga

SEQ ID NO: 13274 - RNA, 3222 nt, synthetic construct
  misc_feature 1..3222: note = derived and/or modified CDS sequence (opt1) from SFTSV/Huaiyangshan virus(2010-WWG)__HQ419231.1__GP
  source 1..3222: mol_type = other RNA
atgatgaaggtgatctggttcagcaccctgatctgcttcgtgatccagtgctccggcgacagcgggcccatcatctgcgccggcccgatccactccaacaagagcgccgacatcccccacctcctggggtactccgagaagatctgccagatcgaccgcctgatccacgtgagctcctggctccggaaccacagccagttccagggctacgtggggcagcgcggcggccggtcccaggtcagctactaccccgcggagaactcctacagccgctggtccgggctgctgagcccctgcgacgccgactggctcggcatgctggtggtgaagaaggccaaggggtccgacatgatcgtcccgggccccagctacaaggggaaggtgttcttcgagcggcccaccttcgacggctacgtgggctgggggtgcggctccggcaagagccgcacggagtccggggagctgtgcagcagcgactccggcaccagctccgggctcctgcccagcgaccgggtcctgtggatcggcgacgtggcctgccagccgatgacccccatccccgaggagaccttcctcgagctgaagtccttcagccagtccgagttccccgacatctgcaagatcgacgggatcgtgttcaaccagtgcgagggcgagagcctgccgcagcccttcgacgtcgcctggatggacgtggggcactcccacaagatcatcatgcgcgagcacaagacgaagtgggtgcaggagagctccagcaaggacttcgtctgctacaaggagggcaccggcccctgctccgagagcgaggagaagacctgcaagacctccgggagctgccggggcgacatgcagttctgcaaggtggcggggtgcgagcacggcgaggaggcctccgaggccaagtgccgctgcagcctcgtgcacaagcccggggaggtcgtggtgtcctacggcggcatgcgggtccgcccgaagtgctacgggttcccccggatgatggccacgctggaggtgaaccagcccgagcagcgcatcggccagtgcaccgggtgccacctggagtgcatcaacggcggggtgcggctcatcaccctgaccagcgagctgcgcagcgcgacggtctgcgcctcccacttctgcagctccgccaccagcggcaagaagtccaccgagatccagttccacagcggctccctcgtggggaagaccgccatccacgtcaagggcgccctggtggacgggacggagttcaccttcgagggcagctgcatgttccccgacggctgcgacgcggtggactgcaccttctgccgggagttcctgaagaacccgcagtgctaccccgccaagaagtggctcctgatcatcatcgtcatcctgctcgggtacgccggcctgatgctgctcaccaacgtgctgaaggccatcgggatctggggctcctgggtgatcgcccccgtcaagctgatcttcgcgatcatcaagaagctcatgcgcgccgtgagctgcctgatggggaagctgatggaccggggccgccaggtgatccacgagggcatcggggagaaccgggagggcaaccaggacgacgtccgcatcgagatggcccgcccccggcgcgtgcggcactggatgtactccccggtgatcctcacgatcctggccatcgggctggccgagagctgcgacgagatggtccacgcggactccaagctcgtgagctgccgccagggctccgggaacatgaaggagtgcgtgaccaccggccgggccctgctgcccgccgtcaaccccggccaggaggcctgcctccacttcaccgcccccgggagcccggactccaagtgcctgaagatcaaggtgaagcgcatcaacctgaagtgcaagaagtccagctcctacttcgtgcccgacgcgcggagccgctgcacgtccgtccggcgctgccggtgggccggcgactgccagagcgggtgcccgccccacttcacctccaacagcttctccgacgactgggccggcaagatggaccgcgccgggctcggcttcagcggctgctccgacgggtgcggcggggcggcctgcggctgcttcaacgccgcccccagctgcatcttctggcggaagtgggtggagaacccccacgggatcatctggaaggtgtccccctgcgccgcgtgggtcccgagcgccgtgatcgagctgaccatgccctccggcgaggtgcgcaccttccaccccatgagcggcatccccacgcaggtcttcaagggggtgtccgtgacctacctgggcagcgacatggaggtctccgggctcaccgacctgtgcgagatcgaggagctcaagagcaagaagctggccctggccccgtgcaaccaggccggcatgggcgtggtggggaaggtcggcgagatccagtgctccagcgaggagagcgcgcggaccatcaagaaggacgggtgcatctggaacgccgacctggtgggcatcgagctgcgcgtggacgacgccgtctgctactccaagatcacgagcgtggaggccgtggccaactactccgcgatccccaccaccatcgggggcctccggttcgagcgcagccacgactcccagggcaagatcagcgggagccccctggacatcaccgccatccggggcagcttctccgtcaactaccgcgggctgcgcctcagcctgtccgagatcacggcgacctgcaccggcgaggtgaccaacgtgagcgggtgctactcctgcatgaccggcgccaaggtcagcatcaagctgcactccagcaagaactccacggcccacgtgcggtgcaagggcgacgagaccgccttcagcgtgctcgagggggtccactcctacaccgtgagcctgagcttcgaccacgccgtggtcgacgagcagtgccagctgaactgcggcgggcacgagtcccaggtgaccctcaagggcaacctgatcttcctggacgtgcccaagttcgtcgacgggagctacatgcagacgtaccactccaccgtgccgaccggcgccaacatccccagccccaccgactggctcaacgccctgttcggcaacgggctgtcccgctggatcctcggcgtgatcggggtcctgctgggcggcctcgcgctgttcttcatgatcatgagcctgttcaagctcgggacgaagcaggtcttccggtcccgcaccaagctggcctga

SEQ ID NO: 13275 - RNA, 3222 nt, synthetic construct
  misc_feature 1..3222: note = derived and/or modified CDS sequence (opt1) from SFTSV/Huaiyangshan virus(2010-WWX)__HQ419232.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgcctgctcgagtgcatcaacggcggggtgcggctgatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctgatcgacgggaccgagttcacgttcgagggcagctgcatgttccccgacggctgcgacgcggtggactgcaccttctgccgcgagttcctcaagaacccccagtgctacccggccaagaagtggctgttcatcatcatcgtgatcctgctcgggtacgccggcctgatgctgctcaccaacgtcctgaaggccatcgggatctggggctcctgggtgatcgcccccgtgaagctgatcttcgcgatcatcaagaagctcatgcggaccgtcagctgcctgatggggaagctgatggaccgcggccgccaggtgatccacgaggagatcggcgagaaccgggaggggaaccaggacgacgtgcggatcgagatggcccgcccccgccgggtccgccactggatgtactcccccgtgatcctcacgatcctggccatcggcctggccgagagctgcgacgagatggtgcacgccgactccaagctcgtcagctgccggcaggggtccggcaacatgaaggagtgcgtgaccaccgggcgcgcgctgctgccggccgtgaaccccggccaggaggcctgcctccacttcaccgcccccggcagccccgacagcaagtgcctgaagatcaaggtcaagcggatcaacctgaagtgcaagaagtccagctcctacttcgtgccggacgcccgcagccggtgcacgtccgtgcgccggtgccgctgggcgggggactgccagagcggctgcccgccccacttcacctccaacagcttctccgacgactgggccgggaagatggaccgggccggcctcgggttcagcggctgctccgacggctgcgggggcgccgcgtgcgggtgcttcaacgccgcccccagctgcatcttctggcgcaagtgggtcgagaacccccacggcatcatctggaaggtgtccccctgcgccgcctgggtgcccagcgcggtcatcgagctgaccatgccgtccggggaggtgcggaccttccaccccatgagcggcatccccacccaggtgttcaagggcgtctccgtgacctacctggggagcgacatggaggtgtccggcctcaccgacctgtgcgagatcgaggagctcaagagcaagaagctggccctggccccctgcaaccaggccgggatgggcgtcgtgggcaaggtgggggagatccagtgcagctccgaggagagcgcccgcaccatcaagaaggacggctgcatctggaacgcggacctggtcgggatcgagctgcgggtggacgacgccgtgtgctactccaagatcacgagcgtcgaggccgtggccaactactccgccatcccgaccaccatcggcgggctccgcttcgagcggagccacgactcccagggcaagatcagcggcagccccctggacatcaccgcgatccgcgggagcttctccgtgaactaccggggcctgcgcctcagcctgtccgagatcacggccacgtgcaccggggaggtcaccaacgtgagcggctgctactcctgcatgaccggggccaaggtgagcatcaagctgcactccagcaagaactccacggcccacgtccgctgcaagggcgacgagaccgcgttcagcgtgctcgagggcgtgcacagctacaccgtctccctgagcttcgaccacgccgtggtggacgagcagtgccagctgaactgcgggggccacgagtcccaggtcaccctcaaggggaacctgatcttcctggacgtgcccaagttcgtggacggcagctacatgcagacgtaccactccaccgtccccaccggggccaacatcccgagccccaccgactggctcaacgccctgttcggcaacggcctgtcccggtggatcctcggggtgatcggcgtgctgctcgggggcctggccctgttcttcatgatcatgagcctgttcaagctcggcacgaagcaggtcttccgctcccggaccaagctggcgtga

SEQ ID NO: 13276 - RNA, 3222 nt, synthetic construct
  misc_feature 1..3222: note = derived and/or modified CDS sequence (opt1) from SFTSV/Huaiyangshan virus(2010-ZGQ)__HQ419233.1__GP
  source 1..3222: mol_type = other RNA
atgatgaaggtgatctggttcagctccctgatctgcctcgtcatccagtgcggcggggacaccggccccatcatctgcgccgggccgacccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccacgttcgacggctacgtggggtggggctgcgggagcggcaagtcccgcaccgagagcggcgagctctgctccagcgacagcgggacctccagcggcctgctgccctccgaccgggtcctctggatcggggacgtggcctgccagccgatgacccccatccccgaggagacgttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagaccaagtgggtgcaggagtccagctccaaggacttcgtctgctacaaggagggcaccgggccctgcagcgagtccgaggagaagacctgcaagacgagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccaccctggaggtgagccagcccgagcagcgcatcgggcagtgcaccggctgccacctcgagtgcatcaacgggggcgtgcggctgatcaccctgacgagcgagctcaagtccgcgaccgtctgcgccagccacttctgctccagcgccacctccggcaagaagtccaccgagatccagttccactccgggagcctggtgggcaagacggccatccacgtcaagggggccctggtggacggcaccgagttcaccttcgagggctcctgcatgttccccgacgggtgcgacgcggtggactgcaccttctgccgcgagttcctcaagaacccccagtgctacccggccaagaagtggctgttcatcatcgtcgtgatcctgctcggctacgccgggctgatgctgctcacgaacgtgctgaaggccatcggcgtctgggggagctgggtgatcgcccccgtgaagctggtcttcgcgatcatcaagaagctcatgcgggccgtgtcctgcctgatgggcaagctgatggaccgcggccgccaggtgatccacgaggagatcggggagaaccgggagggcaaccaggacgacgtccggatcgagatggcccgcccccgccgggtgcgccactggatgtacagccccgtgatcctcaccatcctggccatcgggctggccgagggctgcgacgagatggtccacgcggactccaagctcgtgagctgccggcaggggtccggcaacatgaaggagtgcgtgaccaccggccgcgccctgctgccggccgtcaaccccgggcaggaggcctgcctccacttcacggcccccggcagccccgactccaagtgcctgaagatcaaggtgaagcggatcaacctgaagtgcaagaagtccagcagctacttcgtgccggacgcgcgcagccggtgcacctccgtccgccggtgccgctgggccggggactgccagagcggctgcccgccccacttcacctccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtggagaacccccacggcatcatctggaaggtgtccccctgcgccgcgtgggtccccagcgccgtgatcgagctgaccatgccgtccggcgaggtgcggacgttccaccccatgagcgggatccccacccaggtcttcaagggcgtgtccgtgacctacctggggagcgacatggaggtctccggcctcaccgacctgtgcgagatcgaggagctcaagagcaagaagctggccctggccccctgcaaccaggccggcatgggggtggtgggcaaggtcggggagatccagtgctccagcgaggagagcgcgcgcacgatcaagaaggacggctgcatctggaacgccgacctggtggggatcgagctgcgggtggacgacgccgtctgctactccaagatcaccagcgtggaggccgtggccaactactccgcgatcccgaccaccatcggcggcctccgcttcgagcggagccacgactcccaggggaagatcagcggcagccccctggacatcacggccatccgcgggagcttctccgtcaactaccggggcctgcgcctcagcctgtccgagatcaccgcgacctgcaccggggaggtgaccaacgtgagcggctgctactcctgcatgacgggcgccaaggtcagcatcaagctgcactccagcaagaactccaccgcccacgtgcgctgcaagggggacgagaccgccttcagcgtgctcgagggcgtccactcctacagcgtgagcctgtccttcgaccacgccgtggtcgacgagcagtgccagctgaactgcgggggccacgagagccaggtgaccctccgggggaacctgatcttcctggacgtgcccaagttcgtcgacggctcctacatgcagacgtaccacagcaccgtgcccaccggcgccaacatcccgtcccccaccgactggctcaacgccctgttcgggaacggcctgagccgctggatcctcggggtcatcggcgtgctgctgggcgggctcgcgctgttcttcctgatcatgtccctcttcaagctgggcacgaagcagatcttccggagccgcaccaagctggcctga

SEQ ID NO: 13277 - RNA, 3222 nt, synthetic construct
  misc_feature 1..3222: note = derived and/or modified CDS sequence (opt1) from SFTSV/Huaiyangshan virus(M-HZM)__JF951393.1__GP
  source 1..3222: mol_type = other RNA
atgatgaaggtgatctggttcagctccctgacctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcacggagagcggcgagctctgcagctccgacagcggcacctccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagacgaagtgggtgcaggagtccagctccaaggacttcgtctgctacaaggagggcaccggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcatgcgggtccgcccgaagtgctacgggttcagccggatgatggcgaccctggaggtgaacccgcccgagcagcgcatcggccagtgcacggggtgccacctcgagtgcatcaacggcggggtgcggctgatcaccctgacctccgagctccgcagcgccaccgtctgcgcctcccacttctgcagctccgccacgagcggcaagaagaacaccgagatccacttccactccggcagcctggtggggaagaccgccatccacgtcaagggcgcgctggtggacgggaccgagttcacgttcgagggctcctgcatgttccccgacggctgcgacgccgtggactgcaccttctgccgggagttcctcaagaacccccagtgctaccccgccaagaagtggctgttcatcatcatcgtcatcctgctcgggtacgccggcctgatgctgctcaccaacgtgctgaaggccatcggggtgtggggcagctgggtcatcgcgcccgtgaagctgatgttcgccatcatcaagaagctcatgcgcaccgtgtcctgcctggtcgggaagctgatggaccggggccgccaggtgatccacgaggagatcggcgagaacggggagggcaaccaggacgacgtgcggatcgagatggcccgcccccgccgggtccgccactggatgtacagcccggtgatcctcacgatcctggccatcgggctggccgagggctgcgacgagatggtgcacgcggactccaagctcgtcagctgccggcaggggtccggcaacatgaaggagtgcatcaccaccggccgcgccctgctgcccgccgtgaaccccgggcaggaggcctgcctccacttcaccgcccccggcagcccggactccaagtgcctgaagatcaaggtgaagcggatcaacctgaagtgcaagaagtccagctcctacttcgtccccgacgcgcgcagccggtgcacgtccgtgcgccggtgccgctgggccggggactgccagagcggctgcccgccccacttcacctccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtggagaacccccacggcatcatctggaaggtctccccctgcgccgcgtgggtgccgagcgccgtgatcgagctgaccatgccctccggcgaggtccggaccttccaccccatgagcgggatccccacccaggtgttcaagggcgtgtccgtcacctacctggggagcgacatggaggtgtccggcctcaccgacctgtgcgagatcgaggagctcaagagcaagaagctggccctggccccgtgcaaccaggccggcatgggggtggtcggcaaggtgggggagatccagtgctccagcgaggagagcgcgcgcaccatcaagaaggacggctgcatctggaacgccgacctggtggggatcgagctgcgggtcgacgacgccgtgtgctactccaagatcacgagcgtggaggccgtcgccaactactccgcgatccccaccaccatcggcggcctccgcttcgagcggagccacgactcccaggggaagatcagcggcagccccctggacatcaccgccatccgcgggagcttctccgtgaacctgcggggcctccgcctgagcctgtccgagatcacggccacgtgcaccggggaggtgaccaacgtcagcggctgctactcctgcatgaccggcgccaaggtgagcatcaagctccactccagcaagaactccacggcgcacgtgcgctgcaagggggacgagaccgccttcagcgtcctggagggcgtgcactcctacatcgtgagcctgagcttcgaccacgccgtcgtggacgagcagtgccagctcaactgcgggggccacgagtcccaggtgaccctgaaggggaacctgatcttcctcgacgtccccaagttcgtggacggcagctacatgcagacctaccactccacggtgccgaccggcgccaacatccccagccccaccgactggctgaacgccctgttcgggaacggcctctcccggtggatcctgggggtcatcggcgtgctgctcggcgggctggcgctgttcttcctcatcatgttcctgctgaagctcggcaccaagcaggtcttccgcagccggacgaagctggcctga

SEQ ID NO: 13278 - RNA, 3222 nt, synthetic construct
  misc_feature 1..3222: note = derived and/or modified CDS sequence (opt1) from SFTSV/Phlebovirus(AH15/China/2010 strain AH15)__HQ141593.1__GP
  source 1..3222: mol_type = other RNA
atgatgaaggtgatctggttcttcagcctgatctgcctcgtcatccagtgcggcggggacaccggccccatcatctgcgccgggccgatccactccaacaagagcgccgacatcccccacctcctgggctactccgagaagatctgccagatcgaccgcctgatccacgtgagctcctggctgcggaaccacagccagttccaggggtacgtgggccagcgcggcgggcggtcccaggtcagctactaccccgcggagaactcctacagccgctggtccggcctgctcagcccctgcgacgccgactggctggggatgctggtggtgaagaaggccaagggctccgacatgatcgtcccggggcccagctacaagggcaaggtgttcttcgagcggcccaccttcgacggctacgtggggtggggctgcgggtccggcaagagccgcacggagtccggcgagctctgcagctccgacagcgggaccagctccggcctgctgcccagcgaccgggtcctctggatcggggacgtggcctgccagccgatgacccccatccccgaggagaccttcctggagctgaagtccttcagccagtccgagttccccgacatctgcaagatcgacggcatcgtgttcaaccagtgcgagggggagagcctcccgcagcccttcgacgtcgcctggatgggcgtgggccactcccacaagatcatcatgcgcgagcacaagacgaagtgggtgcaggagagctccagcaaggacttcgtctgctacaaggaggggaccggcccctgctccgagagcgaggagaagacctgcaagacctccgggagctgccggggcgacatgcagttctgcaaggtggcggggtgcgagcacggcgaggaggcctccgaggccaagtgccgctgcagcctggtgcacaagcccggcgaggtcgtggtgtcctacgggggcatgcgggtccgcccgaagtgctacgggttcagccggatgatggccacgctggaggtgaacgagcccgagcagcgcatcggccagtgcaccgggtgccacctcgagtgcatcaacggcggcgtgcggctgatcaccctgacctccgagctcaagagcgcgacggtctgcgccagccacttctgctccagcgccacctccgggaagaagtccaccgagatccagttccactccggcagcctggtggggaagaccgccatccacgtcaagggcgccctggtggacggcacggagttcaccttcgaggggtcctgcatgttccccgacggctgcgacgcggtggactgcaccttctgccgcgagttcctcaagaacccccagtgctacccggccaagaagtggctgttcatcatcatcgtcatcctgctcgggtacgccggcctgatgctgctcaccaacgtgctgaaggccatcggggtgtggggcagctgggtcatcgcccccgtgaagctggtgttcgcgatcatcaagaagctcatgcgggccgtctcctgcctgatgggcaagctgatggaccgcgggcgccaggtgatccacgaggagatcggcgagaaccgggaggggaaccaggacgacgtgcggatcgagatggcccgcccccgccgggtccgccactggatgtacagccccgtgatcctcacgatcctggccatgggcctggccgaggggtgcgacgagatggtgcacgcggactccaagctcgtcagctgccggcagggctccggcaacatgaaggagtgcgtgaccaccgggcgcgccctgctgccggccgtgaaccccggccaggaggcctgcctccacttcaccgcccccgggagccccgactccaagtgcctgaagatcaaggtcaagcggatcaacctgaagtgcaagaagtccagcagctacttcgtgccggacgcgcgcagccggtgcacgtccgtgcgccggtgccgctgggccggcgactgccagagcgggtgcccgccccacttcacctccaacagcttctccgacgactgggccggcaagatggaccgggccggcctcgggttcagcggctgctccgacgggtgcggcggggcggcctgcggctgcttcaacgccgcccccagctgcatcttctggcgcaagtgggtcgagaacccccacggcatcatctggaaggtgtccccctgcgccgcgtgggtgcccagcgccgtcatcgagctgaccatgccgtccggggaggtgcggaccttccaccccatgagcggcatccccacccaggtgttcaagggggtctccgtgacctacctgggcagcgacatggaggtgtccggcctcaccgacctgtgcgagatcgaggagctcaagagcaagaagctggccctggccccctgcaaccaggccgggatgggcgtcgtggggaaggtgggcgagatccagtgctccagcgaggagtccgcgcgcaccatcaagaaggacgggtgcatctggaacgccgacctggtcggcatcgagctgcgggtggacgacgccgtgtgctacagcaagatcacgagcgtcgaggccgtggccaactactccgcgatcccgaccaccatcggcgggctccgcttcgagcggagccacgactcccagggcaagatcagcgggagccccctggacatcaccgccatccgcggcagcttctccatcaactaccgggggctgcgcctcagcctgacggagatcaccgccacgtgcaccggcgaggtgaccaacgtctccggctgctacagctgcatgacgggggccaaggtgtccatcaagctgcacagctccaagaacagcaccgcgcacgtgcgctgcaagggcgacgagaccgccttctccgtcctcgagggggtgcacagctactccgtgagcctgtccttcgaccacgccgtcgtggacgagcagtgccagctgaactgcggcgggcacgagagccaggtgaccctccggggcaacctgatcttcctggacgtccccaagttcgtggacggcagctacatgcagacgtaccactccaccgtgcccaccggggccaacatcccgagccccaccgactggctcaacgccctgttcggcaacgggctgtcccgctggatcctcggcgtcatcggcgtgctgctcgggggcctggcgctgttcttcctgatcatgagcctcttcaagctggggacgaagcaggtcttccggtcccgcaccaagctggcctga

SEQ ID NO: 13279 - RNA, 3222 nt, synthetic construct
  misc_feature 1..3222: note = derived and/or modified CDS sequence (opt1) from SFTSV/Phlebovirus(HN6/China/2010 strain HN6)__HQ141596.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatcttcgcgatcatcaagaagctgatgcggaccgtgagctgcctcgtggggaagctgatggaccgcggccggcaggtcatccacgaggagatcggcgagaaccgcgaggggaaccaggacgacgtgcggatcgagatggcccgcccccgccgggtgcgccactggatgtactcccccgtcatcctgacgatcctcgccatcggcctggccgagagctgcgacgagatggtgcacgccgactccaagctggtgagctgccggcaggggtccggcaacatgaaggagtgcgtcaccaccgggcgcgcgctcctgccggccgtgaaccccggccaggaggcctgcctgcacttcaccgcccccggcagccccgacagcaagtgcctcaagatcaaggtgaagcggatcaacctgaagtgcaagaagtccagctcctacttcgtcccggacgcccgcagccggtgcacgtccgtgcgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtctccccctgcgccgcctgggtgcccagcgcggtgatcgagctcaccatgccgtccggggagatgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccggggcctgcgcctgagcctctccgagatcacggcgacctgcaccggggaggtgaccaacgtgagcggctgctactcctgcatgaccggggccacggtcagcatcaagctgcactccagcaagaactccaccgcccacgtgcgctgcaagggcgacgagaccgccttcagcgtgctggagggcgtccacagctacaccgtgtccctcagcttcgaccacgccgtggtcgacgagcagtgccagctgaactgcgggggccacgagtcccaggtgacgctgaaggggaacctcatcttcctggacgtgcccaagttcgtcgacggcagctacatgcagacctaccactccaccgtgcccaccggggccaacatcccgagccccacggactggctgaacgccctcttcggcaacggcctgtcccggtggatcctgggggtgatcggcgtcctcctcgggggcctggccctgttcttcatgatcatgagcctgttcaagctgggcaccaagcaggtcttccgctcccggaccaagctcgcgtga

SEQ ID NO: 13280 - RNA, 3222 nt, synthetic construct
  misc_feature 1..3222: note = derived and/or modified CDS sequence (opt1) from SFTSV/Phlebovirus(JN1/China/2010)__JN258706.1__GP
  source 1..3222: mol_type = other RNA
atgatgaaggtgatctggttcagctccctgatctgcctcgtgatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccaacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcatgcgggtccgcccgaagtgctacgggttcagccggatgatggcgaccctggaggtgaacccgcccgagcagcgcatcggccagtgcaccgggtgccacctcgagtgcatcaacggcggggtgcggctggtcacgctgacctccgagctccgcagcgccaccgtgtgcgcctcccacttctgcagctccgccaccagcggcaagaagtccacggagatccacttccacagcggctccctggtcgggaagaccgccatccacgtgaagggcgcgctggtggacgggaccgagttcaccttcgagggcagctgcatgttccccgacggctgcgacgccgtcgactgcacgttctgccgggagttcctcaagaacccccagtgctaccccgccaagaagtggctgttcatcatcatcgtgatcctgctcgggtacgccggcctgatgctgctcaccaacgtgctgaaggccatcggggtctggggctcctgggtgatcgcgcccgtgaagctgatgttcgccatcatcaagaagctcatgcgcaccgtcagctgcctggtggggaagctgatggaccggggccgccaggtgatccacgaggagatcggcgagaacggggagggcaaccaggacgacgtccggatcgagatggcccgcccccgccgggtgcgccactggatgtactccccggtgatcctcaccatcctggccatcgggctggccgagggctgcgacgagatggtccacgcggacagcaagctcgtgtcctgccggcaggggagcggcaacatgaaggagtgcatcacgaccggccgcgccctgctgcccgccgtgaaccccgggcaggaggcctgcctccacttcaccgcccccggctccccggacagcaagtgcctgaagatcaaggtcaagcggatcaacctgaagtgcaagaagtccagcagctacttcgtgcccgacgcgcgctcccggtgcaccagcgtgcgccggtgccgctgggccggggactgccagtccggctgcccgccccacttcacgagcaactccttcagcgacgactgggccgggaagatggaccgggccggcctcggcttctccgggtgcagcgacggctgcgggggcgcggcctgcgggtgcttcaacgccgccccctcctgcatcttctggcgcaagtgggtcgagaacccccacggcatcatctggaaggtgagcccctgcgccgcgtgggtgccgtccgccgtcatcgagctgaccatgcccagcggcgaggtgcggaccttccaccccatgtccgggatccccacccaggtgttcaagggcgtcagcgtgacgtacctggggtccgacatggaggtgagcggcctcaccgacctgtgcgagatcgaggagctgaagtccaagaagctggccctcgccccgtgcaaccaggccggcatgggggtcgtgggcaaggtgggggagatccagtgcagcagcgaggagtccgcgcgcaccatcaagaaggacggctgcatctggaacgccgacctggtcgggatcgagctgcgggtggacgacgccgtgtgctacagcaagatcacctccgtcgaggccgtggccaactacagcgcgatccccacgaccatcggcggcctccgcttcgagcggtcccacgacagccaggggaagatctccggcagccccctggacatcaccgccatccgcgggtccttcagcgtgaactaccggggcctgcgcctctccctgagcgagatcaccgccacgtgcaccggggaggtcaccaacgtgtccggctgctacagctgcatgaccggcgccaaggtgtccatcaagctgcacagctccaagaacagcaccgcgcacgtccgctgcaagggggacgagacggccttctccgtgctcaagggcgtgcacagctacatcgtcagcctgtccttcgaccacgccgtggtggacgagcagtgccagctgaactgcgggggccacgagagccaggtcaccctcaaggggaacctgatcttcctggacgtgcccatcttcgtggacggctcctacatgcagacctaccacagcaccgtcccgacgggcgccaacatcccctcccccaccgactggctcaacgccctgttcgggaacggcctgagccggtggatcctcggggtgatcggcgtcctgctgggcgggctcgcgctgttcttcctgatcatgttcctcctgaagctgggcaccaagcaggtcttccgctcccggaccaagctcgcctga

SEQ ID NO: 13281 - RNA, 3222 nt, synthetic construct
  misc_feature 1..3222: note = derived and/or modified CDS sequence (opt1) from SFTSV/Phlebovirus(JS2010-014)__JQ317170.1__GP
  source 1..3222: mol_type = other RNA
atgatgaaggtgatctggttcagctacctgatctgcttcgtgatccagtgctccggcgacagcgggcccatcatctgggccggcccgatccactccaacaagagcgccgacatcccccacctcctggggtactccgagaagatctgccagatcgaccgcctgatccacgtgagctcctggctccggaaccacagccagttccagggctacgtggggcagcgcggcggccggtcccaggtcagctactaccccgcggagaactcctacagccgctggtccgggctgctgagcccctgcgacgccgactggctcggcatgctggtggtgaagaaggccaaggggtccgacatgatcgtcccgggccccagctacaaggggaaggtgttcttcgagcggcccaccttcgacggctacgtgggctgggggtgcggctccgggaagtcccgcaccgagtccggcgagctgtgcagcagcgactccggcacgagctccgggctcctgcccagcgaccgggtcctgtggatcggcgacgtggcctgccagccgatgacccccatccccgaggagaccttcctcgagctgaagtccttcagccagtccgagttccccgacatctgcaagatcgacgggatcgtgttcaaccagtgcgagggcgagagcctgccgcagcccttcgacgtcgcctggatggacgtggggcactcccacaagatcatcatgcgcgagcacaagaccaagtgggtgcaggagagctccagcaaggacttcgtctgctacaaggagggcacgggcccctgctccgagagcgaggagaagacctgcaagacctccgggagctgccggggcgacatgcagttctgcaaggtggcggggtgcgagcacggcgaggaggcctccgaggccaagtgccgctgcagcctcgtgcacaagcccggggaggtcgtggtgtcctacggcggcatgcggatccgcccgaagtgctacgggttcagccggatgatggccaccctggaggtcagccagcccgagcagcgcctgggccagtgcacggggtgccacctcgagtgcatcaacggcggggtgcggctgatcaccctgacctccgagctcaagagcgcgaccgtgtgcgcctcccacttctgcagctccgccacgagcggcaagaagtccaccgagatccagttccacagcggctccctggtcgggaagaccgccatccacgtgaagggcgccctggtcgacgggaccgagttcacgttcgagggcagctgcatgttccccgacggctgcgacgcggtggactgcaccttctgccgcgagttcctcaagaacccccagtgctacccggccaagaagtggctgttcatcatcatcgtgatcctgctcgggtacgccggcctgatgctgctcaccaacgtcctgaaggccatcgggatctggggctcctgggtgatcgcccccgtgaagctgatgttcgcgatcatcaagaagctcatgcggaccgtcagctgcctgatgcgcaagctgatggaccgggggcgccaggtgatccacgaggagatcggcgagaaccgggtgggcaaccaggacgacgtccgcatcgagatggcccgcccccggcgcgtgcggcactggatgtactcccccgtgatcctcacgatcctggccatcgggctggccgagagctgcgacgagatggtccacgccgactccaagctcgtgagctgccgccagggctccgggaacatgaaggagtgcgtgaccaccggccgggcgctgctgccggccgtcaaccccgggcaggaggcctgcctccacttcaccgcccccggcagccccgacagcaagtgcctgaagatcaaggtgaagcgcatcaacctgaagtgcaagaagtccagctcctacttcgtgccggacgcccggagccgctgcacgtccgtccggcgctgccggtgggcgggcgactgccagagcgggtgcccgccccacttcacctccaacagcttctccgacgactgggccggcaagatggaccgcgccgggctcggcttcagcgggtgctccgacggctgcggcggggccgcgtgcggctgcttcaacgccgcccccagctgcatcttctggcggaagtgggtggagaacccccacgggatcatctggaaggtgtccccctgcgccgcctgggtccccagcgcggtgatcgagctgaccatgccgtccggcgaggtgcgcaccttccaccccatgagcgggatccccacgcaggtcttcaagggcgtgtccgtgacctacctgggcagcgacatggaggtctccgggctcaccgacctgtgcgagatcgaggagctcaagagcaagaagctggccctggccccctgcaaccaggccggcatgggggtggtgggcaaggtcggcgagatccagtgcagctccgaggagagcgcccggaccatcaagaaggacgggtgcatctggaacgcggacctggtgggcatcgagctgcgcgtggacgacgccgtctgctactccaagatcacgagcgtggaggccgtggccaactactccgccatcccgaccaccatcgggggcctccggttcgagcgcagccacgactcccaggggaagatcagcggcagccccctggacatcaccgcgatccggggcagcttctccgtcaactaccgcgggctgcgcctcagcctgtccgagatcacggcgacctgcaccggcgaggtgaccaacgtgagcgggtgctactcctgcatgaccggcgccaaggtcagcatcaagctgcactccagcaagaactccacggcccacgtgcggtgcaagggggacgagaccgccttcagcgtgctcgagggcgtccacagctacaccgtgtccctgagcttcgaccacgccgtggtcgacgagcagtgccagctgaactgcggcgggcacgagtcccaggtgaccctcaagggcaacctgatcttcctggacgtgcccaagttcgtcgacgggagctacatgcagacgtaccactccaccgtgcccaccggcgccaacatcccgagccccaccgactggctcaacgccctgttcgggaacggcctgtcccgctggatcctcggcgtgatcggggtcctgctgggcgggctcgccctgttcttcatgatcatgagcctgttcaagctcggcacgaagcaggtcttccggtcccgcaccaagctggcgtga

SEQ ID NO: 13282 - RNA, 3222 nt, synthetic construct
  misc_feature 1..3222: note = derived and/or modified CDS sequence (opt1) from SFTSV/Phlebovirus(JS2010-015)__JQ317173.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcaacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatgttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgttcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccggggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcctgtcccggtggatcctgggggtgatcggcgtcctcctcgggggcctggccctgttcttcatgatcatgagcctgttcaagctgggcacgaagcaggtcttccgctcccggaccaagctcgcgtga

SEQ ID NO: 13283 - RNA, 3222 nt, synthetic construct
  misc_feature 1..3222: note = derived and/or modified CDS sequence (opt1) from SFTSV/Phlebovirus(JS2010-019)__JQ317179.1__GP
  source 1..3222: mol_type = other RNA
atgatgaaggtgatctggttcagctccctgacctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcacggagagcggcgagctgtgcagctccgacagcggcacctccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagacgaagtgggtgcaggagtccagctccaaggacttcgtctgctacaaggagggcaccggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggggaggtcgtggtgagctacggcggcatgcgggtccgcccgaagtgctacgggttcagccggatgatggccacgctggaggtgaaccagcccgagcagcgcctgggccagtgcaccgggtgccacctcgagtgcatcaacggcggggtgcggctgatcaccctgacctccgagctcaagagcgcgacggtctgcgcctcccacttctgcagctccgccaccagcggcaagaagtccaccgagatccagttccacagcggctccctggtggggaagaccgccatccacgtcaagggcgccctggtggacgggacggagttcaccttcgagggcagctgcatgttccccgacggctgcgacgcggtggactgcaccttctgccgcgagttcctcaagaacccccagtgctacccggccaagaagtggctgttcatcatcatcgtcatcctgctcgggtacgccggcctgatgctgctcaccaacgtgctgaaggccatcgggatctggggctcctgggtgatcgcccccgtcaagctgatgttcgcgatcatcaagaagctcatgcggacggtgagctgcctgatgcgcaagctgatggaccgggggcgccaggtgatccacgaggagatcggcgagaaccgggagggcaaccaggacgacgtccgcatcgagatggcccgcccccggcgcgtgcggcactggatgtactcccccgtgatcctcaccatcctggccatcgggctggccgagagctgcgacgagatggtccacgccgactccaagctcgtgagctgccgccagggctccgggaacatgaaggagtgcgtgaccaccggccgggcgctgctgagcgccgtcaacccggggcaggaggcctgcctccacttcacggcccccggcagccccgactccaagtgcctgaagatcaaggtgaagcgcatcaacctgaagtgcaagaagtccagcagctacttcgtgcccgacgcccggtcccgctgcaccagcgtccggcgctgccggtgggcgggcgactgccagtccgggtgcccgccccacttcaccagcaactccttcagcgacgactgggccggcaagatggaccgcgccgggctcggcttctccgggtgcagcgacggctgcggcggggccgcgtgcggctgcttcaacgccgccccctcctgcatcttctggcggaagtgggtggagaacccgcacgggatcatctggaaggtgagcccctgcgccgcctgggtcccctccgcggtgatcgagctgaccatgcccagcggcgaggtgcgcacgttccacccgatgtccgggatccccacccaggtcttcaagggcgtgagcgtgacctacctgggctccgacatggaggtcagcgggctcaccgacctgtgcgagatcgaggagctcaagagcaagaagctggccctggccccctgcaaccaggccggcatgggggtggtgggcaaggtcggcgagatccagtgctccagcgaggagtccgcccggacgatcaagaaggacgggtgcatctggaacgcggacctggtgggcatcgagctgcgcgtggacgacgccgtctgctacagcaagatcacctccgtggaggccgtggccaactacagcgccatccccaccaccatcgggggcctccggttcgagcgctcccacgacagccaggggaagatctccggcagcccgctggacatcacggcgatccggggctccttcagcgtcaactaccgcgggctgcgcctctccctgagcgagatcaccgcgacctgcaccggcgaggtgaccaacgtgtccgggtgctacagctgcatgacgggcgccaaggtctccatcaagctgcacagctccaagaacagcaccgcccacgtgcggtgcaagggggacgagaccgccttcagcgtgctcgagggcggccactcctacaccgtcagcctgtccttcgaccacgccgtggtggacgagcagtgccagctgaactgcgggggccacgagagccaggtcacgctcaaggggaacctgatcttcctggacgtgcccaagttcgtggacggctcctacatgcagacctaccacagcaccgtccccaccggggccaacatcccctccccgacggactggctcaacgccctgttcggcaacggcctgagccgctggatcctcggggtgatcggcgtgctgctcgggggcctggccctgttcttcatgatcatgtccctgttcaagctcggcaccaagcaggtcttccggagccgcaccaagctggcgtga

SEQ ID NO: 13284 - RNA, 3222 nt, synthetic construct
  misc_feature 1..3222: note = derived and/or modified CDS sequence (opt1) from SFTSV/Phlebovirus(JS24)__HQ830164.1__GP
  source 1..3222: mol_type = other RNA
atgatgaaggtgatctggttcagctccctgatctgcctcgtgatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgggggcgagtccctgccgcagcccttcgacgtcgcctggatggacgtgggccacagccacaagatcatcatgcgcgagcacaagacgaagtgggtgcaggagtccagctccaaggacttcgtctgctacaaggaggggaccggcccctgcagcgagtccgaggagaagacctgcaagaccagcgggtcctgccggggcgacatgcagttctgcaaggtggcggggtgcgagcacggcgaggaggccagcgaggccaagtgccgctgctccctggtgcacaagcccggcgaggtcgtggtgagctacgggggcatgcgggtccgcccgaagtgctacgggttctcccggatgatggccacgctggaggtgaaccagcccgagcagcgcatcggccagtgcaccgggtgccacctcgagtgcatcaacggcggcgtgcggctgatcaccctgaccagcgagctcaagagcgcgacggtctgcgcctcccacttctgcagctccgccaccagcgggaagaagtccaccgagatccagttccacagcggctccctggtggggaagaccgccatccacgtcaagggcgccctggtggacggcacggagttcaccttcgaggggagctgcatgttccccgacggctgcgacgcggtggactgcaccttctgccgcgagttcctcaagaacccccagtgctacccggccaagaagtggctgttcatcatcatcgtcatcctgctcgggtacgccggcctgatgctgctcaccaacgtgctgaaggccatcggggtgtggggctcctgggtcatcgcccccgtgaagctggtgttcgcgatcatcaagaagctcatgcgggccgtcagctgcctgatgggcaagctgatggaccgcgggcgccaggtgatccacgaggagatcggcgagaaccgggaggggaaccaggacgacgtgcggatcgagatggcccgcccccgccgggtccgccactggatgtactcccccgtgatcctcacgatcctggccatcggcctggccgaggggtgcgacgagatggtgcacgcggacagcaagctcgtctcctgccggcagggcagcggcaacatgaaggagtgcgtgaccaccgggcgcgccctgctgccggccgtgaaccccggccaggaggcctgcctccacttcaccgcccccgggtcccccgacagcaagtgcctgaagatcaaggtcaagaagatcaacctgaagtgcaagaagtccagcagctacttcgtgccggacgcgcggtcccgctgcacgagcgtgcggcgctgccggtgggccggcgactgccagtccgggtgcccgccccacttcaccagcaactccttcagcgacgactgggccggcaagatggaccgcgccggcctcgggttctccggctgcagcgacgggtgcggcggggcggcctgcggctgcttcaacgccgccccctcctgcatcttctggcggaagtgggtcgagaacccccacggcatcatctggaaggtgagcccctgcgccgcgtgggtgccctccgccgtcatcgagctgaccatgccgagcggggaggtgcgcaccttccaccccatgtccggcatccccacccaggtgttcaagggggtcagcgtgacctacctgggctccgacatggaggtgagcggcctcaccgacctgtgcgagatcgaggagctgaagtccaagaagctggccctcgccccctgcaaccaggccgggatgggcgtcgtggggaaggtgggcgagatccagtgcagctccgaggagagcgcgcggaccatcaagaaggacgggtgcatctggaacgccgacctggtcggcatcgagctgcgcgtggacgacgccgtgtgctacagcaagatcacgtccgtcgaggccgtggccaactacagcgcgatcccgaccaccatcggcgggctccggttcgagcgctcccacgacagccagggcaagatctccgggagccccctggacatcaccgccatccggggctccttcagcgtgaactaccgcgggctgcggctctccctgagcgagatcacggccacgtgcaccggcgaggtcaccaacgtgtccggctgctacagctgcatgaccggggccaaggtgtccatcaagctgcacagctccaagaacagcacggcgcacgtccgctgcaagggcgacgagaccgccttctccgtgctcgagggggtgcacagctactccgtcagcctgagcttcgaccacgccgtggtggacgagcagtgccagctgaactgcggcgggcacgagtcccacgtcaccctcaagggcaacctgatcttcctggacgtgcccaagttcgtggacggcagctacatgcagacctaccactccacggtccccaccggggccaacatcccgagccccaccgactggctcaacgccctgttcggcaacgggctgtcccgctggatcctcggcgtgatcggcgtcctgctcgggggcctggcgctgttcttcctgatcatgagcctcttcaagctggggaccaagcaggtcttccggtcccgcacgaagctggcctga

SEQ ID NO: 13285 - RNA, 3222 nt, synthetic construct
  misc_feature 1..3222: note = derived and/or modified CDS sequence (opt1) from SFTSV/Phlebovirus(JS4/China/2010 strain JS4)__HQ141605.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaacccgcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctaccccgccaagaagtggctgttcatcatcatcgtcatcctgctggggtacgccggcctcatgctgctgaccaacgtgctcaaggccatcggggtgtggggctcctgggtcatcgcccccgtgaagctgctgttcgcgatcatcaagaagctcatgcggaccgtgagctgcctgatggggaagctgatggaccgcggccggcaggtcatccacgaggagatcggcgagaaccgcgaggggaaccaggacgacgtgcggatcgagatggcccgcccccgccgggtgcgccactggatgtactccccggtcatcctcacgatcctggccatcggcctggccgaggggtgcgacgagatggtgcacgccgacagcaagctcgtgtcctgccggcagggcagcgagaacatgaaggagtgcgtcaccaccgggcgcgcgctgctgcccgccgtgaaccccggccaggaggcctgcctccacttcaccgcccccggctccccggacagcaagtgcctgaagatcaaggtgaagcggatcaacctgaagtgcaagaagtccagcagctacttcgtccccgacgcccgctcccggtgcacgagcgtgcgccggtgccgctgggcgggggactgccagtccggctgcccgccccacttcaccagcaactccttcagcgacgactgggccgggaagatggaccgggccggcctcgggttctccggctgcagcgacggctgcgggggcgccgcgtgcgggtgcttcaacgccgccccctcctgcatcttctggcgcaagtgggtggagaacccccacggcatcatctggaaggtcagcccctgcgccgcctgggtgccgtccgcggtgatcgagctgaccatgcccagcggggaggtccggaccttccaccccatgtccggcatccccacccaggtgttcaagggcgtgagcgtcacctacctggggtccgacatggaggtgagcggcctcaccgacctgtgcgagatcgaggagctgaagtccaagaagctggccctcgccccgtgcaaccaggccgggatgggcgtggtcggcaaggtgggggagatccagtgcagcagcgaggagtccgcccgcaccatcaagaaggacggctgcatctggaacgcggacctggtggggatcgagctgcgggtcgacgacgccgtgtgctacagcaagatcacgtccgtggaggccgtcgccaactacagcgccatccccaccaccatcggcgggctccgcttcgagcggtcccacgacagccagggcaagatctccggcagccccctggacatcaccgcgatccgcgggtccttcagcgtgaactaccggggcctgcgcctctccctgagcgagatcacggccacgtgcaccggggaggtgaccaacgtctccggctgctacagctgcatgaccggggccaaggtgtccatcaagctgcacagctccaagaacagcacggcccacgtgcgctgcaagggcgacgagaccgcgttctccgtcctcgagggcgtgcacagctacaccgtgagcctgtccttcgaccacgccgtcgtggacgagcagtgccagctgaactgcgggggccacgagagccaggtgaccctcaaggggaacctgatcttcctggacgtccccaagttcgtggacggctcctacatgcagacgtaccacagcaccgtgccgaccggggccaacatcccctcccccaccgactggctcaacgccctgttcggcaacggcctgagccggtggatcctcggggtcatcggcgtgctgctcgggggcctggccctgttcttcctgatcatgtccctcttcaagctgggcacgaagcaggtcttccgcagccggaccaagctggcgtga

SEQ ID NO: 13286 - RNA, 3222 nt, synthetic construct
  misc_feature 1..3222: note = derived and/or modified CDS sequence (opt1) from SFTSV/Phlebovirus(JS6)__HQ830170.1__GP
  source 1..3222: mol_type = other RNA
atgatgaaggtgatctggttcagctccctgatctgcctcgtcatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgaacgagcccgagcagcgcatcgggcagtgcaccggctgccagctcgagtgcatcaacgggggcgtgcggctgatcaccctgaccagcgagctcaagagcgcgacggtctgcgcctcccacttctgcagctccgccaccagcggcaagaagtccaccgagatccagttccacagcgggtccctggtgggcaagaccgccatccacgtcaagggggccctggtggacggcacggagttcaccttcgagggcagctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggtcctgggtcatcgcccccgtgaagctggtgttcgcgatcatcaagaagctcatgcgggccgtcagctgcctgatgggcaagctgatggaccgcggccgccaggtgatccacgaggagatcggggagaaccgggagggcaaccaggacgacgtgcggatcgagatggcccgcccccgccgggtccgccactggatgtactcccccgtgatcctcacgatcctggccatggggctggccgagggctgcgacgagatggtgcacgcggacagcaagctcgtctcctgccggcaggggagcggcaacatgaaggagtgcgtgaccaccggccgcgccctgctgccggccgtgaaccccgggcaggaggcctgcctccacttcaccgcccccggctcccccgacagcaagtgcctgaagatcaaggtcaagcggatcaacctgaagtgcaagaagtccagcagctacttcgtgccggacgcgcgctcccggtgcacgagcgtgcgccggtgccgctgggccggggactgccagtccggctgcccgccccacttcaccagcaactccttcagcgacgactgggccgggaagatggaccgggccggcctcggcttctccgggtgcagcgacggctgcgggggcgcggcctgcgggtgcttcaacgccgccccctcctgcatcttctggcgcaagtgggtcgagaacccccacggcatcatctggaaggtgagcccctgcgccgcgtgggtgccctccgccgtcatcgagctgaccatgccgagcggcgaggtgcggaccttccaccccatgtccgggatccccacccaggtgttcaagggcgtcagcgtgacctacctggggtccgacatggaggtgagcggcctcaccgacctgtgcgagatcgaggagctgaagtccaagaagctggccctcgccccctgcaaccaggccggcatgggggtcgtgggcaaggtgggggagatccagtgcagctccgaggagagcgcgcgcaccatcaagaaggacggctgcatctggaacgccgacctggtcgggatcgagctgcgggtggacgacgccgtgtgctacagcaagatcacgtccgtcgaggccgtggccaactacagcgcgatcccgaccaccatcggcggcctccgcttcgagcggtcccacgacagccaggggaagatctccggcagccccctggacatcaccgccatccgcgggtccttcagcatcaactaccggggcctgcgcctctccctgagcgagatcacggccacgtgcaccggggaggtgaccaacgtctccggctgctacagctgcatgaccggcgccaaggtgtccatcaagctgcacagctccaagaacagcacggcgcacgtgcgctgcaagggggacgagaccgccttctccgtcctcgagggcgtgcacagctactccgtgagcctgagcttcgaccacgccgtcgtggacgagcagtgccagctgaactgcgggggccacgagtcccaggtgaccctccgggggaacctgatcttcctggacgtccccaagttcgtggacggcagctacatgcagacctaccactccacggtgcccaccggcgccaacatcccgagccccaccgactggctcaacgccctgttcgggaacggcctgtcccgctggatcctcggggtcatcggcgtgctgctgggcgggctcgcgctgttcttcctgatcatgagcctcttcaagctgggcaccaagcaggtcttccggtcccgcacgaagctggcctga

SEQ ID NO: 13287 - RNA, 3222 nt, synthetic construct
  misc_feature 1..3222: note = derived and/or modified CDS sequence (opt1) from SFTSV/Phlebovirus(JSD1)__JF267784.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagccactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctgaagtccttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaaccagcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctcgtggggaagaccgccatccacgtcaagggcgccctggtggacgggaccgagttcacgttcgagggcagctgcatgttccccgacggctgcaacgcggtggactgcaccttctgccgcgagttcctgaagaacccccagtgctacccggccaagaagtggctgttcatcatcatcgtcatcctgctggggtacgccggcctcatgctgctgaccaacgtgctcaaggccatcgggatctggggctcctgggtgatcgcccccgtcaagctgatgttcgcgatcatcaagaagctgatgcggaccgtgagctgcctcatggggaagctgatggaccgcggccgccaggtgatccacgaggagatcggcgagaaccgggaggggaaccaggacgacgtccggatcgagatggcccgcccccgccgggtgcgccactggatgtactcccccgtgatcctgacgttcctcgccatcggcctggccgagagctgcgacgagatggtccacgccgactccaagctggtgagctgccggcaggggtccggcaacatgaaggagtgcgtgaccaccgggcgcgcgctcctgccggccgtcaaccccggccaggaggcctgcctgcacttcaccgcccccggcagccccgacagcaagtgcctcaagatcaaggtgaagcggatcaacctgaagtgcaagaagtccagctcctacttcgtgccggacgcccgcagccggtgcacgtccgtccgccggtgccgctgggcgggggactgccagagcggctgcccgccccacttcacctccaacagcttctccgacgactgggccgggaagatggaccgggccggcctggggttcagcggctgctccgacggctgcgggggcgccgcgtgcgggtgcttcaacgccgcccccagctgcatcttctggcgcaagtgggtggagaacccccacggcatcatctggaaggtgtccccctgcgccgcctgggtccccagcgcggtgatcgagctcaccatgccgtccggggaggtgcggaccttccaccccatgagcggcatccccacgcaggtcttcaagggcgtgtccgtgacctacctggggagcgacatggaggtctccggcctgaccgacctctgcgagatcgaggagctcaagagcaagaagctggccctggccccctgcaaccaggccgggatgggcgtggtgggcaaggtcggggagatccagtgcagctccgaggagagcgcccgcaccatcaagaaggacggctgcatctggaacgcggacctggtggggatcgagctgcgggtggacgacgccgtctgctactccaagatcacgagcgtggaggccgtggccaactactccgccatcccgaccaccatcggcgggctgcgcttcgagcggagccacgactcccagggcaagatcagcggcagccccctcgacatcaccgcgatccgcgggagcttctccgtcaactaccggggcctgcgcctgagcctctccgagatcacggcgacctgcaccggggaggtgaccaacgtgagcggctgctactcctgcatgaccggggccaaggtcagcatcaagctgcactccagcaagaactccacggcccacgtgcgctgcaagggcgacgagaccgccttcagcgtgctggagggcgtccacagctacaccgtgtccctcagcttcgaccacgccgtggtcgacgagcagtgccagctgaactgcgggggccacgagtcccaggtgaccctgaaggggaacctcatcttcctggacgtgcccaagttcgtcgacggcagctacatgcagacgtaccactccaccgtgcccaccggggccaacatcccgagccccaccgactggctgaacgccctcttcggcaacggcctgtcccggtggatcctgggggtgatcggcgtcctcctcgggggcctggccctgttcttcatgatcatgagcctgttcaagctgggcacgaagcaggtcttccgctcccggaccaagctcgcgtga

SEQ ID NO: 13288 - RNA, 3222 nt, synthetic construct
  misc_feature 1..3222: note = derived and/or modified CDS sequence (opt1) from SFTSV/Phlebovirus(LN2/China/2010 strain LN2)__HQ141608.1__GP
  source 1..3222: mol_type = other RNA
atgatgaaggtgatctggttcagctccctgatctgcttcgtcatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctcaagagcttctcccagagcgagttccccgacatctgccgcatcgacgggatcgtgttcaaccagtgcgagggcgagtccctgccgcagcccttcgacgtcgcctggatggacgtggggcacagccacaagatcatcatgcgggagcacaagaccaagtgggtgcaggagtccagctccaaggacttcgtctgctacaaggagggcacgggcccctgcagcgagtccgaggagaagacctgcaagaccagcgggtcctgccgcggcgacatgcagttctgcaaggtggcggggtgcgagcacggcgaggaggccagcgaggccaagtgccggtgctccctcgtgcacaagcccggggaggtcgtggtgagctacggcggcatgcgcgtccggccgaagtgctacgggttcagccgcatgatggccaccctggaggtgaaccagcccgtgcagcggatcggccagtgcacggggtgccacctggagtgcatcaacggcggggtccgcctcatcaccctgacctccgagctcaagagcgcgaccgtgtgcgcctcccacttctgcagctccgccacgagcggcaagaagtccaccgagatccagttccacagcggctccctcgtcgggaagaccgccatccacgtgaagggcgccctggtggacgggaccgagttcacgttcgagggcagctgcatgttccccgacggctgcgacgcggtcgactgcaccttctgccgggagttcctgaagaacccccagtgctacccggccaagaagtggctgttcatcatcatcgtgatcctgctggggtacgccggcctcatgctgctgaccaacgtgctcaaggccatcgggatctggggctcctgggtcatcgcccccgtgaagctgatcttcgcgatcatcaagaagctgatgcgcaccgtgagctgcctcatggggaagctgatggaccggggccgccaggtcatccacgaggagatcggcgagaaccgggaggggaaccaggacgacgtgcgcatcgagatggcccgcccccggcgcgtgcggcactggatgtacgcccccgtcatcctgacgatcctcgccatgggcctggccgagtcctgcgacgagatggtgcacgcggacagcaagctggtgtcctgccgccaggggagcggcaacatgaaggagtgcgtcaccaccgggcgggccctcctgccggccgtgaaccccggccaggaggcctgcctgcacttcaccgcccccggctcccccgacagcaagtgcctcaagatcaaggtgaagcgcatcaacctgaagtgcaagaagtccagcagctacttcgtcccggacgcgcggtcccgctgcacgagcgtgcggcgctgccggtgggccggggactgccagtccggctgcccgccccacttcaccagcaactccttcagcgacgactgggccgggaagatggaccgcgccggcctggggttctccggctgcagcgacggctgcgggggcgcggcctgcgggtgcttcaacgccgccccctcctgcatcttctggcggaagtgggtggagaacccccacggcatcatctggaaggtcagcccctgcgccgcgtgggtgccctccgccgtgatcgagctcaccatgccgagcggggaggtccgcaccttccaccccatgtccggcatccccacccaggtgttcaagggcgtgagcgtcacctacctggggtccgacatggaggtgagcggcctgaccgacctctgcgagatcgaggagctgaagtccaagaagctggccctggccccctgcaaccaggccgggatgggcgtggtcggcaaggtgggggagatccagtgcagcagcgaggagtccgcgcggaccatcaagaaggacggctgcatctggaacgccgacctcgtggggatcgagctgcgcgtcgacgacgccgtgtgctacagcaagatcacgtccgtggaggccgtcgccaactacagcgcgatcccgaccaccatcggcgggctgcggttcgagcgctcccacgacagccagggcaagatctccggcagccccctcgacatcaccgccatccgggggtccttcagcgtgaactaccgcggcctgcgcctgtccctcagcgagatcacggccacgtgcaccggggaggtgaccaacgtctccggctgctacagctgcatgaccggggccaaggtgtccatcaagctgcacagctccaagaacagcacggcgcacgtgcggtgcaagggcgacgagaccgccttctccgtcctggagggcgtgcacagctacaccgtgagcctctccttcgaccacgccgtcgtggacgagcagtgccagctgaactgcgggggccacgagagccaggtgaccctgaaggggaacctcatcttcctggacgtccccaagttcgtggacggctcctacatgcagacgtaccacagcaccgtgcccaccggggccaacatcccgtcccccaccgactggctgaacgccctcttcggcaacggcctgagccgctggatcctgggggtcatcggcgtgctcctcgggggcctggcgctgttcttcatgatcatgtccctgttcaagctgggcacgaagcaggtcttccggagccgcaccaagctggcctga

SEQ ID NO: 13289 - RNA, 3222 nt, synthetic construct
  misc_feature 1..3222: note = derived and/or modified CDS sequence (opt1) from SFTSV/Phlebovirus(LN3/China/2010 strain LN3)__HQ141611.1__GP
  source 1..3222: mol_type = other RNA
atgatgaaggtgatctggttcagctccctgatctgcctcgtgatccagtgcggcggggacaccggccccatcatctgcgccgggccgatccacagcaacaagtccgccgacatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaagggcagcgacatgatcgtcccggggccctcctacaagggcaaggtgttcttcgagcggcccaccttcgacggctacgtggggtggggctgcgggagcggcaagtcccgcacggagagcggcgagctctgctccagcgacagcgggacctccagcggcctgctgccctccgaccgggtcctctggatcggggacgtggcctgccagccgatgacccccatccccgaggagaccttcctggagctcaagagcttctcccagagcgagttccccgacatctgcaagatcgacggcatcgtgttcaaccagtgcgagggggagtccctgccgcagcccttcgacgtcgcctggatggacgtgggccacagccacaagatcatcatgcgcgagcacaagacgaagtgggtgcaggagtccagctccaaggacttcgtctgctacaaggagggcaccgggccctgcagcgagtccgaggagaagacctgcaagaccagcggctcctgccgcggggacatgcagttctgcaaggtggcgggctgcgagcacggggaggaggccagcgaggccaagtgccggtgctccctggtgcacaagcccggcgaggtcgtggtgagctacggcgggatgcgggtccgcccgaagtgctacggcttctcccggatgatggccacgctggaggtgaaccagcccgagcagcgcatcgggcagtgcaccggctgccacctcgagtgcatcaacgggggcgtgcggctgatcaccctgaccagcgagctcaagagcgcgacggtctgcgcctcccacttctgcagctccgccaccagcggcaagaagtccaccgagatccagttccacagcgggtccctggtgggcaagaccgccatccacgtcaagggggccctggtggacggcacggagttcaccttcgagggcagctgcatgttccccgacgggtgcgacgcggtggactgcaccttctgccgcgagttcctcaagaacccccagtgctacccggccaagaagtggctgttcatcatcatcgtcatcctgctcggctacgccgggctgatgctgctcaccaacgtgctgaaggccatcggcgtgtgggggtcctgggtcatcgcccccgtgaagctggtgttcgcgatcatcaagaagctcatgcgggccgtcagctgcctgatgggcaagctgatggaccgcggccgccaggtgatccacgaggagatcggggagaaccgggagggcaaccaggacgacgtgcggatcgagatggcccgcccccgccgggtccgccactggatgtactcccccgtgatcctcacgatcctggccatcgggctggccgagggctgcgacgagatggtgcacgcggacagccggctcgtctcctgccgccaggggagcggcaacatgaaggagtgcgtgaccaccggccgggccctgctgccggccgtgaaccccgggcaggaggcctgcctccacttcaccgcccccggctcccccgacagcaagtgcctgaagatcaaggtcaagcgcatcaacctgaagtgcaagaagtccagcagctacttcgtgccggacgcgcggtcccgctgcacgagcgtgcggcgctgccggtgggccggggactgccagtccggctgcccgccccacttcaccagcaactccttcagcgacgactgggccgggaagatggaccgcgccggcctcggcttctccgggtgcagcgacggctgcgggggcgcggcctgcgggtgcttcaacgccgccccctcctgcatcttctggcggaagtgggtcgagaacccccacggcatcatctggaaggtgagcccctgcgccgcgtgggtgccctccgccgtcatcgagctgaccatgccgagcggcgaggtgcgcaccttccaccccatgtccgggatccccacccaggtgttcaagggcgtcagcgtgacctacctggggtccgacatggaggtgagcggcctcaccgacctgtgcgagatcgaggagctgaagtccaagaagctggccctcgccccctgcaaccaggccggcatgggggtcgtgggcaaggtgggggagatccagtgcagctccgaggagagcgcgcggaccatcaagaaggacggctgcatctggaacgccgacctggtcgggatcgagctgcgcgtggacgacgccgtgtgctacagcaagatcacgtccgtcgaggccgtggccaactacagcgcgatcccgaccaccatcggcggcctccggttcgagcgctcccacgacagccaggggaagatctccggcagccccctggacatcaccgccatccgggggtccttcagcgtgaactaccgcggcctgcgcctctccctgagcgagatcacggccacgtgcaccggggaggtcaccaacgtgtccggctgctacagctgcatgaccggcgccaaggtgtccatcaagctgcacagctccaagaacagcacggcgcacgtccggtgcaagggggacgagaccgccttctccgtgctcgagggcgtgcacagctactccgtcagcctgagcttcgaccacgccgtggtggacgagcagtgccagctgaactgcgggggccacgagtcccacgtcaccctccgcgggaacctgatcttcctggacgtgcccaagttcgtggacggcagctacatgcagacctaccactccacggtccccaccggcgccaacatcccgagccccaccgactggctcaacgccctgttcgggaacggcctgtcccggtggatcctcggggtgatcggcgtcctgctgggcgggctcgcgctgttcttcctgatcatgagcctcttcaagctgggcaccaagcaggtcttccgctcccggacgaagctggcctga

SEQ ID NO: 13290 - RNA, 3222 nt, synthetic construct
  misc_feature 1..3222: note = derived and/or modified CDS sequence (opt1) from SFTSV/Phlebovirus(SD24/China/2010 strain SD24)__HM802201.1__GP
  source 1..3222: mol_type = other RNA
atgatgaaggtgatctggttcagctccctgatctgcctcgtgatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacatcgcctggatggacgtcgggcacagccacaagatcatcatgcgcgagcacaagaccaagtgggtgcaggagtccagctccaaggacttcgtgtgctacaaggagggcacgggcccctgcagcgagtccgaggagaaggcgtgcaagaccagcgggtcctgccggggcgacatgcagttctgcaaggtcgccgggtgcgagcacggcgaggaggccagcgaggccaagtgccgctgctccctggtgcacaagcccggggaggtggtcgtgagctacggcggcatgcgggtgcgcccgaagtgctacgggttcagccggatgatggcgaccctggaggtcaacccgcccgagcagcgcatcggccagtgcaccgggtgccacctcgagtgcatcaacggcggggtgcggctgatcacgctgacctccgagctccgcagcgccaccgtgtgcgcctcccacttctgcagctccgccaccagcggcaagaagtccacggagatccacttccacagcggctccctggtcgggaagaccgccatccacgtgaagggcgcgctggtcgacgggaccgagttcaccttcgagggcagctgcatgttccccgacggctgcgacgccgtggactgcacgttctgccgggagttcctcaagaacccccagtgctaccccgccaagaagtggctgttcatcatcatcgtgatcctgctcgggtacgccggcctgatgctgctcaccaacgtcctgaaggccatcggggtgtggggctcctgggtgatcgcgcccgtcaagctgatgttcgccatcatcaagaagctcatgcgcaccgtgagctgcctggtggggaagctgatggaccggggccgccaggtcatccacgaggagatcggcgagaacggggagggcaaccaggacgacgtgcggatcgagatggcccgcccccgccgggtgcgccactggatgtactccccggtcatcctcaccatcctggccatcgggctggccgagggctgcgacgagatggtgcacgcggacagcaagctcgtgtcctgccggcaggggagcggcaacatgaaggagtgcatcacgaccggccgcgccctgctgcccgccgtcaaccccgggcaggaggcctgcctccacttcaccgcccccggctccccggacagcaagtgcctgaagatcaaggtgaagcggatcaacctgaagtgcaagaagtccagcagctacttcgtgcccgacgcgcgctcccggtgcaccagcgtccgccggtgccgctgggccggggactgccagtccggctgcccgccccacttcacgagcaactccttcagcgacgactgggccgggaagatggaccgggccggcctcggcttctccgggtgcagcgacggctgcgggggcgcggcctgcgggtgcttcaacgccgccccctcctgcatcttctggcgcaagtgggtggagaacccccacggcatcatctggaaggtgagcccctgcgccgcgtgggtcccgtccgccgtgatcgagctgaccatgcccagcggcgaggtgcggaccttccaccccatgtccgggatccccacccaggtcttcaagggcgtgagcgtgacgtacctggggtccgacatggaggtcagcggcctcaccgacctgtgcgagatcgaggagctgaagtccaagaagctggccctcgccccgtgcaaccaggccggcatgggggtggtgggcaaggtcggggagatccagtgcagcagcgaggagtccgcgcgcaccatcaagaaggacggctgcatctggaacgccgacctggtggggatcgagctgcgggtggacgacgccgtctgctacagcaagatcacctccgtggaggccgtggccaactacagcgcgatccccacgaccatcggcggcctccgcttcgagcggtcccacgacagccaggggaagatctccggcagccccctggacatcaccgccatccgcgggtccttcagcgtcaactaccggggcctgcgcctctccctgagcgagatcaccgccacgtgcaccggggaggtgaccaacgtgtccggctgctacagctgcatgaccggcgccaaggtctccatcaagctgcacagctccaagaacagcaccgcgcacgtgcgctgcaagggggacgagacggccttctccgtgctcgagggcgtccacagctacatcgtgagcctgtccttcgaccacgccgtggtcgacgagcagtgccagctgaactgcgggggccacgagagccaggtgaccctcaaggggaacctgatcttcctggacgtgcccaagttcgtcgacggctcctacatgcagacctaccacagcaccgtgccgacgggcgccaacatcccctcccccaccgactggctcaacgccctgttcgggaacggcctgagccggtggatcctcggggtgatcggcgtcctgctgggcgggctcgcgctgttcttcctgatcatgttcctcctgaagctgggcaccaagcaggtcttccgctcccggaccaagctcgcctga

SEQ ID NO: 13291 - RNA, 3222 nt, synthetic construct
  misc_feature 1..3222: note = derived and/or modified CDS sequence (opt1) from SFTSV/Phlebovirus(SD4/China/2010 strain SD4)__HM802203.1__GP
  source 1..3222: mol_type = other RNA
atgatgaaggtgatctggttcagctccctgatctgcttcgtgatccagtgcagcggcgactccgggcccatcatctgcgccggcccgatccacagcaacaagtccgccgacatcccccacctcctggggtacagcgagaagatctgccagatcgaccgcctgatccacgtgtccagctggctccggaaccactcccagttccagggctacgtggggcagcgcggcggccggagccaggtctcctactaccccgcggagaacagctactcccgctggagcgggctgctgtccccctgcgacgccgactggctcggcatgctggtggtgaagaaggccaaggggagcgacatgatcgtcccgggcccctcctacaaggggaaggtgttcttcgagcggcccaccttcgacggctacgtgggctgggggtgcggcagcgggaagtcccgcaccgagagcggcgagctgtgcagctccgacagcggcacgtccagcgggctcctgccctccgaccgggtcctgtggatcggcgacgtggcctgccagccgatgacccccatccccgaggagaccttcctcgagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaagacctgcaagaccagcgggtcctgccggggcgacatgcagttctgcaaggtggcggggtgcgagcacggcgaggaggccagcgaggccaagtgccgctgctccctcgtgcacaagcccggggaggtcgtggtgagctacggcggcatgcgggtccgcccgaagtgctacgggttcagccggatgatggccaccctggaggtgaacccgcccgagcagcgcatcggccagtgcacggggtgccacctggagtgcatcaacggcggggtgcggctcatcaccctgacctccgagctcaagagcgcgaccgtctgcgcctcccacttctgcagctccgccacgagcggcaagaagtccaccgagatccagttccacagcggctccctggtggggaagaccgccatccacgtcaagggcgccctggtggacgggaccgagttcacgttcgagggcagctgcatgttccccgacggctgcgacgcggtggactgcaccttctgccgcgagttcctgaagaacccccagtgctaccccgccaagaagtggctgttcatcatcatcgtcatcctgctggggtacgccggcctcatgctgctgaccaacgtgctcaaggccatcggggtgtggggctcctgggtcatcgcccccgtgaagctgctgttcgcgatcatcaagaagctcatgcggaccgtgagctgcctgatggggaagctgatggaccgcggccggcaggtcatccacgaggagatcggcgagaaccgcgaggggaaccaggacgacgtgcggatcgagatggcccgcccccgccgggtgcgccactggatgtactccccggtcatcctcacgatcctggccaccggcctggccgaggggtgcgacgagatggtgcacgccgacagcaagctcgtgtcctgccggcagggcagcgggaacatgaaggagtgcgtcaccaccggccgcgcgctgctgcccgccgtgaaccccggccaggaggcctgcctccacttcacggcccccgggtccccggacagcaagtgcctgaagatcaaggtgaagcggatcaacctgaagtgcaagaagtccagcagctacttcgtccccgacgcccgctcccggtgcaccagcgtgcgccggtgccgctgggcgggcgactgccagtccgggtgcccgccccacttcaccagcaactccttcagcgacgactgggccggcaagatggaccgggccgggctcggcttctccggctgcagcgacgggtgcggcggggccgcgtgcggctgcttcaacgccgccccctcctgcatcttctggcgcaagtgggtggagaacccccacgggatcatctggaaggtcagcccctgcgccacctgggtgccgtccgccgtgatcgagctgacgatgcccagcggcgaggtccggaccttccaccccatgtccggcatccccacccaggtgttcaagggggtgagcgtcacctacctgggctccgacatggaggtgagcgggctcacggacctgtgcgagatcgaggagctgaagtccaagaagctggcgctcgccccgtgcaaccaggccggcatgggcgtgatcgggaaggtcggcgagatccagtgcagcagcgaggagtccgcccgcaccatcaagaaggacgggtgcatctggaacgccgacctggtgggcatcgagctgcgggtggacgacgcggtctgctacagcaagatcacctccgtggaggccgtggccaactacagcgccatccccaccacgatcgggggcctccgcttcgagcggtcccacgacagccagggcaagatctccgggagccccctggacatcaccgccatccgcggctccttcagcgtcaactaccgggggctgcgcctctccctgagcgagatcaccgcgacctgcaccggcgaggtgacgaacgtgtccgggtgctacagctgcatgaccggcgccaaggtctccatcaagctgcacagctccaagaacagcaccgcccacgtgcgctgcaagggcgacgagaccgccttctccgtgctcgagggggtccacagctacacggtgagcctgtccttcgaccacgcggtggtcgacgagcagtgccagctgaactgcggcgggcacgagagccaggtgaccctcaagggcaacctgatcttcctggacgtgcccaagttcgtcgacgggtcctacatgcagacctaccacagcaccgtgccgacgggcgccaacatcccctcccccaccgactggctcaacgccctgttcggcaacgggctgagccggtggatcctcggcgtgatcggggtcctgctgggcggcctcgccctgttcttcctgatcatgtccctcttcaagctggggaccaagcaggtcttccgcagccggaccaagctggcctga

SEQ ID NO: 13292 - RNA, 3222 nt, synthetic construct
  misc_feature 1..3222: note = derived and/or modified CDS sequence (opt1) from SFTSV/Phlebovirus(SDYY104/China/2011)__KU239112.1__GP
  source 1..3222: mol_type = other RNA
atgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctgaacagcttctcccagagcgagttccccgacatctgcaagatcgacgggatcgtgttcaaccagtgcgagggcgagtccctcccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcatgcgggtccgcccgaagtgctacgggttcagccggatgatggcgaccctggaggtgaacccgcccgagcagcgcatcggccagtgcaccgggtgccacctcgagtgcatcaacggcggggtgcggctgatcacgctgacctccgagctccgcagcgccaccgtctgcgcctcccacttctgcagctccgccaccagcggcaagaagtccacggagatccacttccacagcggctccctggtggggaagaccgccatccacgtcaagggcgcgctggtggacgggaccgagttcaccttcgagggcagctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctgctcaccaacgtgctgaaggccatcggggtgtggggctcctgggtcatcgcgcccgtgaagctgatgttcgccatcatcaagaagctcatgcgcaccgtgagctgcctggtcgggaagctgatggaccggggccgccaggtgatccacgaggagatcggcgagaacggggagggcaaccaggacgacgtgcggatcgagatggcccgcccccgccgggtccgccactggatgtactccccggtgatcctcaccatcctggccatcgggctggccgagggctgcgacgagatggtgcacgcggacagcaagctcgtctcctgccggcaggggagcggcaacatgaaggagtgcatcacgaccggccgcgccctgctgcccgccgtgaaccccgggcaggaggcctgcctccacttcaccgcccccggctccccggacagcaagtgcctgaagatcaaggtgaagcggatcaacctgaagtgcaagaagtccagcagctacttcgtccccgacgcgcgctcccggtgcaccagcgtgcgccggtgccgctgggccggggactgccagtccggctgcccgccccacttcacgagcaactccttcagcgacgactgggccgggaagatggaccgggccggcctcggcttctccgggtgcagcgacggctgcgggggcgcggcctgcgggtgcttcaacgccgccccctcctgcatcttctggcgcaagtgggtggagaacccccacggcatcatctggaaggtcagcccctgcgccgcgtgggtgccgtccgccgtgatcgagctgaccatgcccagcggcgaggtccggaccttccaccccatgtccgggatccccacccaggtgttcaagggcgtgagcgtcacgtacctggggtccgacatggaggtgagcggcctcaccgacctgtgcgagatcgaggagctgaagtccaagaagctggccctcgccccgtgcaaccaggccggcatgggggtggtcggcaaggtgggggagatccagtgcagcagcgaggagtccgcgcgcaccatcaagaaggacggctgcatctggaacgccgacctggtggggatcgagctgcgggtcgacgacgccgtgtgctacagcaagatcacctccgtggaggccgtcgccaactacagcgcgatccccacgaccatcggcggcctccgcttcgagcggtcccacgacagccaggggaagatctccggcagccccctggacatcaccgccatccgcgggtccttcagcgtgaactaccggggcctgcgcctctccctgagcgagatcaccgccacgtgcaccggggaggtgaccaacgtctccggctgctacagctgcatgaccggcgccaaggtgtccatcaagctgcacagctccaagaacagcaccgcgcacgtgcgctgcaagggggacgagacggccttctccgtcctcgagggcgtgcacagctacatcgtgagcctgtccttcgaccacgccgtcgtggacgagcagtgccagctgaactgcgggggccacgagagccaggtgaccctcaaggggaacctgatcttcctggacgtccccaagttcgtggacggctcctacatgcagacctaccacagcaccgtgccgacgggcgccaacatcccctcccccaccgactggctcaacgccctgttcgggaacggcctgagccggtggatcctcggggtcatcggcgtgctgctgggcgggctcgcgctgttcttcctgatcgtcttcctcctgaagctgggcaccaagcaggccttccgctcccggaccaagctcgcctga

SEQ ID NO: 13293 - RNA, 3417 nt, synthetic construct
  misc_feature 1..3417: note = derived and/or modified CDS sequence (opt5) from ANDV(Chile-9717869)__AF291703.2__GP
  source 1..3417: mol_type = other RNA
atggagggctggtacctggtggtcctcggggtttgctataccctgacacttgccatgcccaagacgatctacgaactgaaaatggagtgtcctcacaccgtgggactcggccaggggtatattatcggaagcacagaactgggccttatttccatcgaggctgcctctgacattaagctggaaagctcctgcaacttcgatctccataccacatctatggcgcaaaagagctttacccaggtggagtggagaaagaaatccgacacaaccgatacgaccaatgctgcctctacaaccttcgaggcccagacaaagaccgtcaacctgcgggggacgtgtatcctggctccggaactctacgacacactgaagaaagtgaagaaaaccgttctttgctatgatctgacatgtaatcagacccactgccaacccaccgtgtacctcatcgcccctgtcctgacatgtatgagcattcgctcctgcatggctagcgtgtttacgtctagaatccaggttatttatgagaagacccattgtgtgacaggacagcttatcgaaggccagtgcttcaaccccgcccacaccctgacactctcccaacctgcgcatacctacgacacggtcacactgcccattagctgctttttcacccctaaaaagtctgagcagctgaaggtgatcaaaacctttgagggcattctcacaaagaccgggtgcacagaaaatgccctgcagggatactatgtgtgcttccttggctcccacagcgagccgctgatcgtcccctctctcgaagatatccggtccgctgaggttgtgagccgcatgctggtgcaccctagaggggaagaccatgatgccattcagaactcccaatctcaccttcggatcgtcggacccattacggctaaagtgcctagcacctccagcacagacaccctgaagggcacagcctttgcgggggttcccatgtactcttccctcagcaccctggtgcgcaatgccgatccggagttcgtcttttctcctggaatcgtgcccgagagcaaccattccacgtgtgacaaaaagaccgttcctattacatggaccggctatctgcccatctctggcgaaatggagaaagtgacagggtgcaccgtcttctgtacgctcgctggacccggcgccagctgcgaagcctactccgagaatgggatctttaacattagctctcctacatgtctggtgaataaggtccagagattccggggatccgaacagaagatcaacttcatttgccaacgcgtggatcaggacgttgtggtctattgtaatggccagaaaaaggtgatccttaccaaaacactggttattgggcagtgcatctacacctttaccagcctcttctctctgatgccggacgtggcccactcccttgccgtcgagctgtgtgtgcccggactccacggctgggctacagtgatgctgctgagcacgttttgcttcggctgggttctcatccctgcggtcaccctgattatccttaagtgtctgagagtgctcacattttcctgctctcattataccaacgagagcaaattcaagtttattctggaaaaggtgaaaatcgagtaccaaaagacaatggggtccatggtctgcgatgtgtgtcaccatgaatgcgagaccgccaaagaactggagtctcaccggcagagctgtattaatggacagtgcccctactgtatgacgatcacagaggctaccgaatccgcccttcaggcccattatagcatttgcaagctcaccggccgcttccaagaggctctgaaaaagtctctgaagaaacctgaagttaagaaagggtgttacagaacactcggagtgtttcggtataagtcccgctgctacgtcggcctggtgtggtgtcttctgctcacctgtgagatcgttatctgggccgcgagcgctgagacacccctgatggaatctgggtggtccgacacggcccacggcgtgggagagattccgatgaaaaccgatctggaacttgacttcagcctcccttctagctccagctattcttacagacggaagctgacaaaccccgccaacaaggaggaatccatcccttttcacttccagatggagaaacaggtcattcatgctgagatccagcccctgggccactggatggatgccacctttaatattaagacagctttccattgttatggggcctgccaaaaatacagctacccttggcagacctccaagtgcttctttgaaaaagactatcagtacgagacgggatggggctgtaaccccggggattgcccgggagtgggcaccgggtgtacagcgtgcggcgtttatctcgacaagctgaaatctgtgggaaaggcctacaagatcatcagccttaaatataccagaaaggtctgtattcagctgggcacagaacaaacctgcaaacacatcgatgctaatgactgtctcgtgacaccttccgtgaaggtctgcattgttgggaccgtgtctaaactgcagcccagcgatacgctgcttttcctcggacccctggagcagggcgggatcattctgaagcaatggtgtacaacctcctgcgcctttggagaccctggcgacatcatgtctaccccgagcgggatgcgctgtcccgaacacacaggctccttccggaagatctgcggatttgctaccacgcctgtgtgcgagtaccagggcaacacaattagcgggtataaaagaatgatggccaccaaggattctttccagtcctttaatctcacagagccccatatcaccacaaacaaactggaatggattgaccctgatggaaatacccgcgaccacgtcaaccttgtgctgaatcgggatgttagcttccaggacctctctgataacccctgtaaggtggacctgcatacgcaagcgatcgagggcgcctgggggtccggagtcggctttaccctgacatgcaccgtggggcttacagaatgtcctagcttcatgacctctattaaggcttgcgatctcgccatgtgttacggctccacggttacaaatctggctagaggaagcaacaccgtgaaagtcgtgggcaaagggggacactccggcagctcttttaaatgctgtcatgacacagattgcagctccgaggggctgctcgcctctgctccccacctggaacgcgttaccggattcaatcagatcgacagcgataaggtgtacgacgacggcgctccgccttgtacctttaaatgctggttcacaaagtccggcgagtggcttctggggatcctcaacggaaattggattgtcgtggtggtcctggttgtgatcctgattctttctatcattatgttcagcgtgctgtgtccccggagaggccacaaaaagacggtctga

SEQ ID NO: 13294 - RNA, 3417 nt, synthetic construct
  misc_feature 1..3417: note = derived and/or modified CDS sequence (opt5) from ANDV(AH-1)__AF324901.2__GP
  source 1..3417: mol_type = other RNA
atggagggctggtacctggtggccctcggggtctgctataccctgacacttgctatgcccaagacgatctacgaactgaaaatggagtgtcctcacaccgttggactcggccaggggtatattatcggaagcacagaactgggccttatttccatcgaggccgcgtctgacattaagctggaaagctcctgcaacttcgatctccataccacatctatggctcaaaagagctttacccaggtggagtggagaaagaaatccgacacaaccgatacgaccaatgccgcctctacaaccttcgaggctcagacaaagaccgtgaacctgcgggggacgtgtatcctggccccggaactctacgacacactgaagaaagtcaagaaaaccgtgctttgctatgatctgacatgtaatcagacccactgccaacccaccgtttacctcatcgctcctgtgctgacatgtatgagcattcgctcctgcatggccagcgtctttacgtctagaatccaggtgatttatgagaagacccattgtgttacaggacagcttatcgaaggccagtgcttcaaccccgcgcacaccctgacactctcccaacctgcccatacctacgacacggtgacactgcccattagctgctttttcacccctaaaaagtctgagcagctgaaggtcatcaaaacctttgagggcattctcacaaagaccgggtgtacagaaaatgctctgcagggatactatgtgtgcttccttggctcccacagcgagccgctgatcgtgccctctctcgaagatatccggtccgccgaggtcgttagccgcatgctggtgcaccctattggggaagaccatgatgctatccagaactcccaatcttaccttagaattgtgggacccatcacggccaaagtccctagcacctccagcacagacaccctgaagggcattgcgtttgccggggtgcccatgtattcttccttcagcacactcgttcggaatgctgatccggagtttgtgttctctcctggaatcatccccgagagcaaccactccgtctgtgacaaaaagaccgtgcctattacgtggaccggctacctgcccatctctggcgaaatggagaaagttacagggtgcaccgtgttttgtacactggccggacccggcgctagctgcgaagcctattccgagaatgggattttcaacatcagctctcctacctgtctcgtcaataaggtgcagcgcttcagaggatccgaacagaagattaactttatctgccaacgggtcgatcaggacgtggttgtgtactgtaatggccagaaaaaggtcatcctgacgaaaacacttgtgattgggcagtgcatctataccttcacaagcctgttttctctcatgccggacgttgcccattccctggctgtggagctttgtgtccccggactgcacggctgggcgaccgtgatgctcctgagcaccttctgctttggctgggtgctgattcctgccgttacactcatcattctgaagtgtcttcgcgtcctgacgttctcctgctctcactacaccaacgagagcaaatttaagttcatcctcgaaaaggtgaaagtggagtaccaaaagacaatggggtccatggtctgcgatgtgtgtcatcacgaatgcgagaccgctaaagaactggagtctcatagacagagctgtattaatggacagtgcccctattgtatgacaatcaccgaggccacggaatccgccctgcaggctcactacagcatctgcaaacttacaggccggtttcaagaggccctcaaaaagtctctgaagaaacctgaagttaagaaagggtgttatcgcaccctgggagtgttcagatacaagtcccggtgctatgtcggcctcgtgtggtgtctgcttctgacctgcgagattgttatctgggcggctagcgccgagacacccctcatggaatctgggtggtccgacaccgcccatggcgtgggagagattccgatgaaaacagatctggaactggactttagccttccttctagctccagctactcttatcgcagaaagctcacgaaccccgctaacaaggaggaatccatccctttccactttcagatggagaaacaggtcattcacgccgagatccagcccctgggccattggatggatgctaccttcaatatcaagacagccttccactgttacggggcgtgccaaaaatacagctatccttggcagacctccaagtgctttttcgaaaaagactaccagtatgagacaggatggggctgtaaccccggggattgcccgggagtgggcaccgggtgtacggcctgcggcgtttacctggacaagctcaaatctgtgggaaaggcttataagattatcagcctgaaatacacccggaaggtctgtattcagcttggcacagaacaaacctgcaaacatatcgatgccaatgactgtctggtgacaccttccgtgaaggtctgcattgttgggaccgtgtctaaactccagcccagcgatacactgctgtttcttggacccctcgagcagggcgggatcatcctgaagcaatggtgtaccacgtcctgcgctttcggagaccctggcgacattatgtctacaccgagcgggatgagatgtcccgaacacaccggctcctttcgcaagatctgcggattcgccaccacacctgtgtgcgagtatcagggcaacaccgtcagcgggtacaaacggatgatggcgacgaaggattcttttcagtccttcaatctgacagagccccacattaccacaaacaaactcgaatggatcgaccctgatggaaataccagagaccatgtgaacctggttcttaatcgcgatgtgagctttcaggacctgtctgataacccctgtaaggtcgacctccacacacaagccattgagggcgcttgggggtccggagtgggcttcaccctgacgtgcaccgttgggctgacagaatgtcctagctttatgacctctatcaaagcctgcgatcttgctatgtgttacggctccacagtggccaatctcgcccggggaagcaacaccgtcaaggtggttggcaaagggggacattccggcagctctttcaagtgctgtcacgacacggattgcagctccgaggggctgctggcttctgcgccccatctcgaaagagtgacaggatttaatcagatcgacagcgataaggtctatgacgacggcgccccgccttgtaccttcaaatgctggttcacaaagtccggcgagtggctgcttgggattctgaacggaaattggatcgtggtggtcgttctcgtggtgattctgatcctgtctattatcatgtttagcgtcctttgtccccgccggggccacaaaaagaccgtgtga

SEQ ID NO: 13295 - RNA, 3417 nt, synthetic construct
  misc_feature 1..3417: note = derived and/or modified CDS sequence (opt5) from ANDV(CHI-7913)__AY228238.1__GP
  source 1..3417: mol_type = other RNA
atggagggctggtacctggtggccctcgggatctgctataccctgacacttgctatgcccaagacgacctacgaactgaaaatggagtgtcctcacacagtcggactcggccaggggtatattatcggaagcaccgaactgggccttatttccatcgaggccgcgtctgacattaagctggaaagctcctgcaacttcgatctccatacaacctctatggctcaaaagagctttacacaggttgagtggagaaagaaatccgacaccacggataccacaaatgccgcctctaccacattcgaggctcagaccaagacggtgaacctgcgggggacatgtatcctggccccggaactctacgacaccctgaagaaagtgaagaaaacagtcctttgctatgatctgacctgtaatcagacccactgccaacccacagtgtacctcatcgctcctgttctgacgtgtatgagcattcgctcctgcatggccagagtgtttaccagccggatccaggtcatttatgagaagacacattgtgtgaccggacagcttatcgaaggccagtgcttcaaccccgcgcacacactgaccctctctcaacctgcccatacgtacgacacagttaccctgcccatttcctgctttttcacccctaaagagagcgagcagctgaaggtgatcaagacatttgaaggcattctcaccaaaacagggtgcacggagaatgctctgcagggatactatgtctgcttccttggctctcactccgaaccgctgatcgtgcccagcctcgaggatatccgctctgccgaagtggtctccagaatgctggttcaccctcgcggggaggaccatgatgctattcagaacagccaatcccaccttcggatcgtgggacccattaccgccaaggtgccttctacaagctccaccgacacactgaaaggcaccgcgtttgccggggtccccatgtacagctctctctccacgctggtgaagaatgctgatccggagttcgtttttagccctggaatcattcccgaatctaaccatagcgtgtgtgacaaaaagaccgtccctatcacatggaccggctatctgcccatctccggcgagatggaaaaagtgacagggtgcaccgttttctgtacgctcgccggacccggcgcttcttgcgaggcctacagcgaaaatgggatttttaacatctccagccctacatgtctggtgaataaggtccagagattccggggatctgagcagaagattaacttcatctgccaacgcgtggatcaggacgtcgtggtttattgtaatggccagaaaaaggtgattcttaccaaaacactggtcatcgggcagtgcatctacacctttacctccctcttcagcctgatgccggacgtggcccactctcttgctgttgagctgtgtgtgcccggactccacggctgggcgacagtcatgctgctgtccacgttttgcttcggctgggtgctcattcctgccgtgaccctgatcattcttaagtgtctgagagttctcacatttagctgctcccattataccaacgaatctaaattcaagtttatcctggagaaggtcaaagtggaataccaaaagacaatggggagcatggtgtgcgatgtctgtcaccatgagtgcgaaaccgctaaagagctggagtcccaccggcagtcttgtattaatggacagtgcccctactgtatgacgatcacagaagccaccgagagcgcccttcaggctcattattccatttgcaagctcaccggccgcttccaagaagccctgaaaaagagcctgaagaaacctgaggtgaagaaagggtgttacagaacactcggagtttttcggtataagtctcgctgctacgtgggcctggtctggtgtcttctgctcacctgtgagatcgtgatctgggcggcttccgccgaaacacccctgatggagagcgggtggtctgacacggcccacggcgttggagaaattccgatgaaaaccgatctggagcttgacttctccctccctagctctagctcctatagctacagacggaagctgacaaaccccgctaacaaggaagagtctatctcctttcacttccagatggagaaacaggtgattcatgccgaaatccagcctctgggccactggatggatgctacctttaatacaaagaccgccttccattgttatggggcgtgccaaaaatacagctacccctggcagacgtccaagtgcttctttgagaaagactatcagtacgaaaccggatggggctgtaaccctggggattgccccggagtcggcacagggtgtaccgcctgcggcgtgtatctcgacaagctgaaatctgttggaaaggcttacaagattatcagccttaaatatacaagaaaggtgtgtatccagctgggcaccgagcaaacatgcaaacacattgatgccaatgactgtctcgtcaccccgtccgtgaaggtgtgcatcgtcgggacggtttctaaactgcagcctagcgatacactgcttttcctcggacccctggaacagggcggggtgattctgaagcaatggtgtaccacctcctgcgcttttggagaccccggcgacatcatgtctacacctagcgggatgcgctgtccggagcacaccggctccttccggaagatttgcggatttgccacgacacccgtgtgcgagtaccagggcaacaccatcagcgggtataaaagaatgatggcgacaaaggattctttccagtcctttaatctcaccgaacctcatatcacagccaacaaactggagtggattgaccccgatggaaatacccgcgaccacgtcaaccttgtgctgaatcgggatgttagcttccaggacctctctgataacccttgtaaggtggacctgcatacgcaagctatcgaaggcgcctgggggtccggagtcggctttaccctgacatgcaccgtggggcttacagagtgtcccagcttcatgacctctattaaggcttgcgatctcgccatgtgttacggctccacggttgccaatctggctagaggaagcaacacagtgaaagtcgtgggcaaagggggacactccggcagctcttttaaatgctgtcatgacaccgattgcagctccgaagggctgctcgcgtctgcccctcacctggagcgcgttacaggattcaatcagatcgacagcgataaggtgtacgacgacggcgctcccccgtgtacctttaaatgctggttcaccaagtccggcgagtggcttctggggattctcaacggaaattggatcgtcgtggtggtcctggttgtgatcctgattctttctatcattatgttcagcgtgctgtgtcctcggagaggccacaaaaagacagtctga

SEQ ID NO: 13296 - RNA, 3417 nt, synthetic construct
  misc_feature 1..3417: note = derived and/or modified CDS sequence (opt5) from Hu39694(Hu39694)__AF028023.1__GP
  source 1..3417: mol_type = other RNA
atggagggctggtacctgatcgtgctcggggtctgcagcaccctgacacttgccatgcccagaacgatttatgaactgcggatggagtgtcctcacaccgttggactcggccaggggtacatcattggatccacagaactgggccttatcccgattgagaccgtgtctgacctgaagctcgaaagctcctgcaacttcgatctgcatacaacctctatgacacagaaaagctatacccaggtggagtggcgcaagaaatccgacacgaccgatacaaccaatgctgcctctacaacctttgaggcgcagacgaagacagtcaacctgagagggacctgtgtgctcgctagcgaactgtacgacacacttaaaaagatcaagaaaaccgttctgtgctatgatctcacctgtaatcagacacactgccaacccacggtgtacctgatcgcccctgtctccacctgtatgagcattcggtcttgcatggcctccgtgttcacaaaccgcatccaggttatttatgagaagacccattgtgtgacaggacagcttgtcgaaggccagtgctttaatcccgctcacaccctgacgctcagccaacctgcccatacatacgagatggtgaccctgcccgtgacctgtttctttacacctaaaaagtctgaccagctgaaactcatcaagaccttcgagggcattatctccaagacagggtgcacggaaaacgctctgcagggatactatgtctgctttcttggcagccactctgagccgctgcacgttccctccctcgaagatattagaagcgtggaggtgttctcccggatgatcatccatcctcgcggggaagaccacgatcccattcaaaattctcaaggatttctgagaatcgtcggccctattaccgccaaagtgcccagcacatccagcaccgacacacttaaggggaccgcgttcgccggagttccgatgtactcttccctgagcacgctcgtgcggaccacagatcctgagtatgtcttttctcccggcatcattcctgagagcaaccattccacctgtgacaaaaagacaatccccctgacctggacgggctacctgcccatcgctggggaaatggagaaagtgacaggatgcaccgttttctgtacactcgccggccctggggcttcttgcgaagcctatagcgagcacggaatttttaatatctccagcccgacctgtctggtgcacaaggtccagaaattccgcggctctgaacagaagattaacttcatctgccaaagagtggatcaggacgtcgtggtttactgtaatgggcagaagaaagtgattcttaccaaggacctggtcatcggacagtgcatctatacatttacgtccctcttcagcctgatgcccgatgtggcgcattctcttgccgttgagctgtgtgtgcctggcctccacggctgggctaccgtcatgctgctgtccacattttgcttcgggtggattctcatccccgccattaccctggtggtgcttaaatttctgaagatggctacattcagctgttcccattacaccaacgagtctaaatttaagttcatcctcgaaaaggttaaagtcgagtaccaaaagacgatgggaagcatggtgtgcgacatttgccaccatgaatgtgagacagccaaagaactggagtcccacaagcagtcttgcatcaatggccagtgtccttattgcatgaccatgaccgaggccacagaaagcgctctgcaggcgcactactccatttgtaaacttaccgggcggtttcaagaggccctcaaaaagagcctgaagcgccccgaagtgaagaaaggatgctatagaacactgggcgtcttccggtacaagtctcgctgttatgtggggctcgtttggtgcgtgctgcttacgtgtgagctgatcgtctgggctgcctccgccgagaccccgctcctggaaagcggctggtctgatacagctcatggagtgggcgaggttcctatgaaaaccgacctggaacttgatttttccctccccagctctagctcctacagctatagacggaagctgacaaaccctgccaataaggaggaatctatccccttccactttcagatggagaaacaggtgattcatgcggagatccagaccctggggcactggatggacgctacgttcaacattaagaccgccttccactgctacggagcctgtcaaaaatactcctatccttggcagacagctaagtgctttttcgaaaaagattaccagtatgagaccggctgggggtgcaaccccggagactgtccgggctttgggacaggctgcaccgcctgtggagtctacctcgataagctgaaaagcgtgggcaaggcttataagatcatttcccttaaatacacaagaaaggtttgcatccagctggggaccgaacaaacgtgtaaacatatcgacgccaatgattgcctcgtgacaccttctgtcaaggtgtgtattatcggaaccgtgagcaaactgcagccctccgacaccctgcttttcctcggccccctggagcagggagggattctgctcaagcaatggtgcacaacctcttgtgcgtttggcgaccctggggatatcatgagcacgacatccggcatgcgctgcccggaacacaccggatctttccggaagatttgtggctttgccacaacccccgtctgcgagtatcaggggaacacaatcagcggatacaaaagaatgatggctaccaaggactccttccagagctttaatctgacggatcctcatatcaccacaaacaaacttgagtggattgaccccgatggcaatacccgcgaccacgttaacctggtgctcaatcgggatgtgtctttccaggacctgtccgataacccttgcaaggtcgacctgcatacacaagccatcgaaggggcttggggaagcggcgtggggtttacccttacgtgtacagttggcctcaccgagtgcccctctttcattacatccatcaaagcctgtgatatggcgatgtgctacggaagcaccgtgtctaatctggccagaggctccaacaccgtcaaggtggttgggaagggaggccacagcgggctgcactcccgctgttgccatgacacagattgtagctctgaaggactcgtggctagcgcccctcacctggagcgggtcacgggctttaatcagattgactccgacaaagtgtatgatgacggcgctcccccgtgcaccttcaagtgttggttcacaaaatctggggaatggcttctgggaatcctcaacggcaattggatcgttgtggtcgtgctggtggtcgttctgatttttagcatcattcttttcaacatcctgtgccctagacgcgggcataagaaaaccgtgtga

SEQ ID NO: 13297 - RNA, 3417 nt, synthetic construct
  misc_feature 1..3417: note = derived and/or modified CDS sequence (opt5) from LECV(Of22819)__AF028022.1__GP
  source 1..3417: mol_type = other RNA
atggagggctggtacctgatcgtgctcggggtctgcagcaccctgacacttgccatgcccaagacgatttatgaactgaaaatggagtgtcctcacaccgttggactcggccaggggatcattgtgggatccacagaactgggccttatcccgattgagaccgcttctgacctgaagctcgaaagctcctgcaacttcgatctgcatacaacctctatgacacagaaaagctacacccaagtggagtggagaaagaaatccgacacgaccgatacaaccaatgccgcggctacaacctttgagtctcaggccaagacggtcaacctgcgggggacatgtgtgctcgccgctgaactgtatgacacccttaagaaagttaagaaaacagtgctgtgctacgatctcacctgtaatcagacccactgccaacccacagtctatctgatcgcccctgtgatcacgtgtatgagcattcgctcctgcatggctagcgttttcatctctcggattcagatcatttacgagaagacccattgtgtgacaggacagcttatcgaaggccagtgctttaaccccgcccacaccctgacactcgcgcaacctgcccatacctatgagacggtcacactgcccgtgacctgtttctttacccctaaaaagtccgaccagctgaagctcattaaaacattcgagggcatcatcagcaagaccgggtgcacagaaaatgctctgcagggatactacgtgtgctttcttggctctcactccgagccgctgcacgtccccagcctcaaagatattagatctgccgaagttgtgacgcgcatgatcgtgcatcctagaggggaggaccacgatcccattcagaactcccaaggatatctgcggatcgtcggccctcttaccgctaaggtgcccagcacatcctctagcgacaccctgcaggggacagccttcgcgggagttccgatgtactccagcctctctaccctggtgcgcaatacggatcctgaatttgtcttctcccccggcattatccctgagagcaaccattctgcctgtgacaaaaagaccatccccctgacatggaccggctatctccccattagcggggagatggaaaaagtgacaggatgcaccgtgttttgtacgctggctggccctggggcctcctgcgaggcttactctgaaagcggaatcttcaatatttccagcccgacatgtcttgttaacaaggtccagaagtttagaggctctgagcagaaaatcaatttcatttgccaacgggtggatcaggacgtcgtggtttattgtaacgggcagaagaaagtgatcctgaccaagacactcgtcatcggacaatgcatttacaccttcacctccctgtttagccttatgcccgacgtggcccactctctggccgttgaactctgtgtgcctggcctgcacggctgggctacagtcatgctgctctccacgttctgctttgggtggatcctgattcccgcgatcacccttgtggtgctgaaagttctcaaggtcgccacattcagctgttcccattataccaatgagtctaagtttaaattcattctggagaaggtgaaagtggaataccagaagacaatgggaagcatggtctgcgatatctgccaccatgagtgtgaaaccgctaaagagctggaatcccacaagcagtcttgcattaacggccagtgtccttactgcatgacgatgacagaggccaccgagagcgcccttcaagctcattttgccatctgtaagctcaccgggcgcttccaggaagcgctgaaaaagtccctgaaaaagcccgaggtgagaaaaggatgctatcggacactcggcgtttttcgctacaagagcagatgttatgtggggctggtctggtgcgtgcttctgacctgtgaactcatcgtttgggctgcctctgccgagacaccgctgctggagtccggctggagcgacacggctcacggagtgggcgaagtccctatgaagaccgatcttgagctcgacttctctctgccctccagctctagctactcctatcggcgcaaactgacaaatcctgccaacaaggaagagagcattccctttcacttccagatggaaaaacaggtgatccatgctgagattcaaaacctcgggcactggatggatgccacctttaatatcaagacagcgttccattgctacggagcctgtcagaaatattcttacccttggcagaccgctaagtgcttctttgagaaagactaccagtatgaaacgggctgggggtgcaaccccggagattgtccgggcgttgggaccggctgcacagcctgtggagtgtacctggacaaacttaagtccgtcggcaaggcttataagattatcagcctgaaatacaccagaaaggtgtgcatccaactcgggacagagcagacctgtaaacacattgatgccaatgactgcctggtgacaccttccgtcaaggtttgtatcgtgggaaccgtgtctaagctgcagcccagcgatacgcttctcttcctgggccccctggaacaagggggaattatcctcaaacagtggtgcacaacctcctgtgcgtttggcgaccctggggacattatgtctaccacaagcggcatgcggtgcccggagcacaccggatccttcagaaagatctgtggctttgccacgacacccgtctgcgaatatcaggggaacaccatctctggatacaaacgcatgatggctacaaaggatagcttccagtcctttaatctgaccgaccctcatattacaaccaacaaacttgagtggatcgatcccgacggcaatacgcgggatcacgtgaacctggttctcaatagagacgtgagcttccaagatctgtctgacaacccttgcaaggtcgatctgcatacccaggccattgagggggcttggggatccggcgtggggtttacacttacctgtacagttggcctcaccgaatgccccagcttcatgacgtctatcaaggcctgtgacctggccatgtgctatggatccacagtgcacaatctggctcgcggcagcaacaccgtcaaagtggttgggaagggaggccattctgggtccagctttaaatgttgccacgatacagactgttccagcgagggactcgtggcgtctgcccctcacctggaacgggtcaccggcttcaatcagattgatagcgacaaggtgtacgacgatggcgctcccccgtgcacctttaaatgttggttcacaaagtccggggagtggcttctgggaatcctcaacggcaattggatcgtggtcgttgtgctggtggtcgtgctgattttctctatcattctttttagcatcctgtgccctagacgcgggcataagaaaacggtttga

SEQ ID NO: 13298 - RNA, 3417 nt, synthetic construct
  misc_feature 1..3417: note = derived and/or modified CDS sequence (opt5) from ORNV(Ol22996)__AF028024.1__GP
  source 1..3417: mol_type = other RNA
atggagggctggtacctgatcgtgctcggggtctgcagcaccgttacactggccatgcccaagacgatttatgaacttaaaatggagtgtcctcacaccgtgggactgggccaggggtacatcattggatccacagaactcaacctgatcccgattggcgctgcctctgaccttaagctggagagctcctgcgatttcgacctctataccacacccatgacccaaaaatcttacacacaggtggaatggagaaagaaaagcgagaccacggataccacaaatgcggctgccaccacatttgagtcccagaccaagacggtcaacctgcgggggacatgtatcctggcctctgaactctatgacaccctgaataagatcaaaaagcctgtgctttgctacgatctgaactgtaatcagacacgctgccaacccaccgtttatctcattgctcctgtgatcacctgtatgagcattagatcctgcatggccagcgtctctaactcccggatccagattatctacgagaaaacacattgtgtgacgggacagctggttgaaggccagtgcttcaatcccagccacacccttacactggctcaacctgcccatacctacgagacagtgaccctcccggtcacgtgctttttcacacccaagaaatctgaccagctgaagctggtgaagacctttgagggcattatcaccaaaacagggtgtaccgaaaacgcgctccagggatattacgtgtgcttcctgggctcccacagcgagcctcttcatgtcccctctctggaagatatccgctccgccgaggttgtgagcagaatgattgtgcaccctcggggagaagaccacgatcccatccagaatagccaaggacatctccgcattgtcggcccgatcacagctaaggtgccttctacgagctccagcgacaccctgcaggggacagccttttctggagttcccatgtattccagcctttctaccctggtgagaagcgctgatcctgagttcgtcttttcccccggcattctccccgagtctaaccacagcgtgtgtgacaaaaagacactgcctctgacctggacgggctacctcccgatctccggggaaatggagaaagttaccggatgcacagtgttctgtaccctggccggccccggggcgagctgcgaagcctattctgagaatggaatctttaacatttccagccctacatgtcttgtcaataaggtgcagaaattccggggctctgaacaaaagatcaactttatttgccagcgcatggatcaggacgtcgtggtttactgtaatgggcagaagaaagtgatcctgaccaagacgctcgtcattggacaatgcatctatacattcacctccctgttcagccttatgcccgacgtggctcattccctggccgttgagctctgtgtgcctggcctgcacggctgggctacagtcatgctgctctctaccttttgcttcgggtggatcctgattcccgccatcacccttgtggtgctgaaatttctcaagatggccacattcagctgttcccactacacgaacgagtctaaatttaagctgattctggaaaaggttaaagtcgagtaccagaagaccatgggaagcatggtgtgcgatatctgccatcacgaatgtgagacagctaaagtgcttgaatcccataagcagagctgcattaacggccagtgtccgtattgcatgaccatgacagaggcgaccgagtctgccctccaagctcactactccatctgtaaactgacggggagattccaggaagccctgaaaaagagcctcaagaagcctgaggtcaaacggggatgctatcgcacactgggcgtgtttagatacaagtctcggtgttatgttgggcttgtgtggtgcgtcctgctcacctgtgaactgattgtgtgggccgcttccgccgagacacccctgcttgagagcggctggtctgacaccgcgcatggagttggcgaaatccctatgaaaaccgatctcgagctggacttcagcctgccctcctcctcttcctacagctatcgcagaaagctcacaaatcctgctaacaaggaagagtccatcccctttcacttccagatggaaaaacaggtgattcacgccgagatccaaacgctggggcattggatggatgccacctttaatattaagacagctttccactgctacggagcctgtcagaaatactcttatccgtggcagaccgctaagtgctttttcgagaaagactaccagtatgaaacaggctgggggtgcaaccctggagattgtcccggcgtcgggaccggctgcacggcctgtggagtgtaccttgacaagctgaaaagcgttggcaaggcgtataagatcatttccctcaaatacacccggaaggtgtgcatccaactggggacagagcagacctgtaaacatatcgatgccaatgactgcctggtcacaccctctgtgaaggtgtgtattgtcggaaccgttagcaaacttcagccttccgatacactcctgttcctgggcccgctcgaacaagggggaatcattctgaagcagtggtggaccacgtcttgcgcttttggcgaccccggggacatcatgagcacaacctccggcatgagatgtcctgagcacaccgggagcttccgcaagatttgcggctttgccacaacccccgtgtgtgaatatcaggggaacacgatctctggatacaaacggatgatggctacaaaggattccttccagagctttaatcttaccgaccctcacatcacaaccaacaaactggagtggattgatcccgacggcaatacaagagatcatgtgaacctcgtcctgaatcgcgacgtgtctttccaagatctgtccgacaacccttgcaaggttgatcttcacacccaggccatcgagggggcgtggggaagcggcgtggggtttacgctgacctgcacagtcggcctcaccgaatgtccctctttcatgacatccattaaagcctgcgacctggctatgtgttacggaagcaccgtgacgaatctcgcccggggctccaacacagttaaggtggtcgggaagggaggccatagcgggtctagctttaaatgctgtcacgataccgactgctcctctgagggactggtggctagcgccccgcatcttgaaagagttacaggcttcaatcagatcgattccgacaaggtgtatgacgatggcgcccctccctgtacctttcgctgctggttcaccaaatctggggagtggctgctcggcattctgaacggaaactggatcgtcgtggtggtcctgatcgttgtgcttatttttagcatcgtgctgttctccattctctgtcctcggagagggcacaagaaagctgtctga

SEQ ID NO: 13299 - RNA, 3426 nt, synthetic construct
  misc_feature 1..3426: note = derived and/or modified CDS sequence (opt5) from BCCV__L39950.1__GP
  source 1..3426: mol_type = other RNA
atgggcagactgtacctcatcgtgctgggggtccttattaccgccacagctggattcccccggagcgttcacgagctgaagatcgaatgccctcatacggtggtgctcggccaggggtatgtcaccggatccgtggagctgggctttattgcccttgaccaagttacagatctgaaaatcgaatctagctgttccttcgaccaccatgcggctccgaccacaacccagaactttacacagctcaagtgggccaaaaccgcctctacgaccgatacaaccaatgctgccgagacaaccttcgaaagcaagtccacggaggtgcacctgaaaggggtctgcacaattccctctaacgtgctggacggacctagccgccccgttaccggcagaaagacagtggtctgttacgatctcgcttgcaatcagacccattgtcaacctaccgtgcatctgcttgcccccatccagacatgcatgtccgtgcggagctgtatgatctctctgctcgcgtcccgcattcaggtcgtttatgagaagacgtactgcgtgaccggccagctgatcgaagggctttgttttaaccctgtgccgaatctggccctcacacaacccggacacacctatgacacattcaccctgcctattacgtgctttctggtcgctaaaaagggcgccaacctcaaaatcgctgtggagctggaaaagctcacaaccaaaaccgggtgtgccgagaatgcgctgcaggcctactatatttgcttcatcggacagcacagcgagcccctcacagttcctatgctggaagattacagatctgctgagatttttacccggatcatgatgaaccccaagggcgaagaccacgatatggagcagtccagccaaggggcccttcgcatcgtgggaccgattaagggcaaagtccctcccacagaaacgtctgacaccgtgcagggcatcgctttcgccgggctgcctatgtactccagcttttcctctctcgttagaaaggccgagcccgagtatctgttcagccccggaattatcgctgaatccaatcatagctcttgcgataaaaagacactgcctctcacctggcggggctttctgtccatgagcggggagattgaacgcatcacaggatgtaacgtgttctgcacccttgcgggcccgggggcctcttgtgaggcttacagcgaaaatggaatcttcaacatttcctctcccacgtgcctggtcaataaagtgcagaagtttagaggcagcgagcaacggatcaacttcatttcccagcgcatcgaccaggatgtcattgtgtattgtaatggccagaaaaaggttatcctcaccaagacactggtgatcgggcaatgcatttacacctttacaagcatcttctctcttattccttccgtcgcccacagcctggccgtggagctctgtgttcccggaatccacggctgggctaccattgccctggtgatcacgttttgcttcgggtggctgctcattcctacaaccacaatggtcgtgctgaaatgtcttagactgctcacctattcttgctcccattacagcaccgaatccaagtttaaagtgatcctggagaaggttaaagtcgaatatcagaagacaatgggatctatggtgtgtgacatctgccaccatgagtgcgaaacggcgaaggagctggagagccacaaaaagtcctgtgctgacggccagtgcccctactgtatgaccattacagaagccaccgagtctgcccttcaggctcattacgccgtgtgcaaactcacagggcggttccacgaagctctgaagaaaagcctgaagaagccggaggtccaacgcggctgttatagaaccctcggagtgtttcggtacaaatccagatgctatgttggcctggtgtggatgtgtcttctgacgctcgagctgatcgtctgggccgcgagcgccgatacacctctgcttgaacccgggtggtctgacaccgctcacggagtgggcgatattcctatgaagaccgacctcgagctggatttcgccatcccctcctcttcttcctacagctatcgccggagactggttaaccctgctaactctgacgaaacagtgccctttcatttccagctcgagcgccaggtcattcacgccgaaatccagagcctggggcattggatggatgcgacctttaatatcatttccgccttccactgctacggagagtgtaaaaagtatagctacccgtggcaaacagctaaatgcttctttgagaaggactaccagtatgaaacgtcttggtcctgtaaccctcccgattgccccggcgtggggaccggctgcacagcctgtggaatctaccttgacaagctgaaaagcgttggcaaggcttataaagtgattaccctcaagtacgcccggaaagtctgcatccagctggggacagagcagacctgtaagaatattgatgtgaacgactgcctggtgacgtcctctatcaaagtctgtatgatcggaaccattagcaagttccaacctggcgacacacttctctttctggggccgctggaagagggaggcctcgttctgaagcagtggtgcaccacaacctgttccttcggggatcccggcgacatcatgtctacaaccagcggaatgagatgccctgaacacacgggctcctttcgcaaaatttgtgggttcgccacaacccccgtgtgcgagtatcagggaaataccgtgtctggctttaagcggcttatggctacaaaagatagcttccaatcctttaacgtcagcgaggtgcatatcaccacgacaaagctggaatggtctgaccctgattccaatattaaagaccacatcaacctcatcctgaatagagatgttagcttccaggacctgtctgataacccctgtaaggtggacctttccacccaggcgattgatggggcctggggaagcggcgtcgggtttacacttacctgcatcgtgggcctgacagagtgcagctccttcatgaccagcattaaggtttgtgacatggctatgtgctacggagcctccgtggtcaatctggtgcgcggcagcaacacggttaaaatcgtggggaagggaggccattctgggagcacctttcggtgttgccacgataaagactgtacatccaatggactcctggcctctgctcctcatcttgaaagagtcaccggcttcaaccagattgacagcgataaggtgtatgacgatggcgcgcccccgtgctccatcaaatgttggttcgccaagtctggggagtggctgctcggcattctgaatggaaactgggtggtcgttgctgtgctggtgatcatccttctgattagcatctttctcttctcctttttctgccctattcgctctcacaagaaacaactgtga

SEQ ID NO: 13300 - RNA, 3408 nt, synthetic construct
  misc_feature 1..3408: note = derived and/or modified CDS sequence (opt5) from DOBV(DOBV/Ano-Poroia/Afl9/1999)__NC_005234.1__GP
  source 1..3408: mol_type = other RNA
atgatcatgtggggcctgctcctgaccatgattcttatcgacttcggggccagcctgagaaacgtgtacgatatgaagattgagtgcccccactccatcaattttggagaatctagcgtcacaggcaaagttgagctccctccgctgcttctgacggacgctgaagccctcgtgcccgagtcctcttgtaacatggataatcatcagagcatgtccattatccaaaaggtgaccaaagtctcttggcggaagaaagcggacaaggctcaggccgccaaggatagcttcgaaacaacctccagcgaggtgaacctgaaagggacatgcgctctgtctcaccgcatggttgaggaatcctatagaaatcggcgcagcgtgatctgttacgacctctcttgcaactccacccattgtaagcctacaatgcacatgattgtccccgtgcatagctgcaatatgatgaaatcttgtctggttggacttggcccttatagaatccagattgtgtacgagcggacctattgcacgaccgggatcctgacagaaggaaagtgttttgtccccgatcagtccattgtgaacgtgatcaaaaatggcgtcttcgacattgccagcgtttccatcgtgtgctttttcatccgcgtgaagggcaccaactacaagattatggcttctatcaaaacagccaccgcgaataactgtaatgatacggacaacaaggtccaagggtattacctctgcattgtgggaggcaatagctcccctgtttacgccccgagcacaaccgattttagatctatggaggctctggcctcccttctgcgggctccccacggggaggaccacgatctcagcggagaagaggtggccacatattctatcgcgggccagattgaagggaaaatccctcataccgccaacgctgccaacatgctgttcaccgcttttagcggaatcccctcctactctagcctgtccgtcttcattggcagccaggacggccctgtgatctattctcccgggctctttccgcgcctgaatcagtccagctgcgacaagattgcccttcctctgatctgggagggatacattgatctccccggctattacgaaacagttcacccttgtaacgtgttctgcgtcctgtctgggcccggagcctcctgtgaggcttttagcgagggcgggatcttcaatatcacgtcccccacatgccttgtgtctaaacaaaacagattccgggcggccgaacagcaggtcaattttgtgtgtcagcgcgttgaccaagatattgtgatctattgcaacggacagaagaaaacaattctgaccaagacactcgtcatcggccagtgtatttacagcgtgacctccctgttctctatcatgcctggcgttgctcatagcattgccatcgagctgtgcgtgccggggtttcacggatgggccacggctgccctcctgacaaccttctgttttggctggatccttattctgtccatcaccctcgcggtcctggtggtgcttaagttctttgctgccattctgcacaatagctctcaagaaaacagattcaaaatcattctccggaagatcaaagaggaatttgagaagacaaaagggtccatggtttgcgaggtctgtaagtacgaatgcgagaccggaaaggaactgaaagcccataatctgagctgcccccagtctcagtgtccttattgcttcacacactgtgagcccacggaatccgcttttcaggcccattacaaggtgtgccaagctacccaccgcttcagagacgatctcaaaaagacaatcacccctcagagcacatctcccggctgttatcggaccctgaacctttttagatacaaaagccgctgctatattttcacggtgtgggtcaccctgctcatcattgagtccatcatgtgggccgcgagcgcctctgagacagtgctggaaccgtcctggaatgacaacgctcatggggttggcgtggtccctatgcacaccgatctggagcttgacttcagcctcccctcctctagcaagtacacatataagcggaaactgacctcccctctgaatcaggaacagtctgtggatctccacattgagatcgagagccaaggaatctccacgtctgttcatgccctgggccactggtttgacgggagacttaacctgaagaccagcttccattgttacggagcttgcaccaaatacgaatatccctggcacacagccaagtgtcactttgagcgcgatttcgaatacgagaataactggggctgcaaccctgcggactgtcccgggattggaaccggctgcaccgcctgcgggctctatatcgaccagctgaaaccggtgggctccgcttacaagctgattacagtccggtatagcagaaaggtgtgtgttcagtttggagaagagaatctttgcaaaacgatcgatatgaacgactgtttcgtgacccgccatgtcaaggtgtgcattatcggcacagtgtctaaattttcccagggggataccctcgtcttcctgggacctatggagggcgggggactgatctttaaggactggtgtacatctacctgccaattcggcgatcccggggacattatgagccccaaagataagggcttttcctgtcctgacttcacgggacactttcggaaaaagtgcaatttcgccacaaccccggtttgtgaatacgatggcaacatggtgagcgggtataagaaagtgatggctaccatcgactctttccagtcctttaatacaagctccattcattacaccgatgagagaatcgaatggaaggaccccgatggaatgctcaaagaccacctgaacattcttgtcacaaaggacatcgatttcgagaatctgggcgaaaacccttgcaaagtggggctccagacgagctctattgagggagcctggggcagcggggttggctttaccctgacatgtcagatctccctgaccgagtgctctcgcttccttacaagcatcaaggcctgcgacatggctatttgttacggagcgcaatccgtgaccctcatccggggccagaatacggtcaaggtgtctgggaaaggaggccatagcgggtcctcttttaagtgctgtcacggaaccgattgcagccagcaaggcctgcaggcctccgctccccacctggacaaagttaacggcattgtggaacaggagagcgaaaaggtctatgatgacggggcccctcagtgtggaatctcttgctggttcgtgaaatccggcgagtggattacagggatctttaatggaaactggatcgttattgtggtcctcgtgttctttttcatcctgagccttattctgctctctctgctgtgtcccatcagaaagcataagcgctcctga

SEQ ID NO: 13301 - RNA, 3408 nt, synthetic construct
  misc_feature 1..3408: note = derived and/or modified CDS sequence (opt5) from DOBV(DOB/Saaremaa/160V)__AJ009774.2__GP
  source 1..3408: mol_type = other RNA
atgatcatgtggggcctgctcctgaccatgagccttattaacctgggggcctccctcagaaatgtgtacgacatgaagatcgagtgcccccactctattaacttcggagaaagctccgtcacaggcaaagttgagctgcctccgatccttctgacggatgctgaagccctcgtgcccgagtctagctgtaatatggacaaccatcagtccctgtctattacccaaaaggtgacaaaagtcagctggcggaagaaagcggatcaggtgcaggctgccaaggactcctttgaaaccacaagcaatgagatcaacctgaaggggacctgcacactcacccaccgcatggttgaggaatcttatagaaatcggaaatccgtgatctgttacgatctgagctgcaactctacgcattgtaagcctaccatgcacatgattgtccccgtgcattcctgcaatatgatgaaaagctgtcttgttggactgggcccttatcgcgtgcaggtcgtgtacgagagaacatattgcaccacagggatcctcaccgaaggaaagtgtttcgtgcccgaccaatctattatctccgtcattaaaaacggcgtttttgatatcgccagcgtgtccattgtgtgcttctttatccgggtcaagggcacgtcttacaagatcatggctagcattaaaacatccaatcctaacaattgtaacgacaccgataataaggtgcaggggtattacctgtgcatcgttggagccaacagctctccggtgtacgctccctccacaaccgacttccgcagcaccgaggcccttgcgtctctgctcagaagccctcacggcgaggatcacgacctgtccggggaagaggtcgccacatattctattgctggacagatcgaaggcaaaattccccatacggccaacgctgccaatatggcgtttaccgccttcagcgggatcccttcctacagctctctgtccgtgtttgctggaaaccaggatggcacaatcattttcagccccggcctctttccgaagctgaatcaatcttcctgcgacaaagttgcccttcctctgatctgggaggggtatattgacctccccggatactatgaaaccatccacccttgtaacgtgttctgcgtcctgagcggccccggggcttcctgtgaggccttttctgagggaggcattttcaatatcacaagccccacatgccttgtgtccaagcagaaccggttccgcgccgctgaacagcagatcaattttgtctgtcaaagagtggatcaggacattgttatctactgcaacgggcagaaaaagacgattctgacaaagaccctcgtgatcggacaatgtatttattctgtcaccagcctgttctccatcatgcctagcgtggcgcattctattgccatcgagctgtgcgttccgggctttcacggctgggctacagccgccctcctgaccacattctgttttgggtggatccttattccctccatcacgctggctgtgctcattgtcctgaaattctttgccgcgatccttcacaatagctctcaggaaaaccggttcaagattatcctgcgcaaaatcaaggaggaatttgagaaaaccaagggatccatggtgtgcgaggtgtgtaagtacgaatgcgagacaggcaaagaactcaaggctcataatctgagctgccctcagtctcagtgtccctactgcttcacccactgtgagctgacagaaagcgcctttcaagcccattatagagtttgccaggctacccaccggttccgcgatgacctcaaaaagacgattacccctcagtccacaagccccgggtgttacagaaccctgaacctttttcggtataaatctagatgctacatcttcacagtctgggtggtgctgctcattatcgagtccattctgtgggccgctagcgcctccgagctggtccttgaaccgaattggaacgataatgcgcatggagtgggcatcgttcctatgcacaccgacctcgagctggatttctctctgcccagctcctctaagtatacgtacaagcgcaaactcacaagccctatcaaccaggaacaatccattgacctgcacatcgagattgagtctcaggggatcagcacctccgtgcatgcccttggccactggtttgatggacggctgaacctcaagaccagcttccattgttatggcgcttgcaccaaatacgaatacccctggcacaccgccaagtgtcactttgagagagacttcgaatatgagaataactggtcttgcaatcctcccgattgtccggggattggaacaggctgcacggcttgcgggctgtacctggaccagcttaaacctgtcggatccgcctataagctcatcaccgtgcgctacagccggaaggtttgtgtgcagtttggcgaagagaacctgtgcaaaacaatcgacatgaatgattgtttcgtcaccagacatgtgaaggtttgcattatcgggacagtgtctaaattttcccaaggcgacaccctggtcttcctcggacccatggagggcgggggactgatttttaaggattggtgtacgacaacctgccagttcggcgaccccggggatatcatgagccctaaagacaagggattttcttgtccggatttcaccggccactttcgcaaaaagtgcaacttcgcgacaacccccgtgtgtgaatatgacgggaatatggtgtccggctacaagaaagtcatggccacaattgatagcttccaggcttttaacacgtcctatatccattacaccgacgagcagattgaatggaaggatcctgacggaatgcttaaagatcacctgaatatcctcgttacaaaggacatcgacttcgagaacctgggcgaaaatccctgccgggtggggctgcaaaccgccagcattgagggagcttggggctctggggtgggatttacacttacctgtcagatcagcctcacggagtgctccagattcctgacctctattaaagcctgcgatatggccatctgttacggcgctcagagcgtcacactggtgcgcgggcaaaacaccgttaaggtgtccggcaagggaggccattctgggagctcctttaaatgctgtcacggaaatgactgctctcagcagggcctccaggcgagcgcccctcacctggataaggtcaacgggattgtggaacaagagtccacacaggtttatgacgatggagctccccagtgtggcatcagctgctggttcatcaaatctggcgaatggattaaggggatcttttccggaaattggattgtgatcgtcgtgcttattgttctgttcatcctcagcctgatcctgctttcttttctctgtcctattcggaaacataagagatcctga

SEQ ID NO: 13302 - RNA, 3408 nt, synthetic construct
  misc_feature 1..3408: note = derived and/or modified CDS sequence (opt5) from DOBV(East Slovakia/400Af/98)__AY168577.1__GP
  source 1..3408: mol_type = other RNA
atgatcatgtggggcctgctcctgaccatgattcttatcgacttcgggacaagcctgagaaacgtgtacgatatgaagattgagtgcccccactccatcaattttggagaatctagcgtcacgggcaaagttgagctccctccgctgcttctgaccgacgccgaagccctcgtgcccgagtcctcttgtaacatggataatcatcagagcatgtccattatccaaaaggtgacaaaagtctcttggcggaagaaagccgacaaggcgcaggctgccaaggatagcttcgaaaccacatccagcgaggtgaacctgaaagggacctgcacactgtctcaccgcatggttgaggaatcctatagaaatcggcgcagcgtgatctgttacgacctctcttgcaactccacccattgtaagcctacgatgcacatgattgtccccgtgcatagctgcaatatgatgaaatcttgtctggttggacttggcccttatagaatccaggtggtctacgagcggacctattgcacaaccgggattctgacagaaggaaagtgttttgtgcccgatcagtccatcgtgaacgtcattaaaaatggcgttttcgacatcgccagcgtgtccattgtgtgctttttcatccgcgtcaagggcaccaactacaagatcatggcttctattaaaacggccacagctaataactgtaatgataccgacaacaaggtgcaagggtattacctctgcatcgttggaggcaatagctcccctgtgtacgccccgagcacaaccgattttagatctatggaggcgctggcctcccttctgcgggctccccacggggaggaccacgatctcagcggagaagaggtcgccacctattctattgctggccagatcgaagggaaaattcctcatacagccaacgcggccaacatgctgttcacggcttttagcggaatcccctcctactctagcctgtccgtgtatatcggcagccaggacggccctgttgtgtactctcccggactcttcccgaagctgaatcagtccagctgcgacaaagtcgcccttcctctgatttgggaggggtatatcgatctccccggctactatgaaaccgtgcacccttgtaacgtcttttgcgtgctgtctgggcccggagcttcctgtgaggccttcagcgagggcgggatttttaatatcacatcccctacctgccttgtttctaagcaaaaccgcttcagagccgctgaacaacaggtgaatttcgtctgtcagcgggtggaccaggatattgttatctactgcaacggacagaaaaagacaatcctgaccaagacgctcgtgattggccagtgtatctacagcgtcacatccctgttttctattatgcccggcgtggcgcatagcatcgccattgagctgtgcgtgccggggttccacggatgggctaccgccgccctcctgaccacattttgtttcggctggatccttattccctccatcaccctggctgttctcgtcgtgctgaaatttttcgccgcgatccttcacaatagctctcaagaaaaccgctttaagattatcctgagaaaaattaaggaggaatttgagaaaacaaaggggtccatggtgtgcgaggtctgtaagtatgaatgcgagacgggaaaagaactcaaggctcataatctgagctgccctcagtctcagtgtccctactgcttcacccactgtgagcctacagaatccgccttccaggcccattataaagtgtgccaagctacccaccggtttcgcgacgatctgaagaaaacaatcacgccccagagcacctctccgggctgttacagaaccctcaacctgttccggtataagagcagatgctacatttttacagtttgggtgacccttctgatcatcgagtccattatgtgggccgctagcgcctctgagaatgtcctcgaaccttcctggaacgacaatgcgcatggggtgggcgttgtgcccatgcacacagatctggagctggacttcagccttccttcctctagcaagtatacctacaaacgcaagctcacgtctcccctgaaccaggaacagtccgtcgatctgcacatcgagattgagagccaaggaatctccacatctgtgcatgccctcggccactggttcgacgggcggctgaatcttaaaaccagctttcattgttacggagcttgcacaaagtatgaatacccttggcacaccgccaaatgtcacttcgagagagattttgaatatgagaactcctggggctgcaaccccgctgactgtccggggattggaaccggctgcacagcctgcgggctgtacatcgaccagctcaagcctgttggcagcgcgtataagctgatcacggtgcgctactctcggaaagtctgtgtgcagttcggagaagagaatctgtgcaagaccattgatatgaacgactgttttgtgacaagacatgtcaaagtttgcatcattggcaccgtgtccaagttcagccagggggatacacttgtgtttctcggacccatggagggcgggggactgatcttcaaagactggtgtacctctacgtgccaatttggcgatcccggggacattatgtcccctaaggataaaggcttcagctgtccggactttacaggacacttccgcaagaagtgcaattttgccaccacccccgtctgtgaatatgatggcaacatggtgtctgggtacaaaaaggttatggctacaatcgactccttccagagcttcaatacctccagcatccattacacagatgagcggattgaatggaaagaccctgatggaatgctgaaggaccacctcaacatcctggtgacgaaagacattgattttgagaatcttggcgaaaacccctgcaaggtcgggctgcagacctctagcatcgagggagcctggggctccggggtgggcttcacactcacctgtcagatttctctgacagagtgcagcagatttctgacctccatcaaggcttgcgacatggccatttgttatggagcccaatctgttacgcttatccgcggccagaataccgtgaaagtcagcgggaagggaggccattccgggtctagcttcaaatgctgtcacggaacagattgctcccagcaaggcctccaggctagcgcgcctcacctggacaaggtgaacggcatcgttgaacaggagtctgaaaaagtgtacgatgacggggctccccagtgtggaatttcctgctggtttgtcaagagcggcgagtggatcaccgggattttcaatggaaactggatcgtgattgtggtcctgatctttttctttatcctctctctgattcttctgtccctcctgtgtcctatccggaagcataaaagaagctga

SEQ ID NO: 13303 - RNA, 3408 nt, synthetic construct
  misc_feature 1..3408: note = derived and/or modified CDS sequence (opt5) from DOBV(East Slovakia/862Aa/97)__AY168578.1__GP
  source 1..3408: mol_type = other RNA
atgatcatgtggggcctgctcctgaccatgagccttattaacctgggggcctccctcagaaatgtgtacgacctgcggatcgagtgcccccactctattaacttcggagaaagctccgtcacaggcaaggttgagcttcctccgatccccctgacggatgctgaaaccctcgtgcctgagtctagctgtaatatggacaaccatcagtccctgtctattacacaaaaagtgaccaaggtcagctggcgcaaaaaggccgataaagtgcaggcggctaaggactcctttgaaacaaccagctctgagatcaatctgaaggggacatgcaccctcgcccacagaatggttgaggaatcctatcggaaccgcaaaagcgtgatctgttacgatctgtcttgcaattccacgcattgtaagcccaccatgtatatgattgtccctgtgcacagctgcaacatgatgaaatcttgtcttgttggactgggcccctacagaatccaggtggtctatgagcggacatactgcaccacagggattctcatcgaaggaaagtgtttcgtgcctgaccagtccattatcagcgtgattaaaaatggcgtctttgatatcgcctccgtttctatcgtgtgcttctttattcgcatcaagggcaacagctataagattatgaccaatatcaaaacggctaacccgaataactgtaatgacacagataacaaggtgcaagggtactacctgtgcattgtcggagccaactccagccccgtgtatgctccttctaccacagacttcagatccatggaggttcttgccagcctgctccggtctccccatggcgaggatcacgacctgagcggggaagaggtggcgacctactccatcgccggacaggtcgaaggcaaagtgcctcacaccgagaatgctgccaacatgctgtttacagctttctctgggatccccagctattccagcctctctgtttttgccggaaatcaggatggcacggtgatttactccccgggcctgttccctaaacttaaccagagctcttgcgaaaaagtcgcgctgcccctcatctgggaggggtatattgacctgcctggatactatgagaccatccatccctgtaatgtgttttgcgtcctttccggccccggggccagctgtgaggctttctccgaaggaggcatttttaacatcacatctcctacctgcctggtgagcaagcaaaatcgcttcagagccgctgaacagcagatcaacttcgtttgtcagcgggtggaccaagatattgtcatctactgcaatgggcagaaaaagacaattctcaccaagacgctggtgatcggacagtgtatttactccgttacatctctgtttagcatcatgccgggcgtggcccactccattgccatcgagctctgcgtccccggcttccatgggtgggctaccgcggccctgcttaccacattttgtttcggatggatcctgattcctagcatcaccctcgctattctgatcgtgcttaaatttttcgccgccattctgcacaactcttcccaagaaaatcgctttaaggtgatcctcagaaaaatcaaggaggagttcgaaaagacaaagggcagcatggtttgcgaggtctgtaagtatgaatgcgagacggggaaagaactgaaggctcacaacctgtcttgcccccagtcccagtgtccttactgctttacccattgtgagctcacagagagcgccttccaggcgcactatcgggtgtgccaagctacccatcgctttagagacgatctgaaaaagacaattacgccccagtctaccagcccgggatgttaccggacccttaatctgttcagatataaatcccgctgctacatctttacagtgtgggtcgtgctcctgattatcgaaagcattctgtgggccgcctctgcttccgagatcgttcttgaacctagctggaacgacaatgcccacggcgtgggggtcgtgcccatgcataccgatctcgagctggacttctccctgccttctagctccaagtatacatacaagcggaaactcacctctcccatcaaccaggagcagagcgttgatctgcacattgaaatcgagtcccaaagaatttctacgagcgtgcacgctcttggccattggttcgacggacgcctgaacctcaagacatcctttcactgttacggcgcctgcaccaaatatgaatacccttggcatacagcgcggtgtcacttcgagagagattttgaatatgagaatagctggtcttgcaaccccgccgactgtccggggatcggaaccggctgcaccgcttgcgggctgtacctggatcagcttaagcctgtcggatccgcctataaactcattacagtgcgctacagccggaaggtttgtgtgcagttcggcgaggaaaatctgtgcaagatcatcgacatgaacgactgttttgtctctagacacgtgaaagtgtgcattatcgggacggtctccaagttcagccagggcgataccctggtttttctcggacccatggagggcgggggactgattttcaaagactggtgtacaaccacatgccaatttggcgatcccggggacatcatgtctcctaaggataaaggattctcctgtccggactttaccggccatttccgcaagaaatgcaattttgctacgacacccgtgtgtgaatatgatgggaacatggtgagcggctacaagaaggtcatggccaccattgactccttccaggcgttcaataccagctacatccactatacagatgagcggattgaatggaaagaccctgatggaatgcttaaggaccatatcaacatcctggtgaccaaagatattgactttgagaatctcggcgagaacccctgcaaggttgggctgcagacagcctctatcgaaggagcttggggcagcggggtgggattcacgctgacctgtcagatttcccttacagagtgctctagatttctcaccagcatcaaagcctgcgacatggctatttgttacggcgcccaatccgtcacactggtgcgcgggcagaataccgttaaggtgtctggcaagggaggccacagcgggtcctctttcaaatgctgtcatggaacggattgcagccagcaaggcctgcaggcctccgctcctcacctcgacaaggtcaacgggatcgtggaacaggagagcacccaggtttatgatgacggagcgccccaatgtggcatctcttgctggtttattaaatccggcgaatggatcaaggggattttcaatggaaactggatcgtgattgtcgtgctgatctttttctttatccttagcctgattctcctgtctttcctgtgtcctatccggaaacacaagagatcctga

SEQ ID NO: 13304 - RNA, 3408 nt, synthetic construct
  misc_feature 1..3408: note = derived and/or modified CDS sequence (opt5) from DOBV(A35)__GU904036.1__GP
  source 1..3408: mol_type = other RNA
atgatcatgtggggcctgctcctgacccttagcctgatttccctcggggcctctctgagaaacgtgtacgaccttcggatcgagtgcccccacagcattaatttcggagaatcctctgtcacaggcaaggttgagctgcctccgatccccctcacggatgctgaaaccctggtgcctgagagctcctgtaacatggacaatcatcagtctctgagcattacacaaaaagtgaccaaggtctcctggcgcaaaaaggccgataaagtgcaggcggctaaggacagctttgaaacaacctcttccgagatcaacctcaaggggacatgcaccctggcccacagaatggttgaggaaagctatcggtctcgcaaatccgtgatctgttacgatcttagctgcaattctacgcattgtaagcccaccatgtatatgattgtccctgtgcactcctgcaacatgatgaaaagctgtctggttggactcggcccctacagaatccaggtggtctatgagcggacatactgcaccacagggattctgatcgaaggaaagtgtttcgtgcctgaccagtccattatctctgtgattaaaaatggcgtctttgatatcgccagcgtttccatcgtgtgcttctttattcgcatcaagggcaacagctataagattatgaccaatatcaaaacggctaacccgaataactgtaatgacacagataacaaggtgcaagggtactacctttgcattgtcggagccaattcttcccccgtgtatgctcctagcaccacagacttcagatctatggaggttctggccagcctcctgcggtctccccatggcgaggatcacgacctgtccggggaagaggtggcgacctacagcatcgccggacaggtcgaaggcaaagtgcctcacaccgagaacgctgccaacatgctctttacagctttctccgggatccccagctattcttccctgagcgtttttgccggaaatcaggatggcacggtgatttactctccgggccttttccctaagctgaaccagtccagctgcgaaaaagtcgcgctccccctgatctgggaggggtatattgaccttcctggatactatgagaccatccatccctgtaatgtgttttgcgtcctgtccggccccggggcctcttgtgaggctttcagcgaaggaggcatttttaacatcacatcccctacctgcctcgtgtctaagcaaaatcgcttcagagccgctgaacagcagatcaacttcgtttgtcagcgggtggaccaagatattgtcatctactgcaatgggcagaaaaagacaattctgaccaagacgctggtgatcggacagtgtatttacagcgttacatccctctttagcatcatgccgggcgtggcccactctattgccatcgagctgtgcgtccccggcttccatgggtgggctaccgcggcccttctgaccacattttgtttcggatggatcctcattccttccatcaccctggctattcttatcgtgctgaaatttttcgccgccattctccacaacagctctcaagaaaatcgctttaaggtgatcctgagaaaaatcaaggaggagttcgagaaaacaaagggctccatggtttgcgaagtctgtaagtatgaatgcgagacggggaaagaactgaaggctcacaacctcagctgcccccagtctcagtgtccttactgctttacccattgtgagctgacagagagcgccttccaggcgcactatcgggtgtgccaagctacccatcgctttagagacgatcttaaaaagacaattacgccccagtccaccagcccgggatgttaccggaccctgaatctcttcagatataaatctcgctgctacatctttacagtgtgggtcgtgctgctgattatcgaatccattctttgggccgccagcgcttccgagatcgttctcgaaccttcttggaacgacaatgcccacggcgtgggggtcgtgcccatgcataccgatctggagctggacttcagcctcccttcctctagcaagtatacatacaagcggaaactgacctcccccatcaaccaggagcagtctgttgatcttcacattgaaatcgagagccaaagaatttccacgagcgtgcacgctctgggccattggttcgacggacgcctcaatctgaagacatcttttcactgttacggcgcctgcaccaaatatgaatacccttggcatacagcgcggtgtcacttcgagagagattttgaatatgagaactcctggagctgcaaccccgccgactgtccggggatcggaaccggctgcaccgcttgcgggctgtaccttgatcagctcaagcctgtcggatctgcctataaactgattacagtgcgctactcccggaaggtttgtgtgcagttcggcgaggaaaatctgtgcaagatcatcgacatgaacgactgttttgtcagcagacacgtgaaagtgtgcattatcgggacggtctctaagttctcccagggcgataccctcgtttttctgggacccatggagggcgggggacttattttcaaagactggtgtacaaccacatgccaatttggcgatcccggggacatcatgagccctaaggataaaggattctcctgtccggactttaccggccatttccgcaagaaatgcaattttgctacgacacccgtgtgtgaatatgatgggaacatggtgagcggctacaagaaggtcatggccaccattgactctttccaggcgttcaataccagctacatccactatacagatgagcggattgaatggaaagaccctgatggaatgctgaaggaccatatcaacatcctcgtgaccaaagatattgactttgagaatctgggcgagaacccctgcaaggttgggctgcagacagcctccatcgaaggagcttggggctctggggtgggattcacgcttacctgtcagattagcctcacagagtgctccagatttctgacctctatcaaagcctgcgacatggctatttgttacggcgcccaaagcgtcacactggtgcgcgggcagaataccgttaaggtgtccggcaagggaggccactctgggagctccttcaaatgctgtcatggaacggattgcagccagcaaggcctccaggcctctgctcctcacctggacaaggtcaacgggatcgtggaacaggagtccacccaggtttatgatgacggagcgccccaatgtggcatcagctgctggtttattaaatctggcgaatggatcaaggggattttcaatggaaactggatcgtgattgtcgtgcttatctttttctttatcctgtccctcattctgctgagcttcctttgtcctatccggaaacacaagagatcctga

SEQ ID NO: 13305 - RNA, 3408 nt, synthetic construct
  misc_feature 1..3408: note = derived and/or modified CDS sequence (opt5) from DOBV(A6)__GU904033.1__GP
  source 1..3408: mol_type = other RNA
atgatcatgtggggcctgctcctgaccatgattcttatcgacttcggggccagcctgagaaacgtgtacgatatgaagattgagtgcccccactccatcaattttggagaatctagcgtcacaggcaaagttgagctccctccgctgcttctgacggacgccgaagccctcgtgcccgagtcctcttgtaacatggataatcatcagagcatgtccattatccaaaaggtgaccaaagtctcttggcggaagaaagcggacaaggctcaggccgccaaggatagcttcgaaacaacctccagcgaggtgaacctgaaagggacatgcaccctgtctcaccgcatggttgaggaatcctatagaaatcggcgcagcgtgatctgttacgacctctcttgcaactccacacattgtaagcctaccatgcacatgattgtccccgtgcatagctgcaatatgatgaaatcttgtctggttggacttggcccttatagaatccaggtggcttacgagcggacgtattgcaccacagggattctgaccgaaggaaagtgttttgtccccgatcagtccatcgtgagcgtgattaaaaacggcgtcttcgacatcgcctccgtttctattgtgtgctttttcatccgcgtgaagggcacaaattacaagatcatggctagcattaaaaccgccacggcgaacaattgtaacgatacagacaataaggtccaagggtattacctctgcatcgtgggaggcaactccagccctgtttacgccccgtctaccacagattttagatccatggaggctctggccagccttctgcgggctccccacggggaggaccacgatctctctggagaagaggtggccacctatagcattgcgggccagatcgaagggaaaattcctcataccgccaatgctgccaacatgctgttcacagctttttccggaatcccctcttacagctccctgagcgtcttcatcggctctcaggacggccctattatctattcccccgggctctttccgaagctgaaccagagctcttgcgacaaagtggcccttcctctgatttgggagggatacatcgatctccccggctattacgaaacggttcacccttgtaatgtgttctgcgtcctgtccgggcccggagccagctgtgaggctttttccgagggcgggattttcaacatcacctctcccacatgccttgtgagcaagcaaaatcgcttcagagcggccgaacagcaggtcaactttgtgtgtcagcgggttgaccaagatatcattatctattgcaatggacagaaaaagaccattctgacaaagaccctcgtgatcggccagtgtatttactccgtcacgtctctgttcagcatcatgcctggcgtggctcattccattgccatcgagctgtgcgttccggggtttcacggatgggccacagctgccctcctgaccaccttctgttttggctggatccttattcccagcatcacactggcggtgctcgtcgtgctgaaattctttgctgccattcttcacaactcttcccaagaaaatcgcttcaagatcattctgagaaaaatcaaggaggaatttgagaaaaccaaggggagcatggtgtgcgaggtttgtaagtacgaatgcgagacaggaaaagaactcaaggcccataacctgtcttgccctcagtcccagtgtccctattgcttcacgcactgtgagcctaccgaaagcgcttttcaggcccattacaaagtctgccaagctacacaccggttccgcgacgatctgaagaaaaccatcacaccccagtctaccagcccgggctgttatagaacgctcaatctgtttcggtacaagtccagatgctatattttcaccgtgtgggtgacacttctgatcattgagagcatcatgtgggccgcgtctgcctccgagaacgtcctcgaacctagctggaatgacaacgctcatggggtgggcgttgtgcccatgcacaccgatctggagctggacttctcccttccttctagctccaagtacacatataaacgcaagctcacctctcccctgaatcaggaacagagcgtcgatctgcacattgagatcgagtcccaaggaatctctacgagcgtgcatgccctcggccactggtttgacgggcggctgaaccttaaaacatccttccattgttacggagcttgcaccaagtacgaatatccttggcacacagccaaatgtcactttgagagagatttcgaatacgagaatagctggggctgcaaccccgcggactgtccggggattggaaccggctgcaccgcctgcgggctgtatatcgaccagctcaagcctgttggctctgcttacaagctgattacagtgcgctattcccggaaagtctgtgtgcagtttggagaagagaacctgtgcaagacgatcgatatgaatgactgtttcgttaccagacatgtgaaagtctgcattatcggcacagtgagcaagttttctcagggggatacccttgtgttcctcggacccatggtcggcgggggactgatctttaaagactggtgtacatccacgtgccaattcggcgatcccggggacattatgagccctaaggataaaggcttttcttgtccggacttcaccggacactttcgcaagaagtgcaacttcgccacaacccccgtttgtgagtacgatggcaatatggtgtccgggtataaaaaggtgatggctaccatcgacagcttccagtcctttaacacaagctctattcattacaccgatgaacggatcgagtggaaagaccctgatggaatgctgaaggaccacctcaatattctggtcacaaaagacatcgatttcgaaaaccttggcgagaatccctgcaaggtggggctgcagacgagctccattgaaggagcctggggctctggggttggctttaccctcacatgtcagatcagcctgaccgagtgctccagattcctgacatctatcaaggcctgcgacatggctatttgttacggagcgcaaagcgtgacccttatccgcggccagaacacggtcaaagtgtccgggaagggaggccattctgggagctcctttaaatgctgtcacggaaccgattgcagccagcaaggcctccaggcctctgctcctcacctggacaaggttaatggcattgtggagcaggattccgaaaaagtctatgacgatggggctccccagtgtggaatcagctgctggttcgtgaagtctggcgagtggattacagggatctttaacggaaattggatcgttattgtggtcctggtgttctttttcatcctctccctgattcttctgagcctcctgtgtcctatccggaagcataaaagatcctga

SEQ ID NO: 13306 - RNA, 3408 nt, synthetic construct
  misc_feature 1..3408: note = derived and/or modified CDS sequence (opt5) from DOBV(B13)__GU904034.1__GP
  source 1..3408: mol_type = other RNA
atgatcatgtggggcctgctcctgaccatgattcttatcgacttcggggccagcctgagaaacgtgtacgatatgaagattgagtgcccccactccatcaattttggagaatctagcgtcacaggcaaagttgagctccctccgctgcttctgacggacgctgaagccctcgtgcccgagtcctcttgtaacatggataatcatcagagcatgtccattatccaaaaggtgaccaaagtctcttggcggaagaaagcggacaaggctcaggccgccaaggatagcttcgaaacaacctccagcgaggtgaacctgaaagggacatgcaccctgtctcaccgcatggttgaggaatcctatagaaatcggcgcagcgtgatctgttacgacctctcttgcaactccacacattgtaagcctaccatgcacatgattgtccccgtgcatagctgcaatatgatgaaatcttgtctggttggacttggcccttatagaatccaggtggtctacgagcggacgtattgcaccacagggattctgaccgaaggaaagtgttttgtgcccgatcagtccatcgtgagcgtcattaaaaacggcgttttcgacatcgcttccgtgtctattgtgtgctttttcatccgcgtcaagggcacaaattacaagatcatggccagcattaaaaccgctacggccaacaattgtaacgatacagacaataaggtgcaagggtattacctctgcatcgttggaggcaactccagccctgtgtacgcgccgtctaccacagattttagatccatggaggccctggctagccttctgcgggctccccacggggaggaccacgatctctctggagaagaggtcgctacctatagcattgccggccagatcgaagggaaaattcctcataccgcgaatgccgctaacatgctgttcacagccttttccggaatcccctcttacagctccctgagcgtgttcatcggctctcaggacggccctattatctattcccccgggctctttccgaagctgaaccagagctcttgcgacaaagttgcccttcctctgatttgggagggatacatcgatctccccggctattacgaaacggtgcacccttgtaatgtcttctgcgtgctgtccgggcccggagccagctgtgaggccttttccgagggcgggattttcaacatcacctctcccacatgccttgtcagcaagcaaaatcgcttcagagctgcggaacaacaggtgaactttgtttgtcagcgggtggaccaggatatcattatctattgcaatggacagaaaaagaccattctgacaaagaccctcgtcatcggccagtgtatttactccgtgacgtctctgttcagcatcatgcctggcgttgcccattccattgctatcgagctgtgcgtgccggggtttcacggatgggccacagccgctctcctgaccaccttctgttttggctggatccttattcccagcatcacactggccgtcctcgtggtgctgaaattctttgcggctattcttcacaactcttcccaagaaaatcgcttcaagatcattctgagaaaaatcaaggaggaatttgagaaaaccaaggggagcatggtttgcgaggtctgtaagtacgaatgcgagacaggaaaagaactcaaggcccataacctgtcttgccctcagtcccagtgtccctattgcttcacgcactgtgagcctaccgaaagcgcctttcaggctcattacaaagtgtgccaagccacacaccggttccgcgacgatctgaagaaaaccatcacaccccagtctaccagcccgggctgttatagaacgctcaatctgtttcggtacaagtccagatgctatattttcaccgtgtgggtcacacttctgatcattgagagcatcatgtgggctgcctctgcgtccgagaacgtgctcgaacctagctggaatgacaacgcccatggggttggcgtggtccccatgcacaccgatctggagctggacttctcccttccttctagctccaagtacacatataaacgcaagctcacctctcccctgaatcaggaacagagcgtggatctgcacattgagatcgagtcccaaggaatctctacgagcgttcatgctctcggccactggtttgacgggcggctgaaccttaaaacatccttccattgttacggagcctgcaccaagtacgaatatccttggcacacagctaaatgtcactttgagagagatttcgaatacgagaatagctggggctgcaaccccgccgactgtccggggattggaaccggctgcaccgcgtgcgggctgtatatcgaccagctcaagcctgtgggctctgcctacaagctgattacagtccgctattcccggaaagtgtgtgttcagtttggagaagagaacctgtgcaagacgatcgatatgaatgactgtttcgtgaccagacatgtcaaagtgtgcattatcggcacagtgagcaagttttctcagggggatacccttgtcttcctcggacccatggttggcgggggactgatctttaaagactggtgtacatccacgtgccaattcggcgatcccggggacattatgagccctaaggataaaggcttttcttgtccggacttcaccggacactttcgcaagaagtgcaacttcgctacaacccccgtgtgtgagtacgatggcaatatggtgtccgggtataaaaaggtcatggccaccatcgacagcttccagtcctttaacacaagctctattcattacaccgatgaacggatcgagtggaaagaccctgatggaatgctgaaggaccacctcaatattctggtgacaaaagacatcgatttcgaaaaccttggcgagaatccctgcaaggttgggctgcagacgagctccattgaaggagcttggggctctggggtgggctttaccctcacatgtcagatcagcctgaccgagtgctccagattcctgacatctatcaaggcctgcgacatggccatttgttacggagctcaaagcgtcacccttatccgcggccagaacacggtgaaagtttccgggaagggaggccattctgggagctcctttaaatgctgtcacggaaccgattgcagccagcaaggcctccaggcgtctgcccctcacctggacaaggtgaatggcattgtcgagcaggattccgaaaaagtgtatgacgatggggctccccagtgtggaatcagctgctggttcgttaagtctggcgagtggattacagggatctttaacggaaattggatcgtgattgtcgtgctggtgttctttttcatcctctccctgattcttctgagcctcctgtgtcctatccggaagcataaaagatcctga

SEQ ID NO: 13307 - RNA, 3408 nt, synthetic construct
  misc_feature 1..3408: note = derived and/or modified CDS sequence (opt5) from DOBV(Aa1854/Lipetsk-02)__EU188453.1__GP
  source 1..3408: mol_type = other RNA
atgatcatgtggggcctgctcctgaccatggcccttattaaccccggggctacactgagaaatgtgtacgacatgcggatcgagtgccctcacagcattaacttcggagaatcctctgtcacgggcaaggttgagctcccgcccatccctctggccgatgcggaaacccttgtgcccgagagctcctgtaatatggacaaccatcagtctctgagcattacacaaaaagtgaccaaggtctcctggcgcaaaaaggctgataaagtgcaggccgccaaggactcttttgaaacaaccagctccgagatcaatctcaaggggacatgcaccctgacgcacagaatggttgaggaaagctatcggaaccgcaaatctgtgatctgttacgatctgtcctgcaatagcacccattgtaagcctacaatgcacatgattgtccccgtgcattcttgcaacatgatgaaatcctgtctcgttggactgggcccttatagaatccaggtggtctacgagcggacctattgcacaaccgggattcttacggaaggaaagtgtttcgtgccggaccagagcatcgtgtctgtcattaaaaatggcgtttttgatatcgcttccgtgagcattgtgtgcttctttatccgcatcaagggcaactcctacaagattatggcctctatcaaagaggctaatcccaacaattgtaacgacacagataataaggtccaagggtattacctgtgcattgtgggagccaacagctcccctgtttacgcgcccagcaccacagacttcagatctgtggaggccctcgcttccctgcttcggagccctcacggcgaagatcacgacctgtctggggaggaagtcgccacctatagcatcgctggacaggtggagggcaaagttccccataccgccaacgcggccaatatgctctttacagctttctccgggattccgtctcacagctcctttagcgtgttcacgggaaaccaggatggcaccgtcatctactctcctggcctgtttcccaagctgaatcagtccgcctgcgacaaagtggctctccctctgatctgggaagggtatattgaccttcccggatactatgagacaatccatccctgtaacgtcttctgcgtgctgagcggccctggggcctcttgtgaggccttttccgaaggaggcattttcaatatcaccagcccgacatgcctcgtttccaagcaaaaccgcttcagagctgcggagcagcagattaattttgtgtgtcagcgggtcgatcaagacatcgtgatctactgcaacgggcagaaaaagaccattctgacgaagacacttgttatcggacagtgtatttattctgtgaccagcctgttctccatcatgcccggcgtcgcccactctattgctatcgaactctgcgtgcctggctttcacgggtgggccaccgccgctctgctgacaaccttctgttttggatggattctcatccccagcatcacactggccattcttatcgtgctgaaattctttgcggctattctccataattccagccaagagaaccgcttcaagatcattctgagaaaaatcaaggaagagtttgagcggacgaaaggctctatggtttgcgaagtctgtaagtacgagtgcgaaaccgggaaggagcttaaagcccacaatctgtcctgccctcagagccagtgtccctactgcttcacacattgtgaactcaccgagtctgcctttcaggctcactatcgcgtgtgccaagccacacatagattccgggatgacctgaagaaaaccatcacgccgcagtccaccagccctggatgttacagaacactgaacctctttcgctataagtctcggtgctacattttcaccgtgtgggtcgtgctgcttatcattgagagcatcctgtgggctgcctccgcgagcgaaacagttctcgagcccaattggaacgataatgcccacggcgtgggggtcgtgcctatgcacaccgacctggaactggatttctctcttccctccagctccaaatatacgtacaagagaaagctcacatctcctattaaccaggagcagagcgttgacctgcatatcgaggtggaatcccaaggcatctctaccagcgtccacgctctgggacattggtttgatggccgcctcaacctgaaaacatccttccactgttatggggcctgcaccaagtacgagtacccctggcacaccgctcggtgtcattttgaaagagacttcgagtatgaaaattcttggagctgcaacccggccgattgtcctggaattggcacagggtgcacggcgtgcggactttacctggaccagctcaaacccgtgggctccgcctataagctgatcaccgttcgctacagccggagagtgtgtgtccagtttggggaggagaatctgtgcaaaacaattgacatgaacgattgtttcgtgacccgccacgtgaaggtctgcatcattggcacagtttctaagttttcccagggagacacccttgtgttcctcggccccatggaagggggaggcctgatctttaaagattggtgtacgacaacctgccaattcggggaccctggagatatcatgagcccgaaggacaaaggcttttcttgtcccgatttcaccgggcattttcggaagaaatgcaatttcgctacaacccctgtgtgtgagtatgacggcaacatggtctccggatacaagaaagtgatggccacaattgatagcttccaggcttttaatacgtctaacatccactataccgacgaaagaattgagtggaaggatcccgacggcatgctgaaggatcatctcaatatcctggttacaaaagacattgacttcgaaaaccttggggagaatccttgcaaggtgggactgcagaccgcctccatcgagggcgcctgggggagcggagtcggctttacactcacctgtcagatttccctgacggaatgcagccgcttcctgacctctatcaaagcctgcgatatggcgatctgttacggggcccaaagcgtgacacttgttcggggccagaacaccgtgaaggtctccggaaaaggcgggcactctggaagctcctttaagtgctgtcacggcacagactgctctcagcaagggctccaggctagcgctccccatctggataaggtgaatggaattgttgagcaggaatccacccaggtgtacgacgatggcgcccctcaatgtggcatctcttgctggttcattaaaagcggggagtggatcaagggaatttttaacggcaattggatcgtcatcgtggtgctgattttctttttcatcctctccctgattcttctgagctttctctgtcccatcagaaaacacaagcggtcttga

SEQ ID NO: 13308 - RNA, 3402 nt, synthetic construct
  misc_feature 1..3402: note = derived and/or modified CDS sequence (opt5) from DOBV(Ap/Sochi/hu)__JF920149.1__GP
  source 1..3402: mol_type = other RNA
atgtggggcctgctcctgaccatgatccttattgacttcggggccacactgagaaacgtgtacgatatgcggatcgagtgcccccacagcgtcaattttggagaatcctctgttagcggcaaggtggagctccctccggtgctgctttccgaagtcgagacgctggtgcccgaatctagctgtaacatggacaatcatcagtccatgtctattatccaaaaagttacccagctcacatggcgcaagaaagctgataaggcccaggcggctaaagacagcttcgagattacctccggggaggtgagcctgaagggaacatgcaccctgacacacagaatggtcgaagattctcatcggaaccgcaagtccatcatctgttatgacctcagctgcaattctacccactgtaaacctacgatgcatatgattgtgcccatccactcctgcaacatgatgaaaagctgtctggttggccttgggccttaccggattcaggtggtctatgagagaacctactgcacaaccggaatcctgacagaaggcaagtgttttgtgcccgatcaatctattgtgaatgtcatcaagaacggcgttttcgacattgcctccgtgagcatcgtgtgctttttcgtccgcgtgaaagggaccaattataagatcatggcctccattaagacggctacatctaacaattgtaacgataccggaaataaagttcagggctactatctctgcatcgtcgggggaaacagctcccctgtgtacgtgccgagcacaaccgactttagatctatggaggccctggcttccatgcttcgggcgccccacggcgaggatcatgacctggccggggaagaggttgccacctacagcattgctggacaggtggaaggcaaggtccctcacacagcctctacggctaatatgctcctgaccgccttcagcggcatcccctcctattctagcctgtccgtgtttacagggagccaggatggacctattgtctactctcccggcctcttcccgaaactgaaccaatccagctgcgacaaggtggggcttcctctgatctgggagggatatatcgacctccccggctactatgaaaccgttcatcagtgtaacgtgttttgcgtcctgtctgggcctggagcgtcctgtgaggccttcagcgagggcggcatttttaatatcacatcccccaactgcatggtgtctaaacagaatcgcttcagagctgccgaacagcaagttaacttcgcttgtcagcgggtggatcaggacattcttatcttttgcaatgggcaaaagaaaaccattctgacgaagacactcgtcatcggacagtgtatctacagcattacctccctgttctctatcatgcccggcgtggcccacagcattgccatcgagctgtgcgtgcctgggtttcacggatgggctaccgcggccctcctgacaaccttctgttttggctgggttcttattccgtccatcacactggctgtcctcgtggtgctgaagttctttgccgccattcttcataacagctctcaggaaaatcgcttcaaactgatcctcaagaaaatcaaggaggaatttgagaaaacgaaggggtccatggtctgcgaggtgtgtaagtatgaatgcgagaccggcaaagaactgaaggctcacaacctgagctgcccccagtctcaatgtccttactgcttcacacattgtgagcccaccgaatccgcctttcaggcgcactacaaagtttgccaggctacacatagattccgggatgacctcaagaaaaccattacgcctcagagcacctctcccggatgttatcgcacactgaatctttttagatacaagagccggtgctatatcttcaccgtgtgggtcgtgctgctcgttgtggagtccgtcatgtgggccgccagcgcttctgagacagtgctggaaccgtcctggaacgataatgcccacggcgttggggtggtccctatgcacaccgacctggagcttgatttcagcctcccctcctctagcaagtacacgtataaaagaaagctgacatcccctattaaccaagaacagtctgtggacctgcatatcgagattgagagccagggaatctccacctctgtgcacgctctcggccattggtttgatgggcgcctgaatcttaaaaccagcttccactgttacggagcctgcacaaagtatgaatacccctggcacaccgcgcggtgtcattttgagagagacttcgaatacgagaactcctggggctgcaatcctgccgattgtcccgggatcggcacaggatgcacggcttgcggcatttatatcgaccagctgaaaccggtcgggagcgcctacaagctcattaccgttcgctattctcggaaggtgtgtgtgcaatttggagaagagaacctgtgcaaaacaatcgacatgaacgattgtttcgtcaccagacacgtgaaggtttgcattatcggcacagtgtccaaatttagccagggggacaccctggtcttccttggacctatggagggcgggggcctcatctttaaggattggtgtacgtctacatgccagttcggagaccccggcgatattatgtcccccaaagacaaggggtttagctgtcctgaatttaccggacattttcgcaaaaagtgcaatttcgctaccacaccggtgtgtgagtacgatggcaacatggtttctgggtataagaaagtgatggccaccatcgactccttccaggcgtttaatacaagctccattcactacacggatgaacggatcgagtggaaggaccccgatggaatgctgaaagaccatctgaacattctcgtcaccaaggatatcgacttcgaaaatctgggcgacaacccttgcaaagtggggcttcaaacagttagcatcgagggcgcctggggatctggcgtggggtttaccctgacatgtcaggtcagcctcaccgagtgctccagattcctgacgtctattaaggcttgcgataaggccatctgttatggagctcagagctccaccctgattcgcggccaaaatacagtgaaagtgtctgggaagggaggccacagcggctcctcttttaaatgctgtcacgggaccgactgcagccagcagggacttcaggcctccgctccccatctcgataagatcaacggcattgtcgaacaagagaatgaaaaagtttacgacgatggggcccctcagtgtggaatcagctgctggttcgtgaagtctggcgagtggattcaggggatctttaacggaaattggatcgtgattgtcgtgctgatcttctttttcattctgtccctcatcctgcttagcattttctgtcccatccggaagcacaaaagatcttga

SEQ ID NO: 13309 - RNA, 3402 nt, synthetic construct
  misc_feature 1..3402: note = derived and/or modified CDS sequence (opt5) from DOBV(Ap1584/Sochi-01)__EU188450.1__GP
  source 1..3402: mol_type = other RNA
atgtggggcctgctcctgaccatgatccttattgacttcggggccacactgagaaacgtgtacgatatgcggatcgagtgcccccacagcgtcaattttggagaatcctctgttagcggcaaggtggagctccctccggtgctgctttccgaagtcgagacgctggtgcccgaatctagctgtaacatggacaatcatcagtccatgtctattatccaaaaagttacccagctcacatggcgcaagaaagctgataaggcccaggcggctaaagacagcttcgagattacctccggggaggtgagcctgaagggaacatgcaccctgacacacagaatggtcgaagattctcatcggaaccgcaagtccatcatctgttatgacctcagctgcaattctacccactgtaaacctacgatgcatatgattgtgcccatccactcctgcaacatgatgaaaagctgtctggttggccttgggccttaccggattcaggtggtctatgagagaacctactgcacaaccggaatcctgacagaaggcaaatgttttgtgcccgatcaatctattgtgaatgtcatcaagaacggcgttttcgacattgcctccgtgagcatcgtgtgctttttcgtccgcgtgaaagggaccaattataagatcatggcctccattaagacggctacatctaacaattgtaacgataccggaaataaagttcagggctactatctctgcatcgtcgggggaaacagctcccctgtgtacgtgccgagcacaaccgactttagatctatggaggccctggcttccatgcttcgggcgccccacggcgaggatcatgacctggccggggaagaggttgccacctacagcattgctggacaggtggaaggcaaggtccctcacacagccaatgctgccaacatgctcctgacggcgttctctggcgtgcccagctattcctctctgagcgtctttaccgggtcccaggatggacctatcgtgtacagccccggcctcttcccgaaactgaaccaatcttcctgcgacaaggttgggcttcctctgatttgggagggatatatcgacctccccggctactatgaaacagtgcatcagtgtaatgtcttttgcgtgctgagcgggcctggagcctcttgtgaggctttctccgagggcggcatctttaacattaccagccccaattgcatggtttccaaacagaaccgcttcagagccgctgaacagcaagtgaatttcgcctgtcagtctgtcgatcaggacatccttattttctgcaacgggcaaaagaaaacaatcctgaccaagacgctcgtgattggacagtgtatctaccccatcacaagcctgttctccattatgcctggcgtggcccactctatcgctattgagctgtgcgttccggggtttcacggatgggcgaccgccgctctcctgaccacattctgttttggctgggtccttatccccagcattaccctggccgtgctcgtggtcctgaagttctttgccgctatccttcataattccagccaggaaaaccggttcaaactgattctcaagaaaatcaaggaggaatttgagaaaacaaaggggtctatggtgtgcgaggtttgtaagtatgaatgcgagacgggcaaagaactgaaggcccacaatctgtcctgccctcagagccaatgtccctactgcttcacccattgtgagcctacagaatctgcgtttcaggctcactacaaagtgtgccaggccacccatcgcttcagagatgacctcaagaaaacaatcacgccccagtccaccagcccgggatgttatcggaccctgaacctttttcgctacaagtctagatgctatattttcacagtctgggtggttctgctcgtggtcgagagcgtgatgtgggccgcttccgccagcgagaccgttctggaaccttcttggaatgataacgctcacggcgtgggggtcgtgcccatgcacacagacctggagcttgatttctccctccctagctcctctaagtacacctataaacggaagctgacgagccccatcaatcaagaacagtccgtggacctgcatattgagatcgagtctcagggaattagcacatccgtccacgccctcggccattggtttgatgggagactgaaccttaaaacctctttccactgttacggagcgtgcacaaagtatgaatacccttggcacaccgcccgctgtcattttgagcgggacttcgaatacgagaatagctggggctgcaaccccgctgattgtccggggatcggcaccggatgcacagcctgcggcatctatattgaccagctgaaacctgttgggtccgcttacaagctcatcacggtgagatatagccgcaaggtgtgtgtccaatttggagaagagaacctgtgcaaaaccattgacatgaatgattgtttcgtgacacggcacgttaaggtgtgcatcattggcaccgtctctaaattttcccagggggacacactggtgttccttggacccatggagggcgggggcctcatctttaaggattggtgtaccagcacgtgccagttcggagaccccggcgatatcatgtctcctaaagacaaggggttttcctgtccggaatttacaggacattttagaaagaagtgcaacttcgccaccacccccgtttgtgagtacgatggcaatatggtgagcgggtataagaaagtcatggcgacaattgactctttccaggcctttaacacctccagcatccactacacagatgaacgcattgagtggaaggaccctgatggaatgctgaaagaccatctgaatatcctcgtgacgaaggatattgacttcgaaaacctgggcgactccccctgcaaagttgggcttcaaaccgtgagcatcgagggcgcttggggatctggcgtcgggtttacactgacctgtcaggtgagcctcacagagtgctcccggttcctgacctctatcaaggcctgcgataaggctatttgttatggagcccagagctccacgctgatcagaggccaaaataccgtgaaagtctctgggaagggaggccacagcggctcctcttttaaatgctgtcacgggacagactgcagccagcagggacttcaggcctccgctcctcatctcgataagattaacggcatcgttgaacaagagaatgaaaaagtgtacgacgatggggcgccccagtgtggaattagctgctggttcgtgaagtctggcgagtggatccaggggatttttaacggaaattggatcgtcatcgtggttctgattttctttttcatcctgtccctcattctgcttagcatcttttgtcctattcgcaagcacaaacggtcttga

SEQ ID NO: 13310 - RNA, 3408 nt, synthetic construct
  misc_feature 1..3408: note = derived and/or modified CDS sequence (opt5) from DOBV(GER/05/477/Af)__GQ205411.1__GP
  source 1..3408: mol_type = other RNA
atgatcatgtggggcctgctcctgacccttagcctgattaacctcggggcctccctgagaaatgtgtacgacatgaagatcgagtgcccccactctattaacttcggagaaagctccgtcacaggcaaagttgagcttcctccgctgctcctgacggatgctgaagccctggtgcccgagtctagctgtaatatggacaaccatcagtccctctctatcacccaaaaggtgacaaaagtcagctggcggaagaaagcggataaggtgcaggctgccaaggactcctttgaaaccacaagctctgaggttaatttcaaagggacctgcacactgacccaccgcatggtggaggaatcctatagaaaccgcaagagcgtcatttgttacgatctttcttgcaattccacgcattgtaaacctaccatgcacatgatcgtgcccgttcatagctgcaacatgatgaagtcttgtctggtgggactcggcccttatcggatccaggtcgtgtacgagagaacatattgcaccacagggattctgaccgaaggaaaatgttttgtgcccgaccagtccatcattagcgtccttaagaatggcgttttcgatatcgcctccgtgtctattgtgtgctttttcatccggattaagggcacgagctacaaaatcatgacatccatcaaggaggctaaccctaataactgtaatgacaccgataacaaagtccaagggtattacctgtgcattgtgggagccaatagctctccggtttacgctccctccacaaccgactttcgcagcgtggaggccctcgcgtctctgctgagaagccctcacggcgaagatcacgacctcgccggggaggaagtcgctacctattccatcgccggacaggtggagggcaaggttccccatacagctaacgccgcgaacatgctgttcacggccttttctgggattcctagctactccagcttctctgtgtttaccggaaatcaggaaggcaacgtcatctattcccccggccttttcccgaaactgaatcagagctcttgcgagaaggtggctctccctctgatttgggaggggtacatcgatcttcccggatattacgaaacagtccacccttgtaacgtgttttgcgttctgtccggccccggggccagctgtgaggctttctccgaaggaggcatcttcaatattacctctcccacatgcctcgtgagcaaacaaaaccggtttcgcgccgccgagcagcagatcaatttcgtctgtcagagagtggaccaagacattgttatctattgcaacgggcagaagaagaccattctgacgaaaacactggtgatcggacagtgtatctactccgtcacctctctctttagcattatgcctggcgtggctcattccatcgcgattgaactgtgcgtgccgggcttccacgggtgggccaccgctgcccttctgacaaccttttgtttcggatggatcctcattcccagcatcacactggccattcttatcatcctgaagtttttcgctgccctctttcacaattcttcccaagagaaccggttcaaaattatcctgaagaaaattaaggaggaatttgagaagacgaaaggcagcatggtttgcgaagtctgtaagtacgagtgcgaaaccgggaaagagctgaaggcgcataatctctcttgccctcagtcccagtgtccctattgcttcacacactgtgagctgaccgaaagcgcttttcaggcccattaccgcgtgtgccaagccacacacagattccgggatgaccttaaaaagaccatcacgcctcagtctaccagccccggatgttatcgcacactgaacctcttcagatacaagtcccggtgctatatttttaccgtgtgggtcatcctgctgatcattgagagcatcctttgggctgcctctgcttccgaaacagtgctcgagccgagctggaatgataacgcccatggcgttggggtggtccctatgcacaccgacctggagctggatttctccctcccctctagctccaaatacacgtataagagaaaactgacatctcctattaatcaggaacagagcgtggaccttcacatcgagattgaatcccaaggcatctctaccagcgttcatgcgctgggacactggtttgatggccgcctcaacctgaagacatccttccattgttacggggcctgcaccaaatacgagtatccctggcacaccgctaagtgtcactttgaacgggacttcgagtacgagaacagctggtcttgcaatcctgccgattgtcccggaatcggcacagggtgcacggcttgcggactgtatcttgaccagctcaagccggtgggctccgcctacaaactgattaccgtcagatatagccgcaaggtgtgtgttcagtttggggaagagaacctgtgcaaaacaatcgatatgaatgactgtttcgtgacccggcatgtcaaggtgtgcattatcggcacagtgtctaaattttcccagggagacaccctcgtcttcctgggccctatggaagggggaggccttatttttaaggattggtgtacgacaacctgccaattcggggaccccggagatatcatgagccccaaagacaagggcttttcttgtcctgatttcaccgggcacttcagaaagaaatgcaactttgcgacaaccccggtttgtgagtacgacggcaatatggtgtccggatataagaaagtgatggccacaatcgatagcttccaggcttttaacacgtccaatattcattacaccgacgaacgcatcgagtggaaggatcccgacggcatgctgaaagatcacctcaacattctggtcacaaaggacatcgatttcgagaatctgggggaaaacccttgcaaggtgggacttcagaccgccagcattgacggcgcttgggggtctggagttggctttacactcacctgtcagatcagcctgacggagtgctcccggttcctgacctctattaaagcctgcgacatggccatctgttacggggctcaaagcgtgacactcgtcagaggccagaataccgtgcgcgtttccggaaagggcgggcattctggaagctcctttaaatgctgtcacggcacagattgctctcagcaagggctgcaggcgagcgctccccaccttgacaaggtgaacggaatcgtcgaacaggagtccacccaggtgtatgatgacggcgcccctcaatgtggcattagctgctggttcgttaaatctggggaatggatcaagggaatttttaatggcaactggatcgtgattgtcgtgctgatcttcctctttctgctgtcccttatcctcctgagcttcctgtgtcccattcggaagcataaaagatcttga

SEQ ID NO: 13311 - RNA, 3408 nt, synthetic construct
  misc_feature 1..3408: note = derived and/or modified CDS sequence (opt5) from DOBV(GER/07/607/Af)__GQ205410.1__GP
  source 1..3408: mol_type = other RNA
atgatcatgtggggcctgctcgtgaccctgagccttattaacctgggggcctccctcagaaatgtctacgacatgaagatcgagtgcccccactctattaacttcggagaaagctccgttacaggcaaagtggagctgcctccgcttcccctgacggatgctgaaaccctcgtgcctgagtctagctgtaatatggacaaccatcagtccctgtctatcacacaaaaggtcaccaaagtgagctggcggaagaaagccgataaggttcaggcggctaaggactcctttgaaacaaccagctctgagatgaatctgaaagggacatgcaccctcacgcaccgcatggtggaggaatcctatagaaaccgcaagagcgtcatttgttacgatctgtcttgcaattccacccattgtaaacccacaatgcacatgatcgtgcctgttcatagctgcaacatgatgaagtcttgtcttgtgggactgggcccctatcggatccaggtcgtgtacgagagaacctattgcacaaccgggattctcacggaaggaaaatgtttcgtgcctgaccagtccatcattagcgtcatgaagaatggcgtttttgatatcgcctccgtgtctattgtgtgcttctttatccggattaagggcacaagctacaaaatcatgacctccatcaaggaggccaacccgaataactgtaatgacacagataccaaagtccaagggtattacctgtgcattgtgggagctaacagctctcccgtttacgccccttccaccacagacttccgcagcgtggaggctcttgcctctctgctcagaagcccccacggcgaagatcacgacctggcgggggaggaagtcgccacgtattccatcgctggacaggtggagggcaaggttcctcataccgccaatgctgccaacatgctgtttacagcgttctctgggattcccagctactccagcttttctgtgttcaccggaaaccaggatggcacagtcatctattccccgggcctctttcctaaactgaatcagagctcttgcgacaaggtggcccttcccctgatttgggaagggtacatcgacctccctggatattacgagaccgtccacccctgtaacgtgttctgcgttctgtccggccccggggctagctgtgaggccttttccgaaggaggcatcttcaatattacgtctcctacatgccttgtgagcaaacaaaaccggttccgcgctgccgagcagcagatcaattttgtctgtcagagagtggatcaagacattgttatctattgcaacgggcagaagaagaccattctgaccaaaacactcgtgatcggacagtgtatctactccgtcacctctctgttcagcattatgccgggcgtggcccattccatcgctattgaactgtgcgtgcccggctttcacgggtgggcgacagccgctctcctgacgaccttctgttttggatggatccttattcctagcatcacactggccattctcatcgttctgaagttctttgccgcccttctgcacaattcttcccaagagaaccggttcaaaatcattctcaagaaaatcaaggaagagtttgagaagaccaaaggcagcatggtctgcgaagtgtgtaagtacgagtgcgaaacagggaaagagctgaaggctcataatctgtcttgcccccagtcccagtgtccttattgcttcacccactgtgaactcacggagagcgcgtttcaggctcattaccgcgtgtgccaagccacccacagattccgggatgacctgaaaaagacaattacaccccagtctaccagcccgggatgttatcgcacccttaacctgtttagatacaagtcccggtgctatatcttcacggtctgggtgattctcctgatcatcgagagcattctgtgggccgcttctgcctccgaaacagttcttgagcctagctggaatgataacgctcatggcgtgggggtcgtgcccatgcacgccgacctcgaactggatttctccctgccttctagctccaaatacacctataagagaaaactcacatctcccatcaatcaggagcagagcgttgacctgcacattgagatcgaatcccaaggcatttctaccagcgtgcatgcgcttggacactggtttgatggccgcctgaacctcaagacctccttccattgttacggggcctgcacaaaatacgagtatccttggcacacggctaagtgtcactttgaacgggacttcgagtacgaaaatagctggtcttgcaaccccgccgattgtccgggaatcggcaccgggtgcacagcttgcggactgtatctggaccagcttaagcctgtcggctccgcctacaaactcatcaccgtgagatatagccgcaaggtttgtgtgcagtttggggaggagaacctgtgcaaaacaattgacatgaatgattgtttcgtcacccggcatgtgaaggtgtgcatcattggcacggtctctaaattttcccagggagacacactggttttcctcggccccatggaagggggaggcctgatctttaaggattggtgtaccaccacatgccaattcggggaccccggagatattatgagccctaaagacaagggcttttcttgtccggatttcaccgggcactttagaaagaaatgcaacttcgcgacaacgcccgtgtgtgagtacgacggcaatatggtgtccggatataagaaagtcatggccaccatcgatagcttccaggcttttaacacatccaatatccattacaccgacgaacgcattgagtggaaggatcctgacggcatgcttaaagatcacctgaacatcctcgtgacaaaggacattgacttcgaaaatctgggggagaacccctgcaaggttggactgcagaccgccagcatcgatggcgcttgggggtctggagtgggctttacgcttacctgtcagattagcctcacagagtgctcccggttcctgacctctatcaaagcctgcgacatggccatttgttacggggctcaaagcgtcacactggtgagaggccagaataccgttaaggtgtccggaaaaggcgggcattctggaagctcctttaagtgctgtcacggcacagattgctctcagcaagggctccaggcgagcgcccctcacctggacaaagtcaacggaatcgtggaacaggagtccacccaggtttatgatgacggcgctccccaatgtggcatcagctgctggttcgtgaagtctggggaatggattaagggaatcttttccggcaattggattgtcatcgtggtgcttattttcctgtttctcctgagcctgatccttctctctttcctgtgtcctatccgcaaacataagcggtcctga

SEQ ID NO: 13312 - RNA, 3408 nt, synthetic construct
  misc_feature 1..3408: note = derived and/or modified CDS sequence (opt5) from DOBV(GER/08/118/Aa)__GQ205412.1__GP
  source 1..3408: mol_type = other RNA
atgatcatgtggggcctgctcgtgattctgagccttatcaacctgggggcctccctcagaaatgtctacgacatgaagattgagtgcccccactctatcaacttcggagaaagctccgttaccggcaaagtggagctgcctccgcttcccctgacagatgctgaaacgctcgtgcctgagtctagctgtaatatggacaaccatcagtccctgtctattacccaaaaggtcacaaaagtgagctggcggaagaaagccgataaggttcaggcggctaaggactcctttgaaaccacaagctctgagatcaatctgaaagggacctgcacactcacccaccgcatggtggaggaatcctatagaaaccgcaagagcgtcatctgttacgatctgtcttgcaattccacgcattgtaaacccaccatgcacatgattgtgcctgttcatagctgcaacatgatgaagtcttgtcttgtgggactgggcccctatcggatccaggtcgtgtacgagagaacatattgcaccacagggattctcaccgaaggaaaatgtttcgtgcctgaccagtccatcattagcgtcatgaagaatggcgtttttgatatcgcctccgtgtctattgtgtgcttctttatccggatcaagggcacgagctacaaaattatgacatccatcaaggaggccaacccgaataactgtaatgacaccgataacaaagtccaagggtattacctgtgcattgtgggagctaatagctctcccgtttacgccccttccacaaccgacttccgcagcgtggaggctcttgcctctctgctcagaagcccccacggcgaagatcacgacctggcgggggaggaagtcgccacctattccatcgctggacaggtggatggcaaggttcctcatacagccaacgctgccaacatgctgtttacggcgttctctgggattcccagctactccagcttttctgtgttcaccggaaatcaggacggcacagtcatctattccccgggcctctttcctaaactgaaccagagctcttgcgacaaggtggcccttcccctgatctgggaggggtacattgatctccctggatattacgaaaccgtccacccctgtaatgtgttctgcgttctgtccggccccggggctagctgtgaggccttttccgagggaggcatcttcaacattacatctcctacctgccttgtgagcaaacaaaatcggttccgcgctgccgaacagcagatcaactttgtctgtcagagagtggaccaagatattgttatctattgcaatgggcagaagaagacgatcctgacaaaaaccctcgtgattggacagtgtatctactccgtcacctctctgttcagcattatgccgggcgtggcccattccatcgctattgagctgtgcgtgcccggctttcacgggtgggcgacagccgctctcctgaccacattctgttttggatggatccttattcctagcatcacgctggccatcctcattgttctgaagttctttgccgcccttctgcacaactcttcccaagaaaatcggttcaaaatcattctcaagaaaatcaaggaggaatttgagaagaccaaaggcagcatggtctgcgaggtgtgtaagtacgaatgcgagacagggaaagaactgaaggcccataacctgtcttgcccccagtcccagtgtccttattgcttcacccactgtgagctcacagaaagcgcgtttcaggctcattaccgcgtgtgccaagccacccacagattccgggacgatctgaaaaagacgattacaccccagtctaccagcccgggatgttatcgcacccttaatctgtttagatacaagtcccggtgctatatcttcacagtctgggtgatcctcctgattatcgagagcattctgtgggccgcttctgcctccgagaccatccttgaacctagctggaacgacaatgctcatggcgttggggtggtccccatgcacacggatctcgagctggacttctccctgccttctagctccaaatacacatataagagaaaactcacctctcccattaaccaggaacagagcgtggatctgcacatcgagatcgagtcccaaggcatttctacaagcgttcatgcccttggacactggtttgacggccgcctgaatctcaagacctccttccattgttacggggcgtgcaccaaatacgaatatccttggcacacagccaagtgtcactttgagcgggatttcgaatacgagaacagctggtcttgcaaccccgctgactgtccgggaatcggcacggggtgcaccgcctgcggactgtatctggaccagcttaagcctgtgggctccgcttacaaactcattacagtcagatatagccgcaaggtgtgtgttcagtttggggaagagaatctgtgcaaaaccatcgatatgaacgactgtttcgtgacacggcatgtcaaggtgtgcattatcggcaccgtgtctaaattttcccagggagatacgctggtcttcctcggccccatggaagggggaggcctgatctttaaggactggtgtacaacaacctgccaattcggggatcccggagacattatgagccctaaagataagggcttttcttgtccggacttcaccgggcactttagaaagaaatgcaatttcgccaccacacccgtttgtgagtacgatggcaacatggtgtccggatataagaaagtgatggcgacgatcgacagcttccaggcctttaatacctccaacattcattacacagatgagcgcatcgaatgggaggaccctgatggcatgcttaaggaccacctgaatattctcgtcaccaaagacatcgatttcgaaaacctgggggagaatccctgcaaggtgggactgcagacagctagcattgacggcgcctgggggtctggagttggctttacccttacgtgtcagatcagcctcaccgagtgctcccggttcctgacatctatcaaggcttgcgatatggccatttgttacggggcccaaagcgtgaccctggtcagaggccagaacacagtgaaagtttccggaaagggcgggcattctggaagctcctttaaatgctgtcacggcaccgactgctctcagcaagggctccaggctagcgcgcctcacctggataaggtgaatggaatcgtcgaacaggagtccacacaggtgtatgacgatggcgctccccaatgtggcattagctgctggttcgttaaatctggggaatggatcaagggagtgttttccggcaactggattgtcatcgtggtgcttatcttcctgtttctcctgagcctgattcttctctctttcctgtgtcctatccgcaagcataaacggtcctga

SEQ ID NO: 13313 - RNA, 3408 nt, synthetic construct
  misc_feature 1..3408: note = derived and/or modified CDS sequence (opt5) from DOBV(GER/08/131/Af)__GQ205413.1__GP
  source 1..3408: mol_type = other RNA
atgatcatgtggggcctgctcctgacccttagcctgattaacctcggggcctccctgagaaatgtgtacgacatgaagatcgagtgcccccactctattaacttcggagaaagctccgtcacaggcaaagttgagcttcctccgctgctcctgacggatgctgaaaccctggtgcccgagtctagctgtaatatggacaaccatcagtccctctctatcacacaaaaggtgaccaaagtcagctggcggaagaaagccgataaggtgcaggcggctaaggactcctttgaaacaaccagctctgaggttaatctgaaagggacatgcacccttacgcaccgcatggtggaggaatcctatagaagccggaagtctgtcatttgttacgatctgtcctgcaacagcacccattgtaaacctacaatgcacatgatcgtgcccgttcattcttgcaatatgatgaagtcctgtctcgtgggactgggcccttatcgcatccaggtcgtgtacgagagaacctattgcacaaccgggattcttacggaaggaaaatgtttcgtgcccgaccagagcatcatttccgtcatcaagaacggcgtttttgatattgcctctgtgagcatcgtgtgcttctttattcggatcaagggcacatcctacaaaatcatgaccagcattaaggagtctaatcctaacaattgtaacgacacagataataaagtccaagggtattacctgtgcatcgtgggagccaactccagcccggtttacgctccctctaccaccgacttccgcagcgtggaggccctcgcttccctgctgagatctccttatggcgaagatcacgacctcgccggggaggaagtcgcgacatacagcattgccggacaggtggagggcaaggttccccacacggctaatgccgctaacatgctgtttaccgccttctccgggatccctagctattcttcctttagcgtgttcacaggaaaccaggatggcaatgtcatttactctcccggcctttttccgaaactgaaccagtccagctgcgaaaaggtggcgctccctctgatctgggaggggtatatcgaccttcccggatactatgagaccgtccatccttgtaatgtgttctgcgttctgtccggccccggggcctcttgtgaggcttttagcgagggaggcattttcaacatcacatcccctacctgcctcgtgtctaaacaaaatcggttccgcgccgctgaacagcagattaactttgtctgtcagagagtggaccaagatatcgttatttactgcaatgggcagaagaagacgatcctgacaaaaaccctggtgatcggacagtgtatttacagcgtcacctccctcttcagcatcatgcccggcgtggcccactctattgccatcgagctgtgcgtgccgggctttcatgggtgggctacagcggcccttctgaccacattctgttttggatggattctcatcccctccattacgctggctatccttatcgttctgaagttctttgccgccctcctgcacaacagctctcaagaaaatcggttcaaaattatcctgaagaaaattaaggaggagtttgaaaagaccaaaggctccatggtctgcgaggtgtgtaagtatgaatgcgagacagggaaagaactcaaggctcacaacctgagctgccctcagtctcagtgtccctactgcttcacccattgtgagcttacagagagcgcctttcaggcgcactatcgcgtgtgccaagctacccatagattccgggacgatctgaaaaagacgatcacccctcagtccacaagccccggatgttaccgcaccctcaatctgtttagatataagtctcggtgctacattttcacagtctgggtgatcctgcttatcattgaatccatcctctgggccgccagcgcttccgagattgttctggaaccgtcttggaacgacaatgcccacggcgtgggggtcgtgcctatgcataccgatctggagctcgacttcagcctgccctcctctagcaaatatacgtacaagagaaaacttacatcccctatcaaccaggagcagtctgttgatctgcacattgaaatcgagagccaaggcatctccaccagcgtgcacgctctcggacattggtttgacggccgcctgaatctgaagacatctttccactgttacggggcctgcaccaaatatgaatacccctggcataccgcgaagtgtcactttgagcgggatttcgaatatgagaactcctggagctgcaaccctgccgactgtcccggaattggcacagggtgcacggcttgcggactttacctcgatcagctgaagccggtcggctctgcctataaactgatcaccgtgagatactcccgcaaggtttgtgtgcagtttggggaggaaaatctctgcaaaacaattgacatgaacgactgtttcgtcacccggcacgtgaaggtgtgcatcattggcacagtcagcaaattttctcagggagataccctggttttccttggccctatggaagggggaggcctgatctttaaggactggtgtacgacaacctgccaattcggggatcccggagacatcatgtcccccaaagataagggctttagctgtcctgacttcaccgggcattttagaaagaaatgcaatttcgctacaaccccggtgtgtgaatatgatggcaacatggtgtccggatacaagaaagtcatggccacaattgacagcttccaggcgtttaatacgtctaacatccactacaccgatgagcgcattgaatggaaggacacagatggcatgctcaaagaccatctgaatatcctggtgaccaaggatattgacttcgagaaccttggggagaatccctgcaaggttggactccagacagccagcatcgacggcgcttgggggtccggagtgggctttaccctgacgtgtcagatttctctgaccgaatgcagccggttcctcacatccatcaaagcctgcgatatggctatctgttatggggcccaatctgtcaccctggtgagaggccagaacacagttcgcgtgagcggaaagggcgggcactccggatctagctttaaatgctgtcatggcaccgactgctcccaccaggggcttcaagccagcgctcctcacctggataaggtcaatggaattgtggagcaggaatctacacaggtttacgacgatggcgcgccccagtgtggcatctcctgctggttcgtgaaaagcggggagtggattaagggaatcttttctggcaactggattgtcatcgtggtgctcatcttcctgtttctgctttccctcattctgctgagcttcctctgtcctatccggaagcataaaagatcctga

SEQ ID NO: 13314 - RNA, 3408 nt, synthetic construct
  misc_feature 1..3408: note = derived and/or modified CDS sequence (opt5) from DOBV(GRW/Aa)__JQ026205.1__GP
  source 1..3408: mol_type = other RNA
atgatcatgtggggcctgctcctgacccttagcctgattaacctcggggcctccctgagaaatgtgtacgacatgaagatcgagtgcccccactctattaacttcggagaaagctccgtcacaggcaaaggggagcttcctccgctgctcctgacggatgctgaaaccctggttcccgagtctagctgtaatatggacaaccatcagtccctctctatcacacaaaaggtgaccaaagtgagctggcggaagaaagccgataaggtccaggcggctaaggactcctttgaaacaaccagctctgaggtgaatctgaaaggaacatgcacccttacgcaccgcatggttgaggaatcctatagaagccggaagtctgtgatttgttacgatctgtcctgcaacagcacccattgtaaacctacaatgcacatgatcgtccccgtgcattcttgcaatatgatgaagtcctgtctcgttggcctggggccttatcgcatccaggtggtctacgagagaacctattgcacaaccgggattcttacggaaggcaaatgtttcgtgcccgaccagagcatcatttccgtgatcaagaacggcgtctttgatattgcctctgttagcatcgtgtgcttctttattcggatcaaggggacatcctacaaaatcatgaccagcattaaggagtctaatcctaacaattgtaacgacacagataataaagtgcaaggatattacctgtgcatcgtcggcgccaactccagcccggtgtacgctccctctaccaccgacttccgcagcgttgaggccctcgcttccctgctgagatctccttatggggaagatcacgacctcgccggagaggaagtggcgacatacagcattgccggccaggtcgaggggaaggtgccccacacggctaatgccgctaacatgctgtttaccgccttctccggaatccctagctattcttcctttagcgttttcacaggcaaccaggatggcaatgtgatttactctcccgggctttttccgaaactgaaccagtccagctgcgaaaaggtcgcgctccctctgatctgggagggatatatcgaccttcccggctactatgagaccgtgcatccttgtaatgtcttctgcgtgtcctctgggcccggagccagctgtgaggctttttccgaaggcgggattttcaacatcacatctcctacctgcctggttagcaaacaaaatcggttccgcgccgctgaacagcagattaactttgtgtgtcagagagtcgaccaagatatcgtgatttactgcaatggacagaagaagacgatcctcacaaaaaccctggttatcggccagtgtatttactccgtgaccagcctgttctctatcatgcccggcgtcgcccactccattgccatcgagctctgcgtgccggggtttcatggatgggctacagcggccctgcttaccacattctgttttggctggattctgatccccagcattacgctcgctatcctgatcgtgcttaagttctttgccgccctgctccacaactcttcccaagaaaatcggttcaaaattatcctgaagaaaattaaggaggagtttgaaaagaccaaagggagcatggtttgcgaggtctgtaagtatgaatgcgagacaggaaaagaactgaaggctcacaacctctcttgccctcagagccagtgtccctactgcttcacccattgtgagctgacagagtccgcctttcaggcgcactatcgcgtgtgccaagctacccatagattccgggacgatcttaaaaagacgatcacccctcagagcacatctcccggctgttaccgcaccctgaatctctttagatataagtcccggtgctacattttcacagtgtgggtcatcctgctgatcattgaaagcatcctttgggccgcctccgcttctgagattgtgctcgaaccgagctggaacgacaatgcccacggggttggcgtggtccctatgcataccgatctggagctggacttctccctcccctctagctccaaatatacgtacaagagaaaactgacatctcctatcaaccaggagcagagcgtggatcttcacattgaaatcgagtcccaaggaatcagcacctctgttcacgctctgggccattggtttgacgggcgcctcaatctgaagacatccttccactgttacggagcctgcaccaaatatgaatacccctggcataccgcgaagtgtcactttgagcgggatttcgaatatgagaacagctggtcttgcaaccctgccgactgtcccggcattgggacaggatgcacggcttgcggcctgtaccttgatcagctcaagccggtggggtccgcctataaactgatcaccgtcagatacagccgcaaggtgtgtgttcagtttggcgaggaaaatctgtgcaaaacaattgacatgaacgactgtttcgtgacccggcacgtcaaggtgtgcatcattggaacagtgtctaaattttcccagggcgataccctcgtcttcctggggcctatggagggaggcgggcttatctttaaggactggtgtacgacaacctgccaattcggagatcccggcgacatcatgagccccaaagataaggggttttcctgtcctgacttcaccggccattttagaaagaaatgcaatttcgctacaaccccggtttgtgaatatgatggaaacatggtgagcggctacaagaaagtgatggccacaattgactctttccaggcgtttaatacgagcaacatccactacaccgatgagcgcattgaatggaaggaccccgatgggatgctgaaagaccatctcaatatcctggtcacaaaggatattgacttcgagaacctgggagagaatccttgcaaggtgggccttcagaccgcctccatcgacggggcttggggatctggcgttgggtttacactcacctgtcagattagcctgacggaatgctcccggttcctgacctctatcaaagcctgcgatatggctatctgttatggcgcccaaagcgtgacactcgtcagaggacagaacaccgtgcgcgtttccggcaagggaggacactctggcagctcctttaaatgctgtcatgggacagactgcagccaccagggactgcaagcctctgctccccaccttgataaggtgaatggcattgtcgagcaggaatccacccaggtgtacgacgatggcgcgcctcagtgtgggatcagctgctggttcattaaatctggagagtggatcaagggcatcttttccgggaactggattgttatcgtggtcctgattttcctctttctgctgagccttatcctcctgtccttcctgtgtcccattcggaagcataaaagatcttga

SEQ ID NO: 13315 - RNA, 3408 nt, synthetic construct
  misc_feature 1..3408: note = derived and/or modified CDS sequence (opt5) from DOBV(Slo/Af-BER)__GU904035.1__GP
  source 1..3408: mol_type = other RNA
atgatcatgtggggcctgctcctgaccatgattcttatcgacttcggggccagcctgagaaacgtgtacgatatgaagattgagtgcccccactccatcaattttggagaatctagcgtcacaggcaaagttgagctccctccgctgcttctgacggacgctgaagccctcgtgcccgagtcctcttgtaacatggataatcatcagagcatgtccattatccaaaaggtgaccaaagtctcttggcggaagaaagcggacaaggctcaggccgccaaggatagcttcgaaacaacctccagcgaggtgaacctgaaagggacatgcaccctgtctcaccgcatggttgaggaatcctatagaaatcggcgcagcgtgatctgttacgacctctcttgcaactccacacattgtaagcctaccatgcacatgattgtccccgtgcatagctgcaatatgatgaaatcttgtctggttggacttggcccttatagaatccaggtggtctacgagcggacgtattgcaccacagggattctgaccgaaggaaagtgttttgtgcccgatcagtccatcgtgagcgtcattaaaaacggcgttttcgacatcgcttccgtgtctattgtgtgctttttcatccgcgtcaagggcacaaattacaagatcatggccagcattaaaaccgctacggccaacaattgtaacgatacagacaataaggtgcaagggtattacctctgcatcgttggaggcaactccagccctgtgtacgcgccgtctaccacagattttagatccatggaggccctggctagccttctgcgggctccccacggggaggaccacgatctctctggagaagaggtcgctacctatagcattgccggccagatcgaagggaaaattcctcataccgcgaatgccgctaacatgctgttcacagccttttccggaatcccctcttacagctccctgagcgtgttcatcggctctcaggacggccctattatctattcccccgggctctttccgaagctgaaccagagctcttgcgacaaagttgcccttcctctgatttgggagggatacatcgatctccccggctattacgaaacggtgcacccttgtaatgtcttctgcgtgctgtccgggcccggagccagctgtgaggccttttccgagggcgggattttcaacatcacctctcccacatgccttgtcagcaagcaaaatcgcttcagagctgcggaacaacaggtgaactttgtttgtcagcgggtggaccaggatatcattatctattgcaatggacagaaaaagaccattctgacaaagaccctcgtcatcggccagtgtatttactccgtgacgtctctgttcagcatcatgcctggcgttgcccattccattgctatcgagctgtgcgtgccggggtttcacggatgggccacagccgctctcctgaccaccttctgttttggctggatccttattcccagcatcacactggccgtcctcgtggtgctgaaattctttgcggctattcttcacaactcttcccaagaaaatcgcttcaagatcattctgagaaaaatcaaggaggaatttgagaaaaccaaggggagcatggtttgcgaggtctgtaagtacgaatgcgagacaggaaaagaactcaaggcccataacctgtcttgccctcagtcccagtgtccctattgcttcacgcactgtgagcctaccgaaagcgcctttcaggctcattacaaagtgtgccaagccacacaccggttccgcgacgatctgaagaaaaccatcacaccccagtctaccagcccgggctgttatagaacgctcaatctgtttcggtacaagtccagatgctatattttcaccgtgtgggtcacacttctgatcattgagagcatcatgtgggctgcctctgcgtccgagaacgtgctcgaacctagctggaatgacaacgcccatggggttggcgtggtccccatgcacaccgatctggagctggacttctcccttccttctagctccaagtacacatataaacgcaagctcacctctcccctgaatcaggaacagagcgtggatctgcacattgagatcgagtcccaaggaatctctacgagcgttcatgctctcggccactggtttgacgggcggctgaaccttaaaacatccttccattgttacggagcctgcaccaagtacgaatatccttggcacacagctaaatgtcactttgagagagatttcgaatacgagaatagctggggctgcaaccccgccgactgtccggggattggaaccggctgcaccgcgtgcgggctgtatatcgaccagctcaagcctgtgggctctgcctacaagctgattacagtccgctattcccggaaagtgtgtgttcagtttggagaagagaacctgtgcaagacgatcgatatgaatgactgtttcgtgaccagacatgtcaaagtgtgcattatcggcacagtgagcaagttttctcagggggatacccttgtcttcctcggacccatggagggcgggggactgatctttaaagactggtgtacatccacgtgccaattcggcgatcccggggacattatgagccctaaggataaaggcttttcttgtccggacttcaccggacactttcgcaagaagtgcaacttcgctacaacccccgtttgtgaatacgatggcaatatggtgtccgggtataaaaaggtgatggccaccatcgacagcttccagtcctttaacacaagctctattcattacaccgatgagcggatcgaatggaaagaccctgatggaatgctgaaggaccacctcaatattctggtcacaaaagacatcgatttcgagaaccttggcgaaaatccctgcaaggtggggctgcagacgagctccattgagggagcttggggctctggggttggctttaccctcacatgtcagatcagcctgaccgagtgctccagattcctgacatctatcaaggcctgcgacatggccatttgttacggagctcaaagcgtgacccttatccgcggccagaacacggtcaaagtgtccgggaagggaggccattctgggagctcctttaaatgctgtcacggaaccgattgcagccagcaaggcctccaggcgtctgcccctcacctggacaaggttaatggcattgtggaacaggattccgagaaagtctatgacgatggggctccccagtgtggaatcagctgctggttcgtgaagtctggcgaatggattacagggatctttaacggaaattggatcgttattgtggtcctggtgttctttttcatcctctccctgattcttctgagcctcctgtgtcctatccggaagcataaaagatcctga

SEQ ID NO: 13316 - RNA, 3408 nt, synthetic construct
  misc_feature 1..3408: note = derived and/or modified CDS sequence (opt5) from HTNV(76-118/POR)__KT885048.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcgggggaaattctgtcatcggctatgtggaactgccgcccgttcctctcgctgatacggcccagatggtgcccgagagctcctgttctatggacaaccatcaaagcctgaataccattacaaagtacacccaggtctcctggcgggggaaagcggatcagtctcagagctcccaaaacagctttgaaacagtgtctaccgaggttgaccttaagggaacatgcgtgctgaaacacaagatggtcgaagagtcctatcgcagcagaaagtctgtgacctgttacgatctctcctgcaatagcacgtattgtaaacctaccctgtacatgatcgtgcccattcatgcttgcaacatgatgaagtcttgtctgatcgccctcggcccttatcgggtccaggttgtgtacgagcgcacatactgcatgaccggggtgctgatcgaaggaaaatgtttcgtcccggaccagtccgtggttagcattatcaagcacggcatttttgatatcgcctccgtgcatattgtctgcttctttgtggctgttaaaggcaatacatataagatcttcgaacaggtgaagaaatcttttgaaagcacctgtaacgacacggagaataaggtccaagggtactatatttgcatcgtgggaggcaactccgcccccatctacgtccctacacttgatgacttcagaagcatggaggcttttaccgggattttccggtctccccacggagaagatcacgacctggccggcgaggaaatcgcgtcctatagcattgtggggcctgccaatgctaaagttccccattctgccagctccgatacactccgcctgatcgcttactctgggattccgagctattccagcctttctatcctgacctccagcaccgaggccaagcacgtgttttctcctggcctcttccccaaactgaaccatacaaattgcgacaagtccgcgatccctctgatttggacgggcatgatcgacctccccgggtactacgaagccgtccacccctgtaccgtgttttgcgttctgagcggacctggcgcttcctgtgaggccttctctgagggaggaattttcaacatcacaagctccatgtgccttgtgtctaaacagaatagatttcggctgaccgaacagcaggtcaacttcgtgtgtcaacgcgtggatatggacattgttgtctattgcaacggccagagaaaggtgatcctcacaaagaccctggtgatcgggcagtgtatttacacgatcacaagcctgttttcccttctcccgggagtcgctcacagcattgccgtggagctgtgcgttcccggcttccatggctgggccaccgctgcgctgctcgtgaccttttgtttcgggtgggtcctgatccctgccattacatttatcattcttaccgtgctgaaattcatcgctaatatctttcacacatctaaccaagaaaatcggctcaagtccgttctgcgcaaaattaaggaggagttcgagaaaacgaagggaagcatggtgtgcgatgtctgtaagtatgagtgcgaaacctacaaagagcttaaggcccatggcgtgtcttgcccccagtcccagtgtccttattgctttacacactgtgaacccaccgaggccgctttccaggcccattacaaagtttgccaagtgacacacagatttcgggacgatctgaagaaaaccgtcacgccgcagaacttcacccctgggtgttatcgcacactcaatctgttcagatacaagagccggtgctacatctttaccatgtggattttcctgctcgtgctggaatctatcctttgggcggctagcgcctccgagacacccctgacccctgtgtggaacgacaatgcccacggagtcggcagcgttcccatgcatacggatctcgagctggacttttctctgacatccagctccaagtatacctacagacgcaaacttacaaaccctctcgaagaggctcagtctattgatctgcacatcgaaatcgaggagcagaccattggggtggacgtgcatgccctgggccactggttcgatggacggctcaatctgaagaccagctttcactgttatggcgcttgcacaaaatacgaatatccctggcatacggccaagtgtcactacgagagagactatcaatacgaaacctcctgggggtgcaacccgtctgactgtcctggagtcggcacagggtgcaccgcgtgcggactttacctggatcagctcaaacccgtgggcagcgcctataagatcattacaatccgctactcccggagagtttgtgtgcagttcggggaggaaaatctgtgcaagattatcgacatgaacgattgttttgtctctcgccatgtgaaagtttgcatcattggcaccgtgagcaagttctcccagggagacacgctgctctttttcggcccccttgaagggggaggcctgatctttaaacactggtgtacatctacctgccaattcggggatcctggagacattatgagcccgcgggataagggctttctgtgtcccgagttccctgggtccttcagaaagaagtgcaattttgctaccacacccatctgtgagtatgacggcaacatggtcagcggatacaaaaaggtgatggccaccattgattctttccagtcctttaatacaagcacgatgcatttcaccgacgagcgcatcgaatggaaggatcctgacggcatgctccgggatcacatcaacattctggttacaaaagacatcgactttgataaccttggggagaatccctgcaagattggactgcagacctcttccatcgaaggcgcttgggggagcggagtgggcttcacactcacctgtctggtctccctgacggagtgccctacctttcttacaagcattaaagcctgcgacaaggcgatctgttatggggccgagtctgtgaccctcacaagaggccagaacaccgtgaaagtcagcggaaagggcgggcactccggatctacattcaagtgctgtcatggcgaagattgcagccaaattgggctgcacgctgccgctccccatctggacaaagttaatggaatctccgagatcgaaaactctaaggtgtacgatgacggcgccccgcagtgtggcattaaatgctggtttgtcaagagcggggagtggatctccggaattttctctggcaattggatcgtgctcattgtgctgtgtgtttttcttctgttcagcctcgtgctgctgtccatcctttgccctgtccgcaaacacaaaaagagctga

SEQ ID NO: 13317 - RNA, 3408 nt, synthetic construct
  misc_feature 1..3408: note = derived and/or modified CDS sequence (opt5) from HTNV(76-118)__Y00386.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcgggggaaattctgtcatcggctatgtggaactgccgcccgttcctctcgctgatacggcccagatggtgcccgagagctcctgttctatggacaaccatcaaagcctgaataccattacaaagtacacccaggtctcctggcgggggaaagcggatcagtctcagagctcccaaaacagctttgaaacagtgtctaccgaggttgaccttaagggaacatgcgtgctgaaacacaagatggtcgaagagtcctatcgcagcagaaagtctgtgacctgttacgatctctcctgcaatagcacgtattgtaaacctaccctgtacatgatcgtgcccattcatgcttgcaacatgatgaagtcttgtctgatcgccctcggcccttatcgggtccaggttgtgtacgagcgcacatactgcatgaccggggtgctgatcgaaggaaaatgtttcgtcccggaccagtccgtggttagcattatcaagcacggcatttttgatatcgcctccgtgcatattgtctgcttctttgtggctgttaaaggcaatacatataagatcttcgaacaggtgaagaaatcttttgaaagcacctgtaacgacacggagaataaggtccaagggtactatatttgcatcgtgggaggcaactccgcccccatctacgtccctacacttgatgacttcagaagcatggaggcttttaccgggattttccggtctccccacggagaagatcacgacctggccggcgaggaaatcgcgtcctatagcattgtggggcctgccaatgctaaagttccccattctgccagctccgatacactctctctgatcgcttacagcgggattccgtcctatagctctctttccatcctgaccagctctaccgaggccaagcacgtgttttcccctggcctcttccccaaactgaaccatacaaattgcgacaagagcgcgatccctctgatttggacgggcatgatcgacctccccgggtactacgaagccgtccacccctgtaccgtgttttgcgttctgtccggacctggcgcttcttgtgaggccttcagcgagggaggaattttcaacatcacatccccgatgtgccttgtgtctaaacagaatcgctttagactgaccgaacagcaggtcaacttcgtgtgtcaacgggtggatatggacattgttgtctattgcaacggccagcgcaaggtgatcctcacaaagaccctggtgatcgggcagtgtatttacacgatcacaagcctgttttcccttctccccggagtcgctcacagcattgccgtggagctgtgcgttcctggcttccatggctgggccaccgctgcgctgctcgtgaccttttgtttcgggtgggtcctgatccccgccattacatttatcattcttaccgtgctgaaattcatcgctaatatctttcacacatctaaccaagaaaatagactcaagtccgttctgcggaaaattaaggaggagttcgagaaaacgaagggaagcatggtgtgcgatgtctgtaagtatgagtgcgaaacctacaaagagcttaaggcccatggcgtgtcttgccctcagtcccagtgtccctattgctttacacactgtgaaccgaccgaggccgctttccaggcccattacaaagtttgccaagtgacacaccgctttagagacgatctgaagaaaaccgtcacgcctcagaacttcacccccgggtgttatcggacactcaatctgttccgctacaagagcagatgctacatctttaccatgtggattttcctgctcgtgctggaatctatcctttgggcggctagcgcctccgagacacctctgacccccgtgtggaacgacaatgcccacggagtcggcagcgttcctatgcatacggatctcgagctggacttttctctgacatccagctccaagtatacctaccggagaaaacttacaaaccccctcgaagaggctcagtctattgatctgcacatcgaaatcgaggagcagaccattggggtggacgtgcatgccctgggccactggttcgatggacgcctcaatctgaagaccagctttcactgttatggcgcttgcacaaaatacgaatatccgtggcatacggccaagtgtcactacgagcgggactatcaatacgaaacctcctgggggtgcaacccttctgactgtcccggagtcggcacagggtgcaccgcgtgcggactttacctggatcagctcaaacccgtgggcagcgcctataagatcattacaatcagatactcccgccgggtttgtgtgcagttcggggaggaaaatctgtgcaagattatcgacatgaacgattgttttgtctctagacatgtgaaagtttgcatcattggcaccgtgagcaagttctcccagggagacacgctgctctttttcggccctcttgaagggggaggcctgatctttaaacactggtgtacatctacctgccaattcggggatccgggagacattatgagcccccgcgataagggctttctgtgtcctgagttccccgggtccttccggaaaaagtgcaattttgctaccacacctatctgtgagtatgacggcaacatggtcagcggatacaaaaaggtgatggccaccattgattctttccagtcctttaatacaagcacgatgcatttcaccgacgagagaatcgaatggaaggatcccgacggcatgctccgcgatcacatcaacattctggttacaaaagacatcgactttgataaccttggggagaatccttgcaagattggactgcagacctcttccatcgaaggcgcttgggggagcggagtgggcttcacactcacctgtctggtctccctgacggagtgccccacctttcttacaagcattaaagcctgcgacaaggcgatctgttatggggccgagtctgtgaccctcacacggggccagaacaccgtgaaagtcagcggaaagggcgggcactccggatctacattcagatgctgtcatggcgaagattgcagccaaattgggctgcacgctgccgctccgcatctggacaaggttaatggaatctccgagatcgaaaactctaaagtgtacgatgacggcgcccctcagtgtggcattaagtgctggtttgtgaaaagcggggagtggatctccggaattttctctggcaattggatcgtcctcattgtgctgtgtgtttttcttctgttcagcctcgtgctgctgtccatcctttgccccgtccgcaagcacaaaaagagctga

SEQ ID NO: 13318 - RNA, 3408 nt, synthetic construct
  misc_feature 1..3408: note = derived and/or modified CDS sequence (opt5) from HTNV(A16)__AF288645.1__GP
  source 1..3408: mol_type = other RNA
atgggcctgtggaagtggctcatcatggccgtgctggtctggccctgcttcgctcttagaaacgtttacgacatgaaaattgagtgtcctcacaccgtgaattttggggaaaacagcgtggtcggatatgtggagctgccgcccatgcctatcgccgatattacacagatgatgcccgaatcctcttgcagcatggacaatcatcaatccctcaacacgatcaccaagtacacacaggtttcttggcggaaaaaggcggatcaggctcagagctcccaaacctctttcgagacagtgagctccgaagtcgactttaaaggcacctgtgtgctgaagcacaagatgattgaggatagctatcgctctagacggtccatcatctgctacgaccttagctgtaattctacattctgcaaacctaccctgtatctcattgttcccgtgcatgcctgtaacatgatgaagtcctgcctgatcgccctggggccttaccgcgtccaggtggtgtatgagagaacgtactgtatgagcggagtcctcctggaaggcaaatgctttgttccggatcagtctgtggtgtccattatcaagcacgggattttcgacatcgctagcgtccatattgtgtgctttttcgttgccatcaaaggatccacctacaagatccttgaacaggtgaagaaatcttttgagctgacatgtaatgataccgacaacaagattcaaggctattacatctgcctcgtcggcgggaatagcgctcccatttatgtgcctacactggatgacttccggtccatggaggcctttgcgggaatcttcaaaagcccccacggcgaggatcacgaccttgccggggaagaggttgcttcttactccattgtgggacctgccaacgctaaggtcccccatagcgcctctgcggacaccctgggcctcgtggcctttagcgggatcccgtcctattctagcttctccgtcctgacgggaagcacagatgctcgccacgtgttctctcctggctttttcccccagctgaatcagaccagatgtgacaaaacagccatccctctcacctggaccggcatgattgatctgcccgggtactatgaagctgttcatccctgcacagtgttttgtgtcctttccggacctggcgccagctgcgaggccttctctgaagggggaatctttaacattacgtccccgatgtgtctggtgagcaagcagaatcggttccgctcctctaaacaacaggttaactttgtgtgccagagagtcgacatggatatcgtggtgtactgtaatggccaaaagaaggttattctcaccaaaacactggtcatcgggcagtgcatctacaccattacaagccttttctccctgctccccggagtggctcactctatcgcggtggagctgtgtgtccctggctttcacggctgggccaccgctgccctgctcgtgacgttctgctttgggtgggttctgattcccgccgtgacacttgtcatcctgaccattctcaagttcatcgctaacatttttcataccagcaaccaggagaatcggctgaaatccgtgcttaagaaaatcaaggaagagttcgaaaagacaaaaggaagcatggtttgtgacgtgtgcaagtatgagtgcgaaacctacaaagagctgaaggcccacggcgtctcttgtcctcagtcccaatgcccctattgtttcacacattgcgagccgacggaagcggcttttcaggcccactacaaagtgtgtcaggttacccatcgcttcagagatgacctcaagaagacagtgacccctcagaactttacacccgggtgctatcggaccctgaatctgttccgctacaaaagcagatgttatatctttacgatgtgggtcttcctcctgattcttgagtctatcctgtgggccgcttccgccagcgaaacccctctcacacccatttggaacgataatgctcacggagtgggctctatccctatgcacaccgacctggagctggattttagccttacatccagctctaagtacacctaccggagaaaactcacgaaccccctggaagagacacaagccgtggacctgcatattgagctcgcggaacagaccatcggggtcgacgttcacgccctgggccattggttcgatggacgccttaatctgaagacatcctttcactgctatggcgcttgtaccaaatacgagtatccgtggcacaccgccaagtgccattacgaacgggactatcagtacgagacaagctgggggtgtaacccttccgattgccccggagtgggcacggggtgcaccgcttgtggactctatctggaccagctgaagcccgtgggctctgcctacaaaatcattacaatcagatacagccgccgggtctgcgtgcaattcggggaggaaaatctttgtaaggttattgatatgaacgactgctttgtgtccagacacgtcaaagtgtgtatcattggcaccgtttctaagttcagccagggagatacactcctgtttttcggccctctggaagggggaggcctcatcttcaaacattggtgcacctccacgtgtcagtttggggacccgggagatatcatgtctccccgcgacaagggcttcctgtgccctgagtttcccgggagcttccggaaaaagtgtaattttgcgacaacccctctttgcgagtatgatggcaacatgatttccggatacaagaaagtgatggccaccatcgacagcttccagtcttttaatacatccaccatgcacttcacagatgaaagaattgagtggaaggaccccgacggcatgctgcgcgatcatatcaacattctcgtcacgaaagacatcgattttgacaatctgggggagaacccttgtaagatcggactgcaaaccagctctattgaaggcgcttgggggtccggagtgggcttcacacttacctgcctcgttagcctgacagagtgccccacctttctgacgtctatcaaagcctgtgataaggctatttgctatggggccgaatccgtgaccctcacacggggccagaacaccgtcaaggtgagcggaaaaggcgggcactccggaagcacattcaagtgttgccacggcgaggactgttctcagaccgggctgcatgccgctgcgccgcaccttgataaagtgaatggaatcagcgaaattgagaactccaaggtctacgacgatggcgcccctcaatgcggcatcaaatgttggttcgttaagtctggggagtggattagcggaatcttttccggcaattggatcgtgctgattgtgctctgcgtcttcctgctgttttctcttgtgctcctgagcgttctgtgtcccgtgagaaagcataaaaagtcctga

SEQ ID NO: 13319 - RNA, 3408 nt, synthetic construct
  misc_feature 1..3408: note = derived and/or modified CDS sequence (opt5) from HTNV(A9)__AF035831.1__GP
  source 1..3408: mol_type = other RNA
atgggcatctggaagtggctggtgatggccagcctcgtctggcccgcttacaccctgagaaacgcctatgacatgaaaattgagtgccctcacacagtttccttcggggaaaattctgtgatcggatacgtggagcttccgcccattcctctggcggatacgacccagatggtccccgaaagctcctgttctatggacaaccatcaaagcctcaatacaatcaccaagtatacacaggtgtcctggcggggcaaagctgatcacgcccaggcctctcagaacagctttgaggctgtttccgccgaagtggacctgaaggggacctgcgtccttaaacataagatgctggaggagagctaccgctctagaaagtccattgcttgttatgatctcagctgcaattctacatactgtaaacctaccctgtatatgatcgtgcccatccacgcctgcaacatgatgaagtcctgtctgattgcgctcggacctcatcgggttcaagtggtctacgaacgcacgtactgcatgaccggcgtgctgatcgaggggaaatgtttcgtgccggaccagagcgtcgtttctattatcaagcacggaatttttgatatcgcctccgtgcacattgtgtgcttctttgtcgctgtgaaaggcaatacatataagatcttcgaacagatcaagaaatcctttgagagcacctgtaacgacacaaagaataaagttcagggctactatatttgcatcgtcgggggaaactctgcccccatttacgtgcctacccttgatgacttcagaagcatggaggctttttccggcatcttccggagcccccatggggaagatcacgacctggccggagaggaaattgcgtcttattccatcgtgggccctgccaatgctaaggttccccatagcgcctctagcgatacgctctccctgacagcttactctgggatcccgagctattccagcctttctattctggccggatccgccgaggctaaacacgtgtttagccctggcttctttccccaactcaaccacaccaagtgcgacaaaacagcgatccctctgatgtggaccggcatgattgacctgcccgggtactacgaagccatccatccctgtaccgtcttctgcgtgctctctggacctggcgcttcctgtgaggccttcagcgaagggggaatttttaatatcacatccccgatgtgcctggtctctaagcagaaccgcttcagacttacggagcaacaggtgaattttgtttgtcagcgggtggatatggacatcattgtctattgcaacggccagcgcaaggtgatcctgaccaaaacactcgttattgggcagtgtatctacaccattacaagcctgttctcccttctgcccggagtggcccactctatcgctgtcgagctctgcgtgcctggctttcatggctgggccaccgcggctctgctggtgacgttctgttttgggtgggttctcattcccgccatgacattcatcgtcctgaccatccttaagtttattgccaacatcttccacaccagcaatcaagaaaacaaactgaagtccgtgctcagaaaaattaaggaggaatttgagaagacaaaaggaagcatggtgtgcgatgtctgtaagtatgagtgcgaaacctacaaagagctgaaggctcatggcgtgtcttgccctcagtcccagtgtccctattgcttcacacactgtgaaccgacggaggccgcttttcaggcccactaccgggtttgccaagtgacccatcgcttcagagacgatcttaaaaagacagtcacccctcagaatttcacacccgggtgttatcggaccctgaacctctttcgctacaagagcagatgctacatcttcacgatgtgggtgtttctgctggttctcgaatctattctgtgggcggcctccgctagcgagatccctcttaatcccgtgtggaacgacaatgcccacggagtcggctctgtgcctatgcccaccgatctggagctcgacttcagcctgacatccagctctaaatatacctaccggagaaagctgacaaacccgcttgaagagtcccaggctatcaatctccatattgaaatcgaggagcagaccattggggttgatgtgcacgccctgggccactggtttgacggacgcctgaacctcaaaacgagcttccattgttatggcgcgtgcacaaagtacgaatatccttggcacaccgccaaatgtcattacgagcgggattatcaatacgaaacatcctgggggtgcaatccctctgactgtcccggagtcggcaccgggtgcaccgcttgcggactgtaccttgaccagctgagagccgtgggcagcgcttataagatcattacaatccgctactcccggagagtgtgtgtccagtttggggaggaaaacctctgcaagatcattgatatgaatgactgtttcgtttctcgccacgtgaaagtgtgcatcattggcacggtcagcaagttttcccagggagataccctgctgttctttggccctcttgaagggggaggcctcatcttcaaacattggtgtacatctacctgccaatttggggacccgggagatattatgagcccccgggacaagggcttcctgtgtcctgagttccccgggtccagcagaaagaagtgcaactttgccacaacccctctgtgtgagtatgatggcaatatggtgtctggatacaaaaaggttatggccacgatcgactccttccagagctttaacacatctaccatgcacttcaccgatgagcgcatcgaatggaaggaccccgatggcatgctccgggaccacattaacatcctggtgacaaaagatattgactttgagaatcttgggggaaacccttgcaagatcggcctgcagacctccagcattgaaggggcttggggatctggcgtcgggttcacactcacgtgtctggtgtccctgaccgagtgccccacatttcttaccagcatcaaagcgtgcgacaaggccatttgttatggcgctgagtccgttacactcaccagaggacagaatacggtgaaagtcagcggcaaagggggacattctggcagcaccttcaagtgctgtcacggggaagagtgctcccaaatcggactgcatgccgccgctccgcacctggataaagtgaacggcatctctgaaattgagaataacaaggtttacgacgatggcgcccctcagtgtgggatcaaatgctggtttgtcaagagcggagaatggatttccggcatcttctctgggaattggattgtgctcatcgtgctgtgtgtgtttcttctgttcagcctcatcctgctgtccattctttgccccgtccgcaaacataagaagtcttga

SEQ ID NO: 13320 - RNA, 3408 nt, synthetic construct
  misc_feature 1..3408: note = derived and/or modified CDS sequence (opt5) from HTNV(84FLi)__AF345636.2__GP
  source 1..3408: mol_type = other RNA
atgggcgtgtggaagtggctggtcatggccagcctcgtttggcccgcctgcaccctgagaaacgtgtacgacatgaaaatcgagtgtcctcacacagtgtccttcggggaaaattctgtcattggatatgtggagcttccgcccatgcctctggccgatacgacccagctcgttcccgaaagctcctgctctatggacaaccatcaaagcctgaatacaatcaccaagtacacacaggtgtcctggcggaaaaaggcggatcaggctcagtctagccaaaactcctttgagaccgtcagcgtggaagttgaccttaaaggcacatgtgtgctgaagcacaagatgattgaggagtcttatcgctccagaaaaagcattacctgctacgatctctcttgtaattccacgtattgcaagcctaccctgtacatgatcgtccccatccatgcctgtaacatgatgaaaagctgcctgatcgccctcgggccttatcgggttcaggtggtctacgaacgcacatactgtatgaccggagttctgattgagggcaagtgcttcgtgccggaccagtctgtggtctccatcattaaacacgggatctttgatattgctagcgtgaagatcgtttgtttctttgtggccgtcaagggaaatacatataaacttttcgaacaggtgaagaaatcctttgactctacctgcaacgatacggagaataaggttcaaggctactatatttgcatcgtgggcgggaacagcgctcccatctacgtccctacactggacgatttcagatccatggaggcctttagcggaattttccggtctccccatggcgaagaccacgatctcgcgggggaggaagtggcctcctatagcatcgtcggacctgctaatgccaaagtgccccactctgctagctccgacaccctgtctcttattgcctacagcggcatcccgtcctatagctctctgtccattctcacaagctctaccgaggcgaagcatgtgttttcccctgggttctttccccagctgaaccacaccaaatgtgacaagacagccatccctctgacgtggaccggaatgatcgatctccccggctactacgaagctattcatctgtgcacagtgttctgtgtccttagcggccccggggcctcctgcgaggctttctctgagggaggcatctttaatattaccagccctatgtgtctggtgtccaagcagaaccagttccgcctcacaaaacaacaggttaattttgtgtgccagagagtcgacatggatatcgtggtgtattgtaacgggcaacggaaggttattctgaccaaaacgatggtcatcggacagtgcatctacacaattacctctcttttcagcctgctcccgggcgtggcccactccatcgccgtggaactgtgtgtccccgggtttcacggatgggctaccgcggccctgctcgtgacattctgctttggctgggttctgattcctgctgtgaccttcatcattcttacagtcctgaagtttgtggccaacatcttccatacgagcaatcaggagaaccgcctcaaatctgttctgagaaagattaaggaagagtttgaaaagaccaagggctccatggtgtgtgacgtctgcaaatatgagtgcgagacataccgggaacttaaggcccacggggtgagctgtccccagtctcaatgcccttattgtttcacccattgcgagcccacagaagctgcctttcaggcgcactaccgcgtttgtcaggtgacccatagattccgggatgacctgaaaaagacggtcaccccgcagaatttcacacctggatgctatcgcaccctcaacctgtttagatacaagtcccggtgttacatcttcacaatgtgggtgtttctgctcgtgctggagagcatcctttgggctgcctctgccagcgaagtccccctgaatcctatttggaacgataatgctcacggcgttgggtccgtgcccatgcacaccgacctcgagctggatttcagcctgacgtcttccagcaaatatacatacagacgcaagctgaccaaccctctcgaggaaacacaagccatcgacctgcatattgagatcgaggaacagaccattggagtggatgtccacgctctgggccattggtttgacgggcggctcaatctgaaaacctccttccactgctatggcgcctgtacaaagtacgagtatccctggcacacggcgaaatgccattacgaaagagactatcagtacgagacctcttggggatgtaacccgagcgattgccctggcgtggggacaggatgcaccgcctgtggcctttacctggaccagctcaagcccgttgggtccgcttataagatcatcacaattcgctactctcggagagtgtgcgtccaatttggagaagagaatctgtgtaaagtgatcgatatgaacgactgcttcgttagccgccacgtgaaggtctgtattatcggcaccgtgtccaaattttctcagggggatacgctgcttttctttggccccctcgaaggaggcgggctgattttcaagcattggtgcacaagcacctgtcagtttggagaccctggcgatatcatgtccccgcgggacaaagggttcctgtgccccgagttccctggcagctttagaaagaaatgtaatttcgccaccacacccctctgcgagtatgatggaaacatgatctctgggtacaagaaggttatggctaccattgactcctttcagagcttcaatacatctacgatgcactttaccgatgaacgcatcgagtggaaagaccctgatggcatgctgcgggaccatattaacatccttgtgacaaaggacattgatttcgacaacctgggagaaaatccctgtaaaatcggcctccaaacctccagcatcgagggggcctggggatctggcgtcgggtttacactgacctgcctggtgtcccttacggaatgccctaccttcctcacaagcattaaggcgtgtgataaagccatctgctatggagctgagtccgtgaccctgacaagaggccagaacaccgtcaaggttagcgggaagggcggacactctggcagcacatttaaatgttgccacggggaggactgttcccagaccggactgcatgccgctgctccccacctcgataaggtgaatggcatttctgaaatcgagaacagcaaagtgtacgacgatggggccccgcaatgcggaattaagtgttggttcgtcacgtccggcgaatggatctctggcatttttagcgggaattggatcgtgctgatcgttctttgcgtgttccttctcttctccctggtcctgctttctgtgctctgtcctgttcgcaaacataaaaagagctga

SEQ ID NO: 13321 - RNA, 3408 nt, synthetic construct
  misc_feature 1..3408: note = derived and/or modified CDS sequence (opt5) from HTNV(Aa03-161)__KT934990.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacactggatgacttcagaagcatggaggcttttaccggcatcttccggtctccccacggggaggatcacgacctcgccggagaagagacagcgacctattccattgtgggccctgccaatgctaaagtcccccatagcgcctctagcgataccctgtcccttatcgctttttctgggattccgagctactccagcctgtctatcctcacatccagcacggaagccaagcacgtgttctctcctggactgtttcccaaactgaaccataccaattgcgacaagggcgcgatccctctcatgtggacaggcatgattgacctgcccgggtattacgaggccatccacccctgtaccgttttctgcgtgctttccggacctggcgctagctgtgaggccttctccgaagggggaatttttaacatcacatctccgatgtgcctggtcagcaaacagaatcgcttcagactcaccgagcaacaggtgaactttgtttgtcaacgggtggatgtcgacattgtggtgtactgcaacggccagcgcaaggttatcctgacgaagacacttgtcatcgggcagtgtatttataccatcacctccctgttctctctcctgcccggagtggctcacagcattgccgtggaactgtgcgtccctggctttcatggctgggccacagctgcgctcctggtgaccttctgttttgggtgggttcttatccccgccattacattcatcattctgacgatcctcaaatttatcgctaatattttccacacctccaaccaagagaatagacttaagagcgtgctgcggaaaatcaaggaagagtttgagaaaacaaagggatctatggtctgcgatgtgtgtaagtacgaatgcgagacctataaagaactgaaggcccatggcgtttcctgccctcagagccagtgtccctactgcttcacacactgtgagccgaccgaagccgcttttcaggcccattataaagtgtgccaagtcacgcaccgcttcagagacgatctcaagaaaaccgtgacacctcagaacttcacccccgggtgttaccggacactgaatctgtttcgctataagtctagatgctacattttcaccatgtggatctttctcctggttcttgagtccattctgtgggcggctagcgcctctgagacgcctctcacacccgtgtggaacgacaatgcccacggagtcggcagcgtgcctatgcataccgatctggaactggacttctcccttacatcctcttccaagtacacctatcggagaaaactcaccaaccccctggaggaagctcagagcatcgatctgcacatcgagattgaggaacagacaatcggggtggacgtccatgccctcggccactggtttgatggacgcctgaatcttaagacgtccttccactgttacggcgcttgcaccaaatatgagtacccgtggcatacagccaagtgtcactatgaacgggactaccaatatgagacctcttgggggtgcaaccctagcgactgtcccggagttggcacagggtgcaccgcgtgcggactgtacctcgatagactgaaacccgtgggctccgcctacaagattatcacgattcgctattctcggagagtgtgtgtccagtttggggaagagaatctgtgcaagatcatcgacatgaacgattgtttcgtgagccgccatgttaaagtgtgcattatcggcacagtctccaagttttctcagggagacacccttctcttctttggccctctggaagggggaggcctgattttcaaacactggtgtaccagcacatgccagtttggggatccgggagacatcatgagcccccgggataagggcttcctctgtcctgagttccccgggagctttcgcaaaaagtgcaatttcgctaccacacctatttgtgaatacgacggcaacatggtgtctggatatagaaaagttatggccacgatcgattcctttcagagcttcaatacctctacaatgcattttaccgacgaacggatcgagtggaaggatcccgacggcatgctgagagatcacattaacatccttgtgacaaaggacattgacttcgataacctgggggaaaatccttgcaaaatcggactccagacctccagcattgagggcgcttgggggtctggagtcggctttacgctgacctgtctggtgtcccttacagagtgccccaccttcctcacaagcatcaaggcctgcgacaaagcgatttgttacggggccgaatccgttaccctgacacgcggccagaacaccgtgaaggtcagcggaaaaggcgggcactctggaagcacgtttaagtgctgtcatggcgaggattgctcccagatcgggctgcacgctgccgctccgcatctcgacaaggtgaatggaatctctgaaatggagaacagcaaagtgtatgatgacggcgcccctcaatgtggcattaagtgctggttcgtcaaatccggggaatggatctctggaatttttagcggcaattggatcgttctgattgtgctttgtgtgttcctcctgttctccctggtcctgctttctatcctctgccccgtgcggaagcacaaaaagagctga

SEQ ID NO: 13322 - RNA, 3408 nt, synthetic construct
  misc_feature 1..3408: note = derived and/or modified CDS sequence (opt5) from HTNV(Aa03-386)__KT934991.1__GP
  source 1..3408: mol_type = other RNA
atgggcatctggaagtggctggtgatggccagcctcgtctggcccgttctgacccttagaaacgtgtacgacatgaaaattgagtgccctcacacaatctccttcggggaaaattctgtgattggatatgtcgagctgccgcccatgcctctcgctgatacggcccagctggtgcccgaaagctcctgttctatggacaaccatcaaagccttaataccatcacaaagtacacccaggtttcctggcggggcaaagcggatcagtctcagagctcccaaaacagctttgagacagtgtctaccgaagtcgacctgaaggggacatgcgtgctcaaacacaagatggttgaggagtcctatcgcagcagaaagtctattacctgttacgatctgtcctgcaatagcacgtattgtaaacctaccctgtacatgatcgtgcccatccatgcttgcaacatgatgaagtcttgtctcattgccctgggaccttatcgggtccaggtggtgtacgaacgcacatactgcatgaccggcgtccttatcgaggggaaatgtttcgttccggaccagtccgtggtgagcattatcaagcacggaatttttgatatcgcctccgtccatattgtgtgcttctttgttgctgtgaaaggcaatacatataagatcttcgaacaggtcaagaaatcttttgagagcacctgtaacgacacggagaataaggtgcaaggctactatatctgcattgttgggggaaactccgcccccatctacgtgcctacactggatgacttcagaagcatggaggcttttaccggcattttccggtctccccacggggaggatcacgacctcgccggagaagagacagcgacctattccatcgtcggccctgccaatgctaaagtgccccatagcgcctctagcgataccctgtcccttattgctttttctgggatcccgagctactccagcctgtctatcctcacatccagcacggaagccaagcacgtcttctctcctggactgtttcccaaactgaaccataccaattgcgacaagggcgcgattcctctcatgtggacaggcatgatcgacctgcccgggtattacgaggccattcacccctgtaccgtgttctgcgttctttccggacctggcgctagctgtgaggccttctccgaagggggaatctttaacattacatctccgatgtgcctggtgagcaaacagaatcgcttcagactcaccgagcagcaggtcaactttgtgtgtcaacgggttgatgtggacatcgtcgtgtactgcaacggccagcgcaaggtgatcctgacgaagacacttgttattgggcagtgtatctataccattacctccctgttctctctcctgcccggagtcgctcacagcatcgccgtggaactgtgcgtgcctggctttcatggctgggccacagctgcgctcctggtcaccttctgttttgggtgggtgcttattcccgccatcacattcattatcctgacgatcctcaaatttattgctaatatcttccacacctccaaccaagagaatagacttaagagcgttctgcggaaaattaaggaagagtttgagaaaacaaagggatctatggtgtgcgatgtctgtaagtacgaatgcgagacctataaagaactgaaggcccatggcgtgtcctgccctcagagccagtgtccctactgcttcacacactgtgagccgaccgaagccgcttttcaggcccattataaagtttgccaagtgacgcaccgcttcagagacgatctcaagaaaaccgtcacacctcagaacttcacccccgggtgttaccggacactgaatctgtttcgctataagtctagatgctacatcttcaccatgtggatttttctcctggtgcttgagtccatcctgtgggcggctagcgcctctgagacgcctctcacacccgtttggaacgacaatgcccacggagtgggcagcgtccctatgcataccgatctggaactggacttctcccttacatcctcttccaagtacacctatcggagaaaactcaccaaccccctggaggaagctcagagcatcgatctgcacattgagatcgaggaacagacaattggggtggacgtgcatgccctcggccactggtttgatggacgcctgaatcttaagacgtccttccactgttacggcgcttgcaccaaatatgagtacccgtggcatacagccaagtgtcactatgaacgggactaccaatatgagacctcttgggggtgcaaccctagcgactgtcccggagtcggcacagggtgcaccgcgtgcggactgtacctcgatagactgaaacccgttggctccgcctacaagatcattacgatccgctattctcggagagtgtgtgtgcagtttggggaagagaatctgtgcaagatcattgacatgaacgattgtttcgtcagccgccatgtgaaagtttgcatcattggcacagtgtccaagttttctcagggagacacccttctcttctttggccctctggaagggggaggcctgatcttcaaacactggtgtaccagcacatgccagtttggggatccgggagacattatgagcccccgggataagggcttcctctgtcctgagttccccgggagctttagaaagaagtgcaatttcgctaccacacctatctgtgaatacgacggcaacatggtctctggatataaaaaggtgatggccacgatcgattcctttcagagcttcaatacctctacaatgcattttaccgacgaacgcattgagtggaaggatcccgacggcatgctgcgggatcacatcaacattcttgttacaaaagacatcgacttcgataacctgggggaaaatccttgcaagattggactccaaacctccagcatcgagggcgcttgggggtctggagtgggctttacgctgacctgtctggtctcccttacagagtgccccaccttcctcacaagcattaaagcctgcgacaaggcgatctgttacggggccgaatccgtgaccctgacaagaggccagaacaccgttaaagtgagcggaaagggcgggcactctggaagcacgtttaagtgctgtcatggcgaggattgctcccagatcgggctgcacgctgccgctccgcatctcgacaaagtcaatggaatttctgaaatggagaacagcaaggtgtatgatgacggcgcccctcaatgtggcatcaaatgctggttcgtgaagtccggggaatggatttctggaatctttagcggcaattggattgtcctgatcgttctttgtatcttcctcctgttctccctggtgctgctttctattctctgccccgtgcgcaaacacaaaaagagctga

SEQ ID NO: 13323 - RNA, 3408 nt, synthetic construct
  misc_feature 1..3408: note = derived and/or modified CDS sequence (opt5) from HTNV(Aa04-722)__KU207182.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacactggatgacttcagaagcatggaggcttttaccggcatcttccggtctccccacggggaggatcacgacctcgccggagaagagacagcgacctattccattgtgggccctgccaatgctaaagtcccccatagcgcctctagcgataccctgtcccttatcgctttttctgggattccgagctactccagcctgtctatcctcacatccagcacggaagccaagcacgtgttctctcctggactgtttcccaaactgaaccataccaattgcgacaagggcgcgatccctctcatgtggacaggcattatcgacctgcccgggtattacgaggccattcacccctgtaccgttttctgcgtgctttccggacctggcgctagctgtgaggccttctccgaagggggaatctttaacattacatctccgatgtgcctggtcagcaaacagaatcgcttcagactcaccgagcaacaggtgaactttgtttgtcaacgggtggatgtcgacatcgtggtgtactgcaacggccagcgcaaggttatcctgacgaagacacttgtcattgggcagtgtatctataccattacctccctgttctctctcctgcccggagtggctcacagcatcgccgtggaactgtgcgtccctggctttcatggctgggccacagctgcgctcctggtgaccttctgttttgggtgggttcttattcccgccatcacattcattatcctgacgatcctcaaatttattgctaatatcttccacacctccaaccaagagaatagacttaagagcgtgctgcggaaaattaaggaagagtttgagaaaacaaagggatctatggtctgcgatgtgtgtaagtacgaatgcgagacctataaagaactgaaggcccatggcgtttcctgccctcagagccagtgtccctactgcttcacacactgtgagccgaccgaagccgcttttcaggcccattataaagtgtgccaagtcacgcaccgcttcagagacgatctcaagaaaaccgtgacacctcagaacttcacccccgggtgttaccggacactgaatctgtttcgctataagtctagatgctacatcttcaccatgtggatttttctcctggttcttgagtccatcctgtgggcggctagcgcctctgagacgcctctcacacccgtgtggaacgacaatgcccacggagtcggcagcgtgcctatgcataccgatctggaactggacttctcccttacatcctcttccaagtacacctatcggagaaaactcaccaaccccctggaggaagctcagagcatcgatctgcacattgagatcgaggaacagacaattggggtggacgtccatgccctcggccactggtttgatggacgcctgaatcttaagacgtccttccactgttacggcgcttgcaccaaatatgagtacccgtggcatacagccaagtgtcactatgaacgggactaccaatatgagacctcttgggggtgcaaccctagcgactgtcccggagttggcacagggtgcaccgcgtgcggactgtacctcgatagactgaaacccgtgggctccgcctacaagatcattacgatccgctattctcggagagtgtgtgtccagtttggggaagagaatctgtgcaagatcattgacatgaacgattgtttcgtgagccgccatgttaaagtgtgcatcattggcacagtctccaagttttctcagggagacacccttctcttctttggccctctggaagggggaggcctgatcttcaaacactggtgtaccagcacatgccagtttggggatccgggagacattatgagcccccgggataagggcttcctctgtcctgagttccccgggagctttagaaagaagtgcaatttcgctaccacacctatctgtgaatacgacggcaacatggtgtctggatataaaaaggttatggccacgatcgattcctttcagagcttcaatacctctacaatgcattttaccgacgaacgcattgagtggaaggatcccgacggcatgctgcgggatcacatcaacattcttgtgacaaaagacatcgacttcgataacctgggggaaaatccttgcaagattggactccagacctccagcatcgagggcgcttgggggtctggagtcggctttacgctgacctgtctggtgtcccttacagagtgccccaccttcctcacaagcattaaagcctgcgacaaggcgatctgttacggggccgaatccgttaccctgacaagaggccagaacaccgtgaaagtcagcggaaagggcgggcactctggaagcacgtttaagtgctgtcatggcgaggattgctcccagatcgggctgcacgctgccgctccgcatctcgacaaagtgaatggaatttctgaaatggagaacagcaaggtgtatgatgacggcgcccctcaatgtggcatcaaatgctggttcgtcaagtccggggaatggatttctggaatctttagcggcaattggattgttctgatcgtgctttgtgtgttcctcctgttctccctggtcctgctttctatcctctgccccgtgcgcaaacacaaaaagagctga

SEQ ID NO: 13324 - RNA, 3408 nt, synthetic construct
  misc_feature 1..3408: note = derived and/or modified CDS sequence (opt5) from HTNV(Aa05-190)__KT934993.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcacggataccgctcagctggttcccgaaagctcctgttctatggacaaccatcaaagccttaatacaattaccaagtacacacaggtgtcctggcggggcaaagccgatcagtctcagagctcccaaaacagctttgagaccgtctctacagaagtggacctgaaggggacctgcgttctcaaacacaagatgatcgaggagtcctatcgcagcagaaagtctattacgtgttacgatctgtcctgcaatagcacctattgtaaacctacactgtacatgatcgtgcccatccatgcgtgcaacatgatgaagtcttgtctcattgctctgggaccttatcgggtccaggtggtgtacgaacgcacctactgcatgacaggcgtccttatcgaggggaaatgtttcgttccggaccagtccgtggtgagcattatcaagcacggaatttttgatatcgcctccgtccatattgtgtgcttctttgttgccgtgaaaggcaatacctataagatcttcgaacaggtcaagaaatcttttgagagcacgtgtaacgacacagagaataaggtgcaaggctactatatctgcattgttgggggaaactccgctcccatctacgtgcctaccctggatgacttcagaagcatggaagcctttacaggcattttccggtctccccacggggaggatcacgacctcgctggagaagagaccgccacctattccatcgtcggccctgcgaatgccaaagtgccccatagcgcttctagcgatacactgtcccttattgccttttctgggatcccgagctactccagcctgtctatcctcacgtccagcaccgaagctaagcacgtcttctctcctggactgtttcccaaactgaaccatacaaattgcgacaagggcgccattcctctcatgtggaccggcatgatcgacctgcccgggtattacgaggcgattcacccctgtacagtgttctgcgttctttccggacctggcgccagctgtgaggctttctccgaagggggaatctttaacattacctctccgatgtgcctggtgagcaaacagaatcgcttcagactcacggagcagcaggtcaactttgtgtgtcaacgggttgatgtggacatcgtcgtgtactgcaacggccagcgcaaggtgatcctgacaaagacccttgttattgggcagtgtatctataccattacatccctgttctctctcctgcccggagtcgcccacagcatcgctgtggaactgtgcgtgcctggctttcatggctgggccaccgccgctctcctggtcacattctgttttgggtgggtgcttattcccgcgatcacgttcattatcctgaccatcctcaaatttattgccaatatcttccacacatccaaccaagagaatagactcaagagcgttcttcggaaaattaaggaagagtttgagaaaaccaagggatctatggtgtgcgatgtctgtaagtacgaatgcgagacatataaagaactgaaggctcatggcgtgtcctgccctcagagccagtgtccctactgcttcacccactgtgagccgacggaagccgcctttcaggctcattataaagtttgccaagtgacccaccgcttcagagacgatctcaagaaaacagtcacccctcagaacttcacacccgggtgttaccggaccctgaatctgtttcgctataagtctagatgctacatcttcacgatgtggatttttctcctggtgcttgagtccatcctgtgggccgcgagcgcttctgagacacctctcacccccgtttggaacgacaatgcccacggagtgggcagcgtccctatgcatacagatctggaactggacttctcccttaccagcagctccaagtacacctatcggagaaaactcacaaaccccctggaggaagcccagagcatcgatctgcacattgagatcgaggaacagacgattggggtggacgtgcatgctctcggccactggtttgatggacgcctgaatcttaagacctccttccactgttacggcgcctgcacaaaatatgagtacccgtggcataccgctaagtgtcactatgaacgggactaccaatatgagacatcttgggggtgcaaccctagcgactgtcccggagtcggcaccgggtgcacggcctgcggactgtacctcgatagactgaaacccgttggctccgcgtacaagatcattacaatccgctattctcggagagtgtgtgtgcagtttggggaagagaatctgtgcaagatcattgacatgaacgattgtttcgtcagccgccatgtgaaagtttgcatcattggcaccgtgtccaagttttctcagggagacacccttctcttctttggccctctggaagggggaggcctgatcttcaaacactggtgtacatctacctgccagtttggggatccgggagacattatgtcccccagagataagggcttcctctgtcctgagttccccgggagctttcggaaaaagtgcaatttcgccacaacgcctatctgtgagtacgacggcaacatggtctctggatataaaaaggtgatggctaccatcgattcctttcagagcttcaatacatctaccatgcattttacagacgaacgcattgagtggaaggatcccgacggcatgctgcgggatcacatcaacattcttgttaccaaagacatcgacttcgataacctgggggaaaatccttgcaagattggactccaaacgtccagcatcgagggcgcctgggggtctggagtgggctttaccctgacatgtctggtctcccttaccgagtgccccacattcctcaccagcattaaggcttgcgacaaggccatctgttacggggcggaatccgtgacactgaccagaggccagaacacggttaaagtgagcggaaagggcgggcactctggaagcacatttaagtgctgtcatggcgaggattgctcccagatcgggctgcacgccgctgccccgcatctcgacaaagtcaatggaatttctgaaatggagaacagcaaggtgtatgatgacggcgctcctcaatgtggcatcaaatgctggttcgtgaagtccggggaatggatttctggaatctttagcggcaattggattgtcctgatcgttctttgtgtgttcctgctgttctccctggtgctgctttctatcctctgccccgtccgcaaacacaaaaagagctga

SEQ ID NO: 13325 - RNA, 3408 nt, synthetic construct
  misc_feature 1..3408: note = derived and/or modified CDS sequence (opt5) from HTNV(Aa09-1000)__KT935001.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacactggatgacttcagaagcatggaggcttttaccggcatcttccggtctccccacggggaggatcacgacctcgccggagaagagacagcgacctattccattgtgggccctgccaatgctaaagtcccccatagcgcctctagcgataccctgtcccttatcgctttttctgggattccgagctactccagcctgtctatcctcacatccagcacggaagccaagcacgtgttctctcctggactgtttcccaaactgaaccataccaattgcgacaagggcgcgatccctctcatgtggacaggcatgattgacctgcccgggtattacgaggccatccacccctgtaccgttttctgcgtgctttccggacctggcgctagctgtgaggccttctccgaagggggaatttttaacatcacatctccgatgtgcctggtcagcaaacagaatcgcttcagactcaccgagcaacaggtgaactttgtttgtcaacgggtggatgtcgacattgtggtgtactgcaacggccagcgcaaggttatcctgacgaagacacttgtcatcgggcagtgtatttataccatcacctccctgttctctctcctgcccggagtggctcacagcattgccgtggaactgtgcgtccctggctttcatggctgggccacagctgcgctcctggtgaccttctgttttgggtgggttcttatccccgccattacattcatcattctgacgatcctcaaatttatcgctaatattttccacacctccaaccaagagaatagacttaagagcgtgctgcggaaaatcaaggaagagtttgagaaaacaaagggatctatggtctgcgatgtgtgtaagtacgaatgcgagacctataaagaactgaaggcccatggcgtttcctgccctcagagccagtgtccctactgcttcacacactgtgagccgaccgaagccgcttttcaggcccattataaagtgtgccaagtcacgcaccgcttcagagacgatctcaagaaaaccgtgacacctcagaacttcacccccgggtgttaccggacactgaatctgtttcgctataagtctagatgctacattttcaccatgtggatctttctcctggttcttgagtccattctgtgggcggctagcgcctctgagacgcctctcacacccgtgtggaacgacaatgcccacggagtcggcagcgtgcctatgcataccgatctggaactggacttctcccttacatcctcttccaagtacacctatcggagaaaactcaccaaccccctggaggaagctcagagcatcgatctgcacatcgagattgaggaacagacaatcggggtggacgtccatgccctcggccactggtttgatggacgcctgaatcttaagacgtccttccactgttacggcgcttgcaccaaatatgagtacccgtggcatacagccaagtgtcactatgaacgggactaccaatatgagacctcttgggggtgcaaccctagcgactgtcccggagttggcacagggtgcaccgcgtgcggactgtacctcgatagactgaaacccgtgggctccgcctacaagattatcacgattcgctattctcggagagtgtgtgtccagtttggggaagagaatctgtgcaagatcatcgacatgaacgattgtttcgtgagccgccatgttaaagtgtgcattatcggcacagtctccaagttttctcagggagacacccttctcttctttggccctctggaagggggaggcctgattttcaaacactggtgtaccagcacatgccagtttggggatccgggagacatcatgagcccccgggataagggcttcctctgtcctgagttccccgggagctttagaaagaagtgcaatttcgctaccacacctatttgtgaatacgacggcaacatggtgtctggatataaaaaggttatggccacgatcgattcctttcagagcttcaatacctctacaatgcattttaccgacgaacgcatcgagtggaaggatcccgacggcatgctgcgggatcacattaacatccttgtgacaaaagacattgacttcgataacctgggggaaaatccttgcaagatcggactccagacctccagcattgagggcgcttgggggtctggagtcggctttacgctgacctgtctggtgtcccttacagagtgccccaccttcctcacaagcatcaaagcctgcgacaaggcgatttgttacggggccgaatccgttaccctgacaagaggccagaacaccgtgaaagtcagcggaaagggcgggcactctggaagcacgtttaagtgctgtcatggcgaggattgctcccagatcgggctgcacgctgccgctccgcatctcgacaaagtgaatggaatctctgaaatggagaacagcaaggtgtatgatgacggcgcccctcaatgtggcattaaatgctggttcgtcaagtccggggaatggatctctggaatttttagcggcaattggatcgttctgattgtgctttgtgtgttcctcctgttctccctggtcctgctttctatcctctgccccgtgcgcaaacacaaaaagagctga

SEQ ID NO: 13326 - RNA, 3408 nt, synthetic construct
  misc_feature 1..3408: note = derived and/or modified CDS sequence (opt5) from HTNV(Aa09-948)__KT935000.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacactggatgacttcagaagcatggaggcttttaccggcatcttccggtctccccacggggaggatcacgacctcgccggagaagagacagcgacctattccattgtgggccctgccaatgctaaagtcccccatagcgcctctagcgataccctgtcccttatcgctttttctgggattccgagctactccagcctgtctatcctcacatccagcacggaagccaagcacgtgttctctcctggactgtttcccaaactgaaccataccaattgcgacaagggcgcgatccctctcatgtggacaggcatgattgacctgcccgggtattacgaggccatccacccctgtaccgttttctgcgtgctttccggacctggcgctagctgtgaggccttctccgaagggggaatttttaacatcacatctccgatgtgcctgattagcaaacagaatcgcttcagactcaccgagcagcaggtcaactttgtgtgtcaacgggttgatgtggacatcgtcgtgtactgcaacggccagcgcaaggtgatcctgacgaagacacttgttattgggcagtgtatctataccattacctccctgttctctctcctgcccggagtcgctcacagcatcgccgtggaactgtgcgtgcctggctttcatggctgggccacagctgcgctcctggtcaccttctgttttgggtgggtgcttattcccgccatcacattcattatcctgacgatcctcaaatttattgctaatatcttccacacctccaaccaagagaatagacttaagagcgttctgcggaaaattaaggaagagtttgagaaaacaaagggatctatggtgtgcgatgtctgtaagtacgaatgcgagacctataaagaactgaaggcccatggcgtgtcctgccctcagagccagtgtccctactgcttcacacactgtgagccgaccgaagccgcttttcaggcccattataaagtttgccaagtgacgcaccgcttcagagacgatctcaagaaaaccgtcacacctcagaacttcacccccgggtgttaccggacactgaatctgtttcgctataagtctagatgctacatcttcaccatgtggatttttctcctggtgcttgagtccatcctgtgggcggctagcgcctctgagacgcctctcacacccgtttggaacgacaatgcccacggagtgggcagcgtccctatgcataccgatctggaactggacttctcccttacatcctcttccaagtacacctatcggagaaaactcaccaaccccctggaggaagctcagagcatcgatctgcacattgagatcgaggaacagacaattggggtggacgtgcatgccctcggccactggtttgatggacgcctgaatcttaagacgtccttccactgttacggcgcttgcaccaaatatgagtacccgtggcatacagccaagtgtcactatgaacgggactaccaatatgagacctcttgggggtgcaaccctagcgactgtcccggagtcggcacagggtgcaccgcgtgcggactgtacctcgatagactgaaacccgttggctccgcctacaagatcattacgatccgctattctcggagagtgtgtgtgcagtttggggaagagaatctgtgcaagatcattgacatgaacgattgtttcgtcagccgccatgtgaaagtttgcatcattggcacagtgtccaagttttctcagggagacacccttctcttctttggccctctggaagggggaggcctgatcttcaaacactggtgtaccagcacatgccagtttggggatccgggagacattatgagcccccgggataagggcttcctctgtcctgagttccccgggagctttagaaagaagtgcaatttcgctaccacacctatctgtgaatacgacggcaacatggtctctggatataaaaaggtgatggccacgatcgattcctttcagagcttcaatacctctacaatgcattttaccgacgaacgcattgagtggaaggatcccgacggcatgctgcgggatcacatcaacattcttgttacaaaagacatcgacttcgataacctgggggaaaatccttgcaagattggactccaaacctccagcatcgagggcgcttgggggtctggagtgggctttacgctgacctgtctggtctcccttacagagtgccccaccttcctcacaagcattaaagcctgcgacaaggcgatctgttacggggccgaatccgtgaccctgacaagaggccagaacaccgttaaagtgagcggaaagggcgggcactctggaagcacgtttaagtgctgtcatggcgaggattgctcccagatcgggctgcacgctgccgctccgcatctcgacaaagtcaatggaatttctgaaatggagaacagcaaggtgtatgatgacggcgcccctcaatgtggcatcaaatgctggttcgtgaagtccggggaatggatttctggaatctttagcggcaattggattgtcctgatcgttctttgtgtgttcctcctgttctccctggtgctgctttctatcctctgccccgtccgcaaacacaaaaagagctga

SEQ ID NO: 13327 - RNA, 3408 nt, synthetic construct
  misc_feature 1..3408: note = derived and/or modified CDS sequence (opt5) from HTNV(Aa10-434)__KT935004.1__GP
  source 1..3408: mol_type = other RNA
atgggcatctggaagtggctggtgatggccagcctcgtctggcccgttctgacccttagaaacgtgtacgacatgaagattgagtgccctcacacagtgtccttcgggggaaattctgtcatcggctatgtggaactgccgcccatgcctctcgctgatacggcccagctggttcccgagagctcctgttctatggacaaccatcaaagccttaataccattacaaagtacacccaggtgtcctggcgggggaaagcggatcagtctcagagctcccaaatcagctttgaaacagtctctaccgaggtggacctgaagggaacatgcgttctcaaacacaagatggtggaagagtcctatcgcagcagaaagtctattacctgttacgatctgtcctgcaacagcacgtattgtaaacctaccctgtacatgatcgtccccatccatgcttgcaatatgatgaagtcttgtctcattgccctgggcccttatcgggtccaggtggtgtacgagcgcacatactgcatgaccggggttcttatcgaaggaaaatgtttcgtgccggaccagtccgtggtcagcattatcaagcacggcatttttgatatcgcctccgtgcatattgtttgcttctttgtggctgtcaaaggcaacacatataagatcttcgaacaggtgaagaaatcttttgagagcacctgtaatgacacggagaacaaggttcaagggtactatatctgcattgtgggaggcaattccgcccccatctacgtccctacactggatgacttcagaagcatggaggcttttaccgggattttccggtctccccacggagaagatcacgacctcgccggcgaggaaacagcgacctattccatcgtggggcctgccaacgctaaagtcccccatagcgcctctagcgataccctgtcccttattgctttttctggaatcccgagctactccagcctgtctatcctcacatccagcacggaggccaagcacgtgttctctcctggcctgtttcccaaactgaatcataccaactgcgacaagggcgcgattcctctcatgtggacagggatgatcgacctgcccggatattacgaagccattcacccctgtaccgttttctgcgtgctttccggccctggggctagctgtgaggccttctccgagggaggcatctttaatattacatctccgatgtgcctggtcagcaaacagaaccgcttcagactcaccgaacaacaggtgaattttgtttgtcaacgggtggatgtcgacatcgtggtgtactgcaacgggcagcgcaaggttatcctgacgaagacacttgtcattggacagtgtatctataccattacctccctgttctctctcctgcccggcgtggctcacagcatcgccgtggagctgtgcgtccctggctttcatgggtgggccacagctgcgctcctggtgaccttctgttttggatgggttcttattcccgccatcacattcattatcctgacgatcctcaaatttattgctaacatcttccacacctccaatcaagaaaacagactcaagagcgtgcttcggaaaattaaggaggaatttgagaaaacaaagggctctatggtctgcgatgtgtgtaagtacgagtgcgaaacctataaagagctgaaggcccatggggtttcctgccctcagagccagtgtccctactgcttcacacactgtgaaccgaccgaggccgcttttcaggcccattataaagtgtgccaagtcacgcaccgcttcagagacgatctcaagaaaaccgtgacacctcagaatttcacccccggatgttaccggacactgaacctgtttcgctataagtctagatgctacatcttcaccatgtggatttttctcctggttcttgaatccatcctgtgggcggctagcgcctctgagacgcctctcacacccgtgtggaatgacaacgcccacggcgtcgggagcgtgcctatgcataccgatctggagctggacttctcccttacatcctcttccaagtacacctatcggagaaaactcaccaatcccctggaagaggctcagagcatcgatctgcacattgaaatcgaggagcagacaattggcgtggacgtccatgccctcggacactggtttgatggccgcctgaaccttaagacgtccttccactgttacggggcttgcaccaaatatgaatacccgtggcatacagccaagtgtcactatgagcgggactaccaatatgaaacctcttggggatgcaatcctagcgactgtcccggcgttgggacaggatgcaccgcgtgcggcctgtacctcgatagactgaaacccgtggggtccgcctacaagatcattacgatccgctattctcggagagtgtgtgtccagtttggcgaggaaaacctgtgcaagatcattgacatgaatgattgtttcgtgagccgccatgttaaagtgtgcatcattggaacaatctccaagttttctcagggcgacacccttctcttctttgggcctctggagggaggcgggctgattttcaaacactggtgtaccagcacatgccagtttggagatccgggcgacatcatgagcccccgggataaggggttcctctgtcctgagttccccggcagctttagaaagaagtgcaacttcgctaccacacctatctgtgaatacgacggaaatatggtctctggctataaaaaggtgatggccacgattgattcctttcagagcttcaacacctctacaatgcattttaccgacgagcgcatcgaatggaaggatcccgacgggatgctgcgggatcacattaatatccttgttacaaaagacattgacttcgataacctgggagagaacccttgcaagatcggcctccaggcttccagcattgaaggggcctggggatctggcgtggggtttaccctgacgtgtctggtctcccttaccgagtgccccacattcctcaccagcatcaaagcgtgcgacaaggccatctgttacggcgctgagtccgtgacactgaccagaggacagaatacagttaaagtgagcggcaaagggggacactctggcagcacctttaagtgctgtcatggggaagattgctcccagattggactgcacgccgctgccccgcatctcgacaaagtcaacggcatctctgagatggaaaatagcaaggtgtatgatgacggcgcccctcaatgtgggattaaatgctggttcgtgaagtccggagagtggatctctggcatttttagcgggaactggatcgtcctgatcgttctttgtgtgttcctgctgttctccctggtgctgctttctattctctgccccgtccgcaaacacaaaaagagctga

SEQ ID NO: 13328 - RNA, 3408 nt, synthetic construct
  misc_feature 1..3408: note = derived and/or modified CDS sequence (opt5) from HTNV(Aa10-518)__KT935005.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacgaagaataaagttcaaggctactatatctgcatcgtcgggggaaactccgcccccatttacgtgcctacactggatgacttcagaagcatggaggcttttaccggcatcttccggtctccccacggggaagatcacgacctcgccggagaggaaacagcgacctattccattgtgggccctgccaatgctaaggtcccccatagcgcctctagcgataccctgtcccttatcgctttttctgggattccgagctactccagcctgtctatcctcacatccagcacggaggccaaacacgtgttctctcctggactgtttcccaagctgaaccataccaattgcgacaaaggcgcgatccctctcatgtggacaggcatgattgacctgcccgggtattacgaagccatccacccctgtaccgttttctgcgtgctttccggacctggcgctagctgtgaggccttctccgaagggggaatttttaacatcacatctccgatgtgcctggtcagcaagcagaatcgcttcagactcaccgagcaacaggtgaactttgtttgtcaacgggtggatgtcgacattgtggtgtactgcaacggccagcgcaaggttatcctgacgaaaacacttgtcatcgggcagtgtatttataccatcacctccctgttctctctcctgcccggagtggctcacagcattgccgtggagctgtgcgtccctggctttcatggctgggccacagctgcgctcctggtgaccttctgttttgggtgggttcttatccccgccattacattcatcattctgacgatcctcaagtttatcgctaatattttccacacctccaaccaagaaaatagactgaaaagcgtgcttcggaagatcaaagaggaatttgagaagacaaagggatctatggtctgcgatgtgtgtaaatacgagtgcgaaacctataaggagctgaaagcccatggcgtttcctgccctcagagccagtgtccctactgcttcacacactgtgaaccgaccgaggccgcttttcaggcccattataaggtgtgccaagtcacgcaccgcttcagagacgatctcaaaaagaccgtgacacctcagaacttcacccccgggtgttaccggacactgaatctgtttcgctataagtctagatgctacattttcaccatgtggatctttctcctggttcttgaatccattctgtgggcggctagcgcctctgagacgcctctcacacccgtgtggaacgacaatgcccacggagtcggcagcgtgcctatgcataccgatctggagctggacttctcccttacatcctcttccaaatacacctatcggagaaagctcaccaaccccctggaagaggctcagagcatcgatctgcacatcgaaattgaggagcagacaatcggggtggacgtccatgccctcggccactggtttgatggacgcctgaatcttaaaacgtccttccactgttacggcgcttgcaccaagtatgaatacccgtggcatacagccaaatgtcactatgagcgggactaccaatatgaaacctcttgggggtgcaaccctagcgactgtcccggagttggcacagggtgcaccgcgtgcggactgtacctcgatagactgaagcccgtgggctccgcctacaagattatcacgattcgctattctcggagagtgtgtgtccagtttggggaggaaaatctgtgcaaaatcgtggacatgaacgattgtttcgttagccgccatgtgaaggtctgcatcattggcacagtgtccaaattttctcagggagacacccttctcttctttggccctctggaagggggaggcctgatcttcaagcactggtgtaccagcacatgccagtttggggatccgggagacattatgagcccccgggataaaggcttcctctgtcctgagttccccgggagctttagaaagaaatgcaatttcgctaccacacctatctgtgagtacgacggcaacatggtttctggatataagaaggtgatggccacgattgattcctttcagagcttcaatacctctacaatgcattttaccgacgagcgcatcgaatggaaagatcccgacggcatgctgcgggatcacatcaacattcttgtcacaaaggacatcgacttcgataacctgggggagaatccttgcaaaattggactccagacctccagcatcgaaggcgcttgggggtctggagtgggctttacgctgacctgtctggtttcccttacagagtgccccaccttcctcacaagcattaaggcctgcgacaaagcgatctgttacggggccgagtccgtgaccctgacaagaggccagaacaccgtcaaggtgagcggaaagggcgggcactctggaagcacgtttaaatgctgtcatggcgaagattgctcccagattgggctgcacgctgccgctccgcatctcgacaaggtgaatggaatctctgagatggaaaacagcaaagtctatgatgacggcgcccctcaatgtggcatcaagtgctggttcgttaaatccggggagtggatttctggaatctttagcggcaattggattgtgctgatcgtgctttgtgtcttcctcctgttctccctggtgctgctttctattctctgccccgttcgcaagcacaagaaaagctga

SEQ ID NO: 13329 - RNA, 3408 nt, synthetic construct
  misc_feature 1..3408: note = derived and/or modified CDS sequence (opt5) from HTNV(Aa10-561)__KT935006.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaatcagctttgagacagtctctaccgaagtggacctgaaggggacatgcgttctcaaacacaagatggtggaggagtcctatcgcagcagaaagtctattacctgttacgatctgtcctgcaacagcacgtattgtaaacctaccctgtacatgatcgtccccatccatgcttgcaatatgatgaagtcttgtctcattgccctgggaccttatcgggtccaggtggtgtacgaacgcacatactgcatgaccggcgttcttatcgaggggaaatgtttcgtgccggaccagtccgtggtcagcattatcaagcacggaatttttgatatcgcctccgtgcatattgtttgcttctttgtggctgtcaaaggcaacacatataagatcttcgaacaggtgaagaaatcttttgagagcacctgtaatgacacggagaacaaggttcaaggctactatatctgcattgtcgggggaaattccgcccccatctacgtgcctacactggatgacttcagaagcatggaggcttttaccggcattttccggtctccccacggggaggatcacgacctcgccggagaagagacagcgacctattccatcgtgggccctgccaacgctaaagtcccccatagcgcctctagcgataccctgtcccttattgctttttctgggatcccgagctactccagcctgtctatcctcacatccagcacggaagccaagcacgtgttctctcctggactgtttcccaaactgaatcataccaactgcgacaagggcgcgattcctctcatgtggacaggcatgatcgacctgcccgggtattacgaggccattcacccctgtaccgttttctgcgtgctttccggacctggcgctagctgtgaggccttctccgaagggggaatctttaatattacatctccgatgtgcctggtcagcaaacagaaccgcttcagactcaccgagcaacaggtgaattttgtttgtcaacgggtggatgtcgacatcgtggtgtactgcaacggccagcgcaaggttatcctgacgaagacacttgtcattgggcagtgtatctataccattacctccctgttctctctcctgcccggagtggctcacagcatcgccgtggaactgtgcgtccctggctttcatggctgggccacagctgcgctcctggtgaccttctgttttgggtgggttcttattcccgccatcacattcattatcctgacgatcctcaaatttattgctaacatcttccacacctccaatcaagagaacagacttaagagcgtgctgcggaaaattaaggaagagtttgagaaaacaaagggatctatggtctgcgatgtgtgtaagtacgaatgcgagacctataaagaactgaaggcccatggcgtttcctgccctcagagccagtgtccctactgcttcacacactgtgagccgaccgaagccgcttttcaggcccattataaagtgtgccaagtcacgcaccgcttcagagacgatctcaagaaaaccgtgacacctcagaatttcacccccgggtgttaccggacactgaacctgtttcgctataagtctagatgctacatcttcaccatgtggatttttctcctggttcttgagtccatcctgtgggcggctagcgcctctgagacgcctctcacacccgtgtggaatgacaacgcccacggagtcggcagcgtgcctatgcataccgatctggaactggacttctcccttacatcctcttccaagtacacctatcggagaaaactcaccaatcccctggaggaagctcagagcatcgatctgcacattgagatcgaggaacagacaattggggtggacgtccatgccctcggccactggtttgatggacgcctgaaccttaagacgtccttccactgttacggcgcttgcaccaaatatgagtacccgtggcatacagccaagtgtcactatgaacgggactaccaatatgagacctcttgggggtgcaatcctagcgactgtcccggagttggcacagggtgcaccgcgtgcggactgtacctcgatagactgaaacccgtgggctccgcctacaagatcattacgatccgctattctcggagagtgtgtgtccagtttggggaagagaacctgtgcaagatcattgacatgaatgattgtttcgtgagccgccatgttaaagtgtgcatcattggcacaatctccaagttttctcagggagacacccttctcttctttggccctctggaagggggaggcctgattttcaaacactggtgtaccagcacatgccagtttggggatccgggagacatcatgagcccccgggataagggcttcctctgtcctgagttccccgggagctttagaaagaagtgcaacttcgctaccacacctatctgtgaatacgacggcaatatggtctctggatataaaaaggtgatggccacgattgattcctttcagagcttcaacacctctacaatgcattttaccgacgaacgcatcgagtggaaggatcccgacggcatgctgcgggatcacattaatatccttgttacaaaagacattgacttcgataacctgggggaaaacccttgcaagatcggactccaggcttccagcattgagggcgcctgggggtctggagtgggctttaccctgacgtgtctggtctcccttaccgagtgccccacattcctcaccagcatcaaagcgtgcgacaaggccatctgttacggggctgaatccgtgacactgaccagaggccagaatacagttaaagtgagcggaaagggcgggcactctggaagcacctttaagtgctgtcatggcgaggattgctcccagattgggctgcacgccgctgccccgcatctcgacaaagtcaacggaatctctgaaatggagaatagcaaggtgtatgatgacggcgcccctcaatgtggcattaaatgctggttcgtgaagtccggggaatggatctctggaatttttagcggcaactggatcgtcctgatcgttctttgtgtgttcctcctgttctccctggtgctgctttctattctctgccccgtccgcaaacacaaaaagagctga

SEQ ID NO: 13330 - RNA, 3408 nt, synthetic construct
  misc_feature 1..3408: note = derived and/or modified CDS sequence (opt5) from HTNV(Aa14-172)__KT935008.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcacggataccgctcagctggttcccgaaagctcctgttctatggacaaccatcaaagccttaatacaattaccaagtacacacaggtgtcctggcggggcaaagccgatcagtctcagagctcccaaaacagctttgagaccgtctctacagaagtggacctgaaggggacctgcgttctcaaacacaagatgatcgaggagtcctatcgcagcagaaagtctattacgtgttacgatctgtcctgcaataacacctattgtaaacctacactgtacatgatcgtgcccatccatgcgtgcaatatgatgaaaagctgtctcattgctctgggaccttatcgggtccaggtggtgtacgaacgcacctactgcatgacaggcgtccttatcgaggggaaatgtttcgttccggaccagtctgtggtgtccattatcaagcacggaatttttgatatcgccagcgtccatattgtgtgcttctttgttgccgtgaaaggcaacacctataagatcttcgaacaggtcaagaaatcctttgagtctacgtgtaatgacacagagaacaaggtgcaaggctactatatctgcattgttgggggaaatagcgctcccatctacgtgcctaccctggatgacttcagatccatggaagcctttacaggcattttccggagcccccacggggaggatcacgacctcgctggagaagagaccgccacctattctatcgtcggccctgcgaacgccaaagtgccccattccgctagctctgatacactgagccttattgccttttccgggatcccgtcttacagctccctgagcatcctcacgtcttccaccgaagctaagcacgtcttcagccctggactgtttcccaaactgaatcatacaaactgcgacaagggcgccattcctctcatgtggaccggcatgatcgacctgcccgggtattacgaggcgattcacccctgtacagtgttctgcgttctttctggacctggcgcctcctgtgaggctttcagcgaagggggaatctttaatattacctccccgatgtgcctggtgtctaaacagaaccgcttcagactcacggagcagcaggtcaactttgtgtgtcaacgggttgatgtggacatcgtcgtgtactgcaatggccagcgcaaggtgatcctgacaaagacccttgttattgggcagtgtatctataccattacaagcctgttctccctcctgcccggagtcgcccactctatcgctgtggaactgtgcgtgcctggctttcatggctgggccaccgccgctctcctggtcacattctgttttgggtgggtgcttattcccgcgatcacgttcattatcctgaccatcctcaaatttattgccaacatcttccacacaagcaatcaagagaacagactgaagtccgttcttcggaaaattaaggaagagtttgagaaaaccaagggaagcatggtgtgcgatgtctgtaagtacgaatgcgagacatataaagaactgaaggctcatggcgtgtcttgccctcagtcccagtgtccctactgcttcacccactgtgagccgacggaagccgcctttcaggctcattataaagtttgccaagtgacccaccgcttcagagacgatctcaagaaaacagtcacccctcagaatttcacacccgggtgttaccggaccctgaacctgtttcgctataagagcagatgctacatcttcacgatgtggatttttctcctggtgcttgagtctatcctgtgggccgcgtccgctagcgagacacctctcacccccgtttggaatgacaacgcccacggagtgggctctgtccctatgcatacagatctggaactggacttcagccttacctccagctctaagtacacctatcggagaaaactcacaaatcccctggaggaagcccagtccatcgatctgcacattgagatcgaggaacagacgattggggtggacgtgcatgctctcggccactggtttgatggacgcctgaaccttaagaccagcttccactgttacggcgcctgcacaaaatatgagtacccgtggcataccgctaagtgtcactatgaacgggactaccaatatgagacatcctgggggtgcaatccttctgactgtcccggagtcggcaccgggtgcacggcctgcggactgtacctcgatagactgaaacccgttggcagcgcgtacaagatcattacaatccgctattcccggagagtgtgtgtgcagtttggggaagagaacctgtgcaagatcattgacatgaatgattgtttcgtctctcgccatgtgaaagtttgcatcattggcaccgtgagcaagttttcccagggagacacccttctcttctttggccctctggaagggggaggcctgatcttcaaacactggtgtacatctacctgccagtttggggatccgggagacattatgagcccccgggataagggcttcctctgtcctgagttccccgggtcctttcgcaaaaagtgcaacttcgccacaacgcctatctgtgagtacgacggcaatatggtcagcggatataaaaaggtgatggctaccatcgattcttttcaatccttcaacacaagcaccatgcattttacagacgaaagaattgagtggaaggatcccgacggcatgctgcgggatcacatcaacattcttgttaccaaagacatcgacttcgataatctgggggaaaacccttgcaagattggactccagacgtcttccatcgagggcgcctgggggagcggagtgggctttaccctgacatgtctggtctctcttaccgagtgccccacattcctcacctccattaaggcttgcgacaaggccatctgttacggggcggaaagcgtgacactgaccagaggccagaatacggttaaagtgtccggaaagggcgggcacagcggatctacatttaagtgctgtcatggcgaggattgcagccagatcgggctgcacgccgctgccccgcatctcgacaaagtcaacggaatttccgaagtggaaaattctaaggtgtatgatgacggcgctcctcaatgtggcatcaaatgctggttcgtcaagagcggggagtggatttccggaatcttttctggcaactggattgttctgatcgtgctttgtgtgttcctcctgttcagcctggtcctgctttccatcctctgccccgtgcgcaaacacaagaagtcttga

SEQ ID NO: 13331 - RNA, 3408 nt, synthetic construct
  misc_feature 1..3408: note = derived and/or modified CDS sequence (opt5) from HTNV(Aa14-266)__KT935013.1__GP
  source 1..3408: mol_type = other RNA
atgggcatctggaagtggctggtgatggccagcctcgtctggcccgttctgacccttagaaacgtgtacgacatgaagattgagtgccctcacacagtgtccttcggggaaaattctgtcatcggatatgtggagctgccgcccatgcctctcgctgatacggcccagatggttcccgaaagctcctgttctatggacaaccatcaaagcctgaataccattacaaagtacacccaggtgtcctggcggggcaaagcggatcagtctcagagcaaccaaaattcctttgagacagtcagcaccgaagtggaccttaaggggacatgcgttctgaaacacaagatggtggaggagtcttatcgctccagaaagagcatcacctgttacgatctctcttgcaactccacgtattgtaaacctaccctgtacatgattgtccccatccatgcttgcaatatgatgaaaagctgtctgatcgccctcggaccttatcgggtccaggtggtgtacgaacgcacatactgcatgaccggcgttctgattgaggggaagtgtttcgtgccggaccagtctgtggtctccatcattaagcacggaatctttgatattgccagcgtgcatatcgtttgcttctttgtggctgtcaaaggcaacacatataagattttcgaacaggtgaagaaatcctttgagtctacctgtaatgacacggagaacaaggttcaaggctactatatctgcatcgtcgggggaaatagcgcccccatttacgtgcctacacttgatgacttcagatccatggaggcttttaccggcatcttccggagcccccacggggaagatcacgacctggccggagaagagattgcgacatattctatcgtgggccctgccaacgctaaagtcccccattccgccagctctgataccctcagcctgattgcttactccgggatcccgtcttatagctcccttagcatcctgacctcttccacagaagccaagcacgtgtttagccctggactcttccccaaactgaatcatacgaactgcgacaagtctgcgattcctctgatgtggaccggcatgatcgacctccccggctactacgaggccgttcacccctgtacagtgttttgcgtcctgtccgggcctggagctagctgtgaggccttctccgaaggcgggattttcaatatcacctctccgatgtgccttgtgagcaaacagaaccgctttagactgacagagcagcaggttaacttcgtgtgtcaacgggtcgatgtggacattgtggtttattgcaatggacagcgcaaggtcatcctcaccaagacgctggtgatcggccagtgtatttacacaatcacctcccttttctctctgctccccggggtggctcacagcattgccgtcgaactgtgcgtgcctggattccatggctgggccaccgctgcgctgctcgttacattttgtttcggctgggtgctgatccccgccattacctttatcattcttacaatcctgaaattcatcgctaacatttttcacacgtccaatcaagagaacagactcaagagcgtcctgcggaaaatcaaggaagagttcgagaaaaccaaggggtctatggtgtgcgatgtttgtaagtatgaatgcgagacatacaaagaacttaaggcccatggagtgtcctgccctcagagccagtgtccctattgctttacccactgtgagccgacagaagccgctttccaggcccattacaaagtctgccaagtgacccaccgctttagagacgatctgaagaaaacggttacccctcagaatttcacacccggctgttatcggaccctcaacctgttccgctacaagtctagatgctacatttttacaatgtggatcttcctgctcgtgctggagtccattctttgggcggctagcgcctctgagacccctctgacgcccgtctggaatgacaacgcccacggggtgggaagcgtgcctatgcatacagatctcgaactggacttttccctgacctcctcttccaagtatacataccggagaaaacttaccaatcccctcgaggaagctcagagcatcgatctgcacatcgagattgaggaacagaccatcggcgtcgacgttcatgccctggggcactggttcgatggccgcctcaacctgaagacatcctttcactgttatggagcttgcacgaaatacgagtatccgtggcataccgccaagtgtcactacgaacgggactatcaatacgagacatcttggggctgcaatcctagcgactgtcccggggtgggaaccggctgcacagcgtgcgggctttacctggatcagctcaaacccgtgggatccgcctataagattatcaccattagatactctcgccgggtctgtgtgcagttcggcgaagagaacctgtgcaagacgatcgacatgaatgattgttttgttagcagacatgtgaaagtctgcatcattgggacagtgtccaagttctctcagggcgacaccctgctctttttcggacctcttgagggcgggggactgatctttaaacactggtgtaccagcacatgccaattcggcgatccgggggacattatgagcccccgcgataagggatttctgtgtcctgaatttcccggcagcttccggaaaaagtgcaactttgctaccacacctatctgtgagtatgacgggaatatggtttctggctacaaaaaggtgatggccacgattgattccttccagagctttaacacctctacaatgcatttcaccgacgaaagaatcgagtggaaggatcccgacggaatgctccgcgatcacatcaacattctggtcacaaaagacatcgactttgataatcttggcgaaaacccttgcaagattgggctgcagacctccagcatcgagggagcttggggctctggggtgggattcacgctcacctgtctggtttccctgacagagtgccccacctttcttacaagcattaaagcctgcgacaaggcgatctgttatggcgccgaatccgtgaccctcacacgggggcagaataccgtcaaagtgagcggcaagggaggccactctgggagcacgttcaagtgctgtcatggagaggattgctcccaaattggcctgcacgctgccgctccgcatctggacaaagtgaacgggatctctgaaatggagaatagcaaggtctacgatgacggagcccctcagtgtggcatcaaatgctggtttgttaagtccggcgaatggatttctgggatcttcagcggaaactggattgtgctcatcgtgctgtgtgtctttcttctgttctccctcgtgctgctgtctattctttgccccgttagaaaacacaaaaagagctga

SEQ ID NO: 13332 - RNA, 3408 nt, synthetic construct
  misc_feature 1..3408: note = derived and/or modified CDS sequence (opt5) from HTNV(Aa14-272)__KT935014.1__GP
  source 1..3408: mol_type = other RNA
atgggcatctggaagtggctggtgatggccagcctcgtctggcccgttctgacccttagaaacgtgtacgacatgaagattgagtgccctcacacagtgtccttcggggaaaattctgtcatcggatatgtggagctgccgcccatgcctctcgctgatacggcccagatggttcccgaaagctcctgttctatggacaaccatcaaagcctgaataccattacaaagtacacccaggtgtcctggcggggcaaagcggatcagtctcagagcaaccaaaattcctttgagacagtcagcaccgaagtggaccttaaggggacatgcgttctgaaacacaagatggtggaggagtcttatcgctccagaaagagcatcacctgttacgatctctcttgcaactccacgtattgtaaacctaccctgtacatgattgtccccatccatgcttgcaatatgatgaaaagctgtctgatcgccctcggaccttatcgggtccaggtggtgtacgaacgcacatactgcatgaccggcgttctgattgaggggaagtgtttcgtgccggaccagtctgtggtctccatcattaagcacggaatctttgatattgccagcgtgcatatcgtttgcttctttgtggctgtcaaaggcaacacatataagattttcgaacaggtgaagaaatcctttgagtctacctgtaatgacacggagaacaaggttcaaggctactatatctgcatcgtcgggggaaatagcgcccccatttacgtgcctacacttgatgacttcagatccatggaggcttttaccggcatcttccggagcccccacggggaagatcacgacctggccggagaagagattgcgacatattctatcgtgggccctgccaacgctaaagtcccccattccgccagctctgataccctcagcctgattgcttactccgggatcccgtcttatagctcccttagcatcctgacctcttccacagaagccaagcacgtgtttagccctggactcttccccaaactgaatcatacgaactgcgacaagtctgcgattcctctgatgtggaccggcatgatcgacctccccggctactacgaggccgttcacccctgtacagtgttttgcgtcctgtccgggcctggagctagctgtgaggccttctccgaaggcgggattttcaatatcacctctccgatgtgccttgtgagcaaacagaaccgctttagactgacagagcagcaggttaacttcgtgtgtcaacgggtcgatgtggacattgtggtttattgcaatggacagcgcaaggtcatcctcaccaagacgctggtgatcggccagtgtatttacacaatcacctccctttttagcctgctccccggggtggctcacagcattgccgtcgaactgtgcgtgcctggattccatggctgggccaccgctgcgctgctcgttacattttgtttcggctgggtgctgatccccgccattacctttatcattcttacaatcctgaaattcatcgctaacatttttcacacgtccaatcaagagaacagactcaagagcgtcctgcggaaaatcaaggaagagttcgagaaaaccaaggggtctatggtgtgcgatgtttgtaagtatgaatgcgagacatacaaagaacttaaggcccatggagtgtcctgccctcagagccagtgtccctattgctttacccactgtgagccgacagaagccgctttccaggcccattacaaagtctgccaagtgacccaccgctttagagacgatctgaagaaaacggttacccctcagaatttcacacccggctgttatcggaccctcaacctgttccgctacaagtctagatgctacatttttacaatgtggatcttcctgctcgtgctggagtccattctttgggcggctagcgcctctgagacccctctgacgcccgtctggaatgacaacgcccacggggtgggaagcgtgcctatgcatacagatctcgaactggacttttccctgaccagctcctccaagtatacataccggagaaaacttaccaatcccctcgaggaagctcagagcatcgatctgcacatcgagattgaggaacagaccatcggcgtcgacgttcatgccctggggcactggttcgatggccgcctcaacctgaagacatcctttcactgttatggagcttgcacgaaatacgagtatccgtggcataccgccaagtgtcactacgaacgggactatcaatacgagacatcttggggctgcaatcctagcgactgtcccggggtgggaaccggctgcacagcgtgcgggctttacctggatcagctcaaacccgtgggatccgcctataagattatcaccattagatactctcgccgggtctgtgtgcagttcggcgaagagaacctgtgcaagatcatcgacatgaatgattgttttgttagcagacatgtgaaagtctgcattatcgggacggtgtccaagttctctcagggcgacacactgcttttcttcggacctctcgagggcgggggactgatttttaaacactggtgtacctctacctgccaattcggcgatccgggggacatcatgtctccccgcgataagggatttctgtgtcctgaatttcccggcagcttccggaaaaagtgcaactttgctacaacccctatttgtgagtatgacgggaatatggtttctggctacaaaaaggtgatggccacaatcgattccttccagagctttaacacgtctaccatgcatttcacagacgaaagaatcgagtggaaggatcccgacggaatgctccgcgatcacattaacatcctggtcaccaaagacattgactttgataatcttggcgaaaacccttgcaagatcgggctgcagacatccagcattgagggagcttggggctctggggtgggattcaccctcacgtgtctggtttccctgaccgagtgccccacatttcttaccagcatcaaagcctgcgacaaggcgatttgttatggcgccgaatccgtgacactcacccgggggcagaatacagtcaaagtgagcggcaagggaggccactctgggagcaccttcaagtgctgtcatggagaggattgctcccaaatcggcctgcacgctgccgctccgcatctggacaaagtgaacgggatctctgaaatggagaatagcaaggtctacgatgacggagcccctcagtgtggcattaaatgctggtttgttaagtccggcgaatggatctctgggattttcagcggaaactggatcgtgctcattgtgctgtgtgtctttcttctgttctccctcgtgctgctgtctatcctttgccccgttagaaaacacaaaaagagctga

SEQ ID NO: 13333 - RNA, 3408 nt, synthetic construct
  misc_feature 1..3408: note = derived and/or modified CDS sequence (opt5) from HTNV(Aa14-362)__KT935015.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgaggctgtctctacagaagtggacctgaaggggacctgcgttctcaaacacaagatggtggaggagtcctatcgcagcagaaagtctatcacatgttacgatctgtcctgcaatagcacctattgtaaacctacgctgtacatgattgtccccatccatgcctgcaacatgatgaagtcttgtctcatcgccctgggaccttatcgggtccaggtggtgtacgaacgcacctactgcatgacaggcgttcttattgaggggaaatgtttcgtgccggaccagtccgtggtcagcatcattaagcacggaatctttgatattgcttccgtgcatatcgtttgcttctttgtggccgtcaaaggcaatacctataagattttcgaacaggtgaagaaatcttttgagagcacatgtaacgacaccgagaataaggttcaaggctactatatctgcatcgtcgggggaaactccgctcccatttacgtgcctacgctggatgacttcagaagcatggaagcctttacaggcatcttccggtctccccacggggaggatcacgacctcgcgggagaagagaccgccacatattccattgtgggccctgctaatgccaaagtcccccatagcgcttctagcgataccctgtcccttatcgccttttctgggattccgagctactccagcctgtctatcctcacctccagcacagaagcgaagcacgtgttctctcctggactgtttcccaaactgaaccatacgaattgcgacaagggcgccatccctctcatgtggaccggcatgattgacctgcccgggtattacgaggctatccacccctgtacagttttctgcgtgctttccggacctggcgccagctgtgaggctttctccgaagggggaatttttaacatcacctctccgatgtgcctggtcagcaaacagaatcgcttcagactcacagagcaacaggtgaactttgtttgtcaacgggtggatgtcgacattatcgtgtactgcaacggccagcgcaaggtgatcctgaccaagacgcttgttattgggcagtgtatctatacaattacctccctgttctctctcctgcccggagtcgcccacagcatcgccgtggaactgtgcgtgcctggctttcatggctgggctaccgcggccctcctggtcacattctgttttgggtgggtgcttattcccgctatcaccttcattatcctgacaatcctcaaatttattgccaatatcttccacacgtccaaccaagagaatagactcaagagcgttcttcggaaaattaaggaagagtttgagaaaaccaagggatctatggtgtgcgatgtctgtaagtacgaatgcgagacatataaagaactgaaggcccatggcgtgtcctgccctcagagccagtgtccctactgcttcacccactgtgagccgacagaagctgcctttcaggcgcattataaagtttgccaagtgacccaccgcttcagagacgatctcaagaaaacggtcacccctcagaacttcacacccgggtgttaccggaccctgaatctgtttcgctataagtctagatgctacatcttcacaatgtggatttttctcctggtgcttgagtccatcctgtgggctgccagcgcctctgagacccctctcacgcccgtttggaacgacaatgctcacggagtgggcagcgtccctatgcatacagatctggaactggacttctcccttacctcctcttccaagtacacatatcggagaaaactcaccaaccccctggaggaagcccagagcatcgatctgcacattgagatcgaggaacagaccattggggtggacgtgcatgctctcggccactggtttgatggacgcctgaatcttaagacatccttccactgttacggcgcctgcacgaaatatgagtacccgtggcataccgcgaagtgtcactatgaacgggactaccaatatgagacatcttgggggtgcaaccctagcgactgtcccggagtcggcaccgggtgcacagcctgcggactgtacctcgatagactgaaacccgttggctccgcttacaagatcattaccatccgctattctcggagagtgtgtgtgcagtttggggaagagaatctgtgcaagatcattgacatgaacgattgtttcgtcagccgccatgtgaaagtttgcatcattggcacggtgtccaagttttctcagggagacacacttctcttctttggccctctggaagggggaggcctgatcttcaaacactggtgtacctctacctgccagtttggggatccgggagacattatgagcccccgggataagggcttcctctgtcctgagttccccgggagctttagaaagaagtgcaatttcgccacaacccctatctgtgagtacgacggcaacatggtcagcggatataaaaaggtgatggctacaatcgattcctttcagagcttcaatacgtctaccatgcattttacagacgaacgcattgagtggaaggatcccgacggcatgctgcgggatcacatcaacattcttgttaccaaagacatcgacttcgataacctgggggaaaatccttgcaagattggactccagacatccagcatcgagggcgcctgggggtctggagtgggctttaccctgacgtgtctggtctcccttaccgagtgccccacattcctcaccagcattaaagcgtgcgacaaggccatctgttacggggctgaatccgtgacactgaccagaggccagaacacagttaaagtgagcggaaagggcgggcactctggaagcacctttaagtgctgtcatggcgaggattgctcccagatcgggctgcacgccgctgccccgcatctcgacaaagtcaatggaatttctgaaatggagaacagcaaggtgtatgatgacggcgcccctcaatgtggcatcaaatgctggttcgtgaagtccggggaatggatttctggaatctttagcggcaattggattgtcctgatcgttctttgtgtgttcctgctgttctccctggtgctgctttctatcctctgccccgtccgcaaacacaaaaagagctga

SEQ ID NO: 13334 - RNA, 3408 nt, synthetic construct
  misc_feature 1..3408: note = derived and/or modified CDS sequence (opt5) from HTNV(Aa14-404)__KT935018.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagatggttcccgaaagctcctgttctatggacaaccatcaaagcctgaataccattacaaagtacacccaggtgtcctggcggggcaaagcggatcagtctcagagctcccaaaacagctttgagacagtctctaccgaagtggaccttaaggggacatgcgttctgaaacacaagatggtggaggagtcctatcgcagcagaaagtctatcacctgttacgatctctcctgcaatagcacgtattgtaaacctaccctgtacatgattgtccccatccatgcttgcaacatgatgaagtcttgtctgatcgccctcggaccttatcgggtccaggtggtgtacgaacgcacatactgcatgaccggcgttctgattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacacttgatgacttcagaagcatggaggcttttaccggcatcttccggtctccccacggggaagatcacgacctggccggagaagagattgcgacatattccatcgtgggccctgccaatgctaaagtcccccatagcgcctctagcgataccctctccctgattgcttactctgggatcccgagctattccagcctttctatcctgacctccagcacagaagccaagcacgtgttttctcctggactcttccccaaactgaaccatacgaattgcgacaagtccgcgattcctctgatgtggaccggcatgatcgacctccccggctactacgaggccgttcacccctgtacagtgttttgcgtcctgagcgggcctggagcttcctgtgaggccttctctgaaggcgggattttcaacatcaccagcccgatgtgccttgtgtccaaacagaatcgctttagactgacagagcagcaggttaacttcgtgtgtcaacgggtcgatgtggacattgtggtttattgcaacggacagcgcaaggtcatcctcaccaagacgctggtgatcggccagtgtatttacacaatcacctctctttttagcctgctccccggggtggctcactccattgccgtcgaactgtgcgtgcctggattccatggctgggccaccgctgcgctgctcgttacattttgtttcggctgggtgctgatccccgccattacctttatcattcttacaatcctgaaattcatcgctaatatttttcacacgagcaaccaagagaatagactcaagtctgtcctgcggaaaatcaaggaagagttcgagaaaaccaaggggtccatggtgtgcgatgtttgtaagtatgaatgcgagacatacaaagaacttaaggcccatggagtgagctgccctcagtctcagtgtccctattgctttacccactgtgagccgacagaagccaccttccaggctcattacaaagtctgccaagtgacgcaccgctttagagacgatctgaagaaaaccgttacacctcagaacttcacccccggctgttatcggacactcaatctgttccgctacaagtccagatgctacatttttaccatgtggatcttcctgctcgtgctggagagcattctttgggccgcgtctgctagcgagacgcctctgacacccgtctggaacgacaatgcccacggggtgggatccgtgcctatgcataccgatctcgaactggactttagcctgacatcttccagcaagtatacctaccggagaaaacttaccaaccccctcgaggaagcccagtccatcgatctgcacatcgagattgaggaacagacaatcggcgtcgacgttcatgctctggggcactggttcgatggccgcctcaatctgaagacgtcttttcactgttatggagcctgcaccaaatacgagtatccgtggcatacagctaagtgtcactacgaacgggactatcaatacgagaccagctggggctgcaacccttccgactgtcccggggtgggaacaggctgcaccgcctgcgggctttacctggatcagctcaaacccgtgggatctgcgtataagattatcacgattagatacagccgccgggtctgtgtgcagttcggcgaagagaatctgtgcaagatcatcgacatgaacgattgttttgtttccagacatgtgaaagtctgcattatcgggacagtgtctaagttcagccagggcgacaccctgctgtttttcggacctctcgagggcgggggactgatttttaaacactggtgtacctccacatgccaattcggcgatccgggggacatcatgagcccccgcgataagggatttctgtgtcctgagttccccggctctttccggaaaaagtgcaattttgccaccacacctctctgtgaatatgacgggaacatggtttccggctacaaaaaggtgatggctacgattgatagcttccagtcttttaatacctccacaatgcatttcaccgacgaaagaatcgagtggaaggatcccgacggaatgctgcgcgatcacatcaacattcttgtcacaaaagacatcgactttgataacctgggcgaaaatccttgcaagattgggctccagaccagctctatcgagggagcctggggctccggggtgggattcacgctgacctgtctggttagccttacagagtgccccacctttctcacatccattaaggcttgcgacaaagccatctgttatggcgcggaaagcgtgaccctgacacgggggcagaacaccgtcaaagtgtctggcaagggaggccacagcgggtccacgttcaagtgctgtcatggagaggattgctctcaaattggcctgcacgccgctgccccgcatctcgacaaagtgaatgggatcagcgaaatggagaactccaaggtctacgatgacggagctcctcagtgtggcatcaaatgctggtttgttaagtctggcgaatggattagcgggatcttctccggaaattggattgtgctgatcgtgctttgtgtctttcttctcttctctctggtgctgcttagcattctctgccccgttagaaaacacaagaagtcctga

SEQ ID NO: 13335 - RNA, 3408 nt, synthetic construct
  misc_feature 1..3408: note = derived and/or modified CDS sequence (opt5) from HTNV(Aa14-423)__KT935022.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagatggttcccgaaagctcctgttctatggacaaccatcaaagcctgaataccattacaaagtacacccaggtgtcctggcggggcaaagcggatcagtctcagagctcccaaaacagctttgagacagtctctaccgaagtggaccttaaggggacatgcgttctgaaacacaagatggtggaggagtcctatcgcagcagaaagtctatcacctgttacgatctctcctgcaatagcacgtattgtaaacctaccctgtacatgattgtccccatccatgcttgcaacatgatgaagtcttgtctgatcgccctcggaccttatcgggtccaggtggtgtacgaacgcacatactgcatgaccggcgttctgattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacacttgatgacttcagaagcatggaggcttttaccggcatcttccggtctccccacggggaagatcacgacctggccggagaagagattgcgacatattccatcgtgggccctgccaatgctaaagtcccccatagcgcctctagcgataccctctccctgattgcttactctgggatcccgagctattccagcctttctatcctgacctccagcacagaagccaagcacgtgttttctcctggactcttccccaaactgaaccatacgaattgcgacaagtccgcgattcctctgatgtggaccggcatgatcgacctccccggctactacgaggccgttcacccctgtacagtgttttgcgtcctgagcgggcctggagcttcctgtgaggccttctctgaaggcgggattttcaacatcaccagcccgatgtgccttgtgtccaaacagaatcgctttagactgacagagcagcaggttaacttcgtgtgtcaacgggtcgatgtggacattgtggtttattgcaacggacagcgcaaggtcatcctcaccaagacgctggtgatcggccagtgtatttacacaatcacctctctttttagcctgctccccggggtggctcactccattgccgtcgaactgtgcgtgcctggattccatggctgggccaccgctgcgctgctcgttacattttgtttcggctgggtgctgatccccgccattacccttatcattctgacaatcctcaaatttatcgctaatattttccacacgagcaaccaagagaatagactgaagtctgtccttcggaaaatcaaggaagagtttgagaaaaccaaggggtccatggtgtgcgatgtttgtaagtatgaatgcgagacatacaaagaactgaaggcccatggagtgagctgccctcagtctcagtgtccctattgcttcacccactgtgagccgacagaagccacctttcaggctcattacaaagtctgccaagtgacgcaccgcttcagagacgatctcaagaaaaccgttacacctcagaactttacccccggctgttatcggacactgaatctgttccgctacaagtccagatgctacattttcaccatgtggatctttctcctggtgcttgagagcattctgtgggccgcgtctgctagcgagacgcctctcacacccgtctggaacgacaatgcccacggggtgggatccgtgcctatgcataccgatctggaactggacttcagccttacatcttccagcaagtatacctaccggagaaaactcaccaaccccctggaggaagcccagtccatcgatctgcacatcgagattgaggaacagacaatcggcgtcgacgttcatgctctcgggcactggtttgatggccgcctgaatcttaagacgtctttccactgttatggagcctgcaccaaatacgagtatccgtggcatacagctaagtgtcactacgaacgggactatcaatacgagaccagctggggctgcaacccttccgactgtcccggggtgggaacaggctgcaccgcctgcgggctgtacctcgatcagctgaaacccgtgggatctgcgtataagattatcacgattagatacagccgccgggtctgtgtgcagtttggcgaagagaatctgtgcaagatcatcgacatgaacgattgtttcgtttccagacatgtgaaagtctgcattatcgggacagtgtctaagtttagccagggcgacacccttctcttctttggacctctggagggcgggggactgattttcaaacactggtgtacctccacatgccaatttggcgatccgggggacatcatgagcccccgcgataagggattcctctgtcctgaatttcccggctctttccggaaaaagtgcaatttcgccaccacacctctgtgtgagtatgacgggaacatggtttccggctacaaaaaggtgatggctacgattgatagctttcagtctttcaatacctccacaatgcattttaccgacgaaagaatcgagtggaaggatcccgacggaatgcttcgcgatcacatcaacattctggtcacaaaagacatcgacttcgataacctcggcgaaaatccttgcaagattgggctgcagaccagctctatcgagggagcctggggctccggggtgggatttacgctgacctgtcttgttagcctcacagagtgccccaccttcctgacatccattaaggcttgcgacaaagccatctgttatggcgcggaaagcgtgaccctgacacgggggcagaacaccgtcaaagtgtctggcaagggaggccacagcgggtccacgtttaagtgctgtcatggagaggattgctctcaaattggcctccacgccgctgccccgcatctggacaaagtgaatgggatcagcgaaatggagaactccaaggtctacgatgacggagctcctcagtgtggcatcaaatgctggttcgttaagtctggcgaatggattagcgggatcttttccggaaattggattgtgcttatcgtgctgtgtgtcttcctcctgttttctctggtgcttctcagcattctgtgccccgttagaaaacacaagaagtcctga

SEQ ID NO: 13336 - RNA, 3408 nt, synthetic construct
  misc_feature 1..3408: note = derived and/or modified CDS sequence (opt5) from HTNV(Aa15-56)__KU207187.1__GP
  source 1..3408: mol_type = other RNA
atgggcatctggaagtggctggtgatggccagcctcgtctggcccgttctgacccttagaaacgtgtacgacatgaagattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggcgcaaagcggatcagtctcagagctcccaaaacagctttgagacagtctctaccgaagtggacctgaagggcacatgcgttctcaaacacaagatggtggaggagtcctatagaagccggaagtctatcacctgttacgatctgtcctgcaatagcacgtattgtaaacctaccctgtacatgattgtccccatccatgcttgcaacatgatgaagtcttgtctcatcgccctggggccttatcgcgtccaggtggtgtacgaaagaacatactgcatgaccggagcccttattgagggcaaatgtttcgttccggaccagtccgtggtgagcatcattaagcacgggatctttgatattgcttccgtccatatcgtgtgcttctttgttgccgtgaaaggaaatacatataagattttcgaacaggtcaagaaatcttttgagagcacctgtaacgacacggagaataaggtgcaaggctactatatctgcatcgttggcgggaactccgctcccatttacgtgcctacactggatgacttccggagcatggaagcctttaccggaatcttccgctctccccacggcgaggatcacgacctcgcgggggaagagacagccacctattccattgtcggacctgctaatgccaaagtgccccatagcgcttctagcgataccctgtcccttatcgccttttctggcattccgagctactccagcctgtctatcctcacatccagcacggaagcgaagcacgtcttctctcctgggctgtttcccaaactgaaccataccaattgcgacaagggagccatccctctcatgtggacaggcatgattgacctgcccggctattacgaggctatccacccctgtaccgtgttctgcgttctttccgggcctggagccagctgtgaggctttctccgaaggcgggatttttaacatcacatctccgatgtgcctggtgagcaaacagaatagattccggctcaccgagcagcaggtcaactttgtgtgtcaacgcgttgatgtggacattgtcgtgtactgcaacggacagagaaaggtgatcctgacgaagacacttgttatcggccagtgtatttataccatcacctccctgttctctctcctgcccggggtcgcccacagcattgccgtggaactgtgcgtgcctggatttcatggctgggctacagcggccctcctggtcaccttctgttttggctgggtgcttatccccgctattacattcatcattctgacgatcctcaaatttatcgccaatattttccacacctccaaccaagagaatcggctcaagagcgttcttcgcaaaatcaaggaagagtttgagaaaacaaaggggtctatggtgtgcgatgtctgtaagtacgaatgcgagacctataaagaactgaaggcccatggagtgtcctgccctcagagccagtgtccctactgcttcacacactgtgagccgaccgaagctgcctttcaggcgcattataaagtttgccaagtgacgcacagattccgggacgatctcaagaaaaccgtcacacctcagaacttcacccccggctgttaccgcacactgaatctgtttagatataagtctcggtgctacattttcaccatgtggatctttctcctggtgcttgagtccattctgtgggctgccagcgcctctgagacgcctctcacacccgtttggaacgacaatgctcacggggtgggaagcgtccctatgcataccgatctggaactggacttctcccttacaagcagctccaagtacacctatagacgcaaactcaccaaccccctggaggaagcccagagcatcgatctgcacatcgagattgaggaacagacaatcggcgtggacgtgcatgctctcgggcactggtttgatggccggctgaatcttaagacgtccttccactgttacggagcctgcaccaaatatgagtacccgtggcatacagcgaagtgtcactatgaaagagactaccaatatgagacctcttggggctgcaaccctagcgactgtcccggggtcggaacaggctgcaccgcctgcgggctgtacctcgatcgcctgaaacccgttggatccgcttacaagattatcacgattcggtattctagacgcgtgtgtgtgcagtttggcgaagagaatctgtgcaagatcatcgacatgaacgattgtttcgtcagccggcatgtgaaagtttgcattatcgggacagtgtccaagttttctcagggcgacacccttctcttctttggacctctggagggcgggggactgattttcaaacactggtgtaccagcacatgccagtttggcgatccgggggacatcatgtcccccagagataagggattcctctgtcctgagttccccggcagctttcgcaaaaagtgcaatttcgccaccacacctatttgtgaatacgacgggaacatggtctctggctataaaaaggtgatggctacgatcgattcctttcaatctttcaatacctctacaatgcattttaccgacgaacggatcgagtggaaggatcccgacggaatgctgagagatcacattaacatccttgttacaaaagacattgacttcgataacctgggcgaaaatccttgcaagatcgggctccagacctccagcattgagggagcctggggctctggggtgggatttacgctgacctgtctggtctcccttacagagtgccccaccttcctcacaagcatcaaagcgtgcgacaaggccatttgttacggcgctgaatccgtgaccctgacacgcgggcagaacaccgttaaagtgagcggcaagggaggccactctgggagcacgtttaagtgctgtcatggagaggattgctcccagatcggcctgcacgccgctgccccgcatctcgacaaagtcaatgggatctctgaaatggagaacagcaaggtgtatgatgacggagcccctcaatgtggcattaaatgctggttcgtgaagtccggcgaatggatctctgggatttttagcggaaattggatcgtcctgattgttctttgtgtgttcctgctgttctccctggtgctgctttctatcctctgccccgtccggaaacacaaaaagagctga

SEQ ID NO: 13337 - RNA, 3408 nt, synthetic construct
  misc_feature 1..3408: note = derived and/or modified CDS sequence (opt5) from HTNV(CBAa11-106)__KC576787.1__GP
  source 1..3408: mol_type = other RNA
atgggcatgtggaagtggctggtgatcgccagcctcgtctggcccgccctgacccttagaaacgtttacgacatgaaaattgagtgccctcacacagtgtccttcggggaaaattctgtgatcggatatgtcgagctgccgcccatgcctctcgccgatacggcgcagatggtgcccgaaagctcctgttctatggacaaccatcaaagcatgaataccattacaaagtacacccaggttatctggcggggcaaagctgatcctgggcagtcctctcagaacagctttgagacagtgtccaccgaaattgacctgaagggaacatgcgtccttaaacacaagatggtggaggagagctatcgctctagaaagtccatcacctgttacgatctgagctgcaattctacgtattgtaaacccaccctctacatgatcgttcctattcatgcctgcaacatgatgaagtcctgtctgatcgccctgggcccgtatcgggtgcaagtcgtgtacgaacgcacatactgcatgaccggggtgctcattgagggaaaatgtttcgtccccgaccagagcgttgtgtctatcattaagcacggcatctttgatattgcttccgtgcatatcgtctgcttctttgtggccgttaaaggcaatacatataagctgttcgaacaggtgaagaaatcttttgagtccacctgtaacgacacggagaataaggtccaggggtactatatctgcattgtgggaggcaacttcgctcctatctacgttcccacacttgatgactttagatctatggaagccttcaccgggatttttcggagccctcacggagaggatcacgacctggcgggcgaagagatcgcctcctatagcattgtggggcccgctaatgccaaagtcccgcattctgcttccagcgatacactctctctgatcgcctacagcggaatcccttcctattctagcctttccattctgaccagctctaccgaagcgaagcacgtgttctcccccggcctctttcctaaactgaaccatacaaattgcgacaagagcgccatccccctgacgtggaccggcatgattgacctccccgggtactacgaggctatccacccttgtacagtcttctgcgtgctgtctggaccgggcgcctcctgtgaggctttcagcgaagggggaatttttaacatcacctcccccatgtgccttgtttctaaacaaaatcgcttcagactgacagagcaacaggtgaactttgtctgtcagcgggtggatatggacatcgttgtgtattgcaacggccagcgcaaggtcattctcaccaagacgctggtgatcgggcagtgtatttacacaatcaccagccttttctccctgctccctggagtggcccactctattgccgttgaactgtgcgtccccggctttcatggctgggctaccgcggccctgctcgtgacattctgttttgggtgggtgctgatccctgctattaccttcatcatccttacagtcctgaaatttgtggccaatattttccacacgagcaaccaggagaatagactcaagtccgttctgcggaaaatcaaggaagagtttgagaaaaccaagggaagcatggtgtgcgatgtctgtaagtatgaatgcgagacatacaaagaacttaaggcccatggcgtgtcttgcccccaatcccagtgtccgtattgcttcacccactgtgagcctacagaagctgcctttcaggcgcattacaaagtttgccaggtgacccaccgcttcagagacgatctgaagaaaacggtcacaccccaaaacttcacacctgggtgttatcggaccctcaatctgtttcgctacaagagcagatgctacattttcacaatgtgggtgtttctgctcatcctggagtctgttctttgggctgcctccgccagcgagacgcccctgacccctgtgtggaacgacaatgctcacggagtcggctctgtgcccatgcatacagatctcgaactggacttcagcctgacctccagctctaagtatacataccggagaaaacttaccaacccgctcgaggaagcccagtccattgatctgcacatcgagatcgaggaacagaccattggggtggacgtccatgctctgggccactggtttgatggacgcctcaatctgaagaccagcttccactgttatggcgcctgcacgaaatacgagtatccttggcataccgcgaagtgtcactacgaacgggactatcagtacgagacatcctgggggtgcaacccctctgactgtcccggagttggcaccgggtgcacagcctgcggactttacctggatcaactcaaacctgtgggcagcgcttataagatcattaccatcagatactcccgccgggtgtgtgtccagtttggggaagagaatctgtgcaagattatcgacatgaacgattgtttcgtgtctagacatgttaaagtgtgcatcattggcacggtcagcaagttttcccagggagacacactgcttttctttggcccgctcgaagggggaggcctgatcttcaaacactggtgtacctctacctgccagtttggggatcccggagacattatgagccctcgcgataagggcttcctgtgtcccgagttccctgggtcctttcggaaaaagtgcaatttcgccacaacccccatctgtgagtatgacggcaacatggtgagcggatacaaaaaggttatggctacaattgattcttttcaatccttcaatacgagcaccatgcattttacagacgaaagaatcgagtggaaggatcctgacggcatgctccgcgatcacatcaacattctggtgaccaaagacatcgacttcgataaccttggggaaaatccctgcaagattggactgcagacatcttccatcgagggcgcctgggggagcggagtcggctttaccctcacgtgtctggtgtctctgaccgagtgcccgacattccttacctccattaaagcgtgcgacaaggccatctgttatggggctgaaagcgttacactcacccggggccagaacacagtgaaagtctccggaaagggcgggcacagcggatctacctttaagtgctgtcatggcgaggattgcagccagattgggctgcacgccgctgcccctcatctggacaaagtgaatggaatctccgaaatcgagaactctaaggtgtacgatgacggcgctccccaatgtggcattaaatgctggttcgtcaagagcggggaatggatctccggaatttttagcggcaattggatcgttctcattgtgctgtgtgtgttccttctgttcagcctcgtcctgctgtccatcctttgccctgtgagaaaacacaagaagtcttga

SEQ ID NO: 13338 - RNA, 3408 nt, synthetic construct
  misc_feature 1..3408: note = derived and/or modified CDS sequence (opt5) from HTNV(CBAa11-26)__KC576786.1__GP
  source 1..3408: mol_type = other RNA
atgggcatgtggaagtggctggtgatcgccagcctcgtctggcccgccctgacccttagaaacgtttacgacatgaagattgagtgccctcacacagtgtccttcggggaaaattctgtgatcggatatgtcgagctgccgcccatgcctctcgccgatacggcgcagatggtgcccgaaagctcctgttctatggacaaccatcaaagcatgaataccattacaaagtacacccaggttatctggcggggcaaagctgatcctgggcagtcctctcagaacagctttgagacagtgtccaccgaaattgacctgaagggaacatgcgtccttaaacacaagatggtggaggagagctatcgctctagaaagtccatcacctgttacgatctgagctgcaattctacgtattgtaaacccaccctctacatgatcgttcctattcatgcctgcaacatgatgaagtcctgtctgatcgccctgggcccgtatcgggtgcaagtcgtgtacgaacgcacatactgcatgaccggggtgctcattgagggaaaatgtttcgtccccgaccagagcgttgtgtctatcattaagcacggcatctttgatattgcttccgtgcatatcgtctgcttctttgtggccgttaaaggcaatacatataagctgttcgaacaggtgaagaaatcttttgagtccacctgtaacgacacggagaataaggtccaggggtactatatctgcattgtgggaggcaactctgctcctatctacgttcccacacttgatgacttcagaagcatggaagcctttaccgggattttccggtcccctcacggagaggatcacgacctggcgggcgaagagatcgccagctattctattgtggggcccgctaatgccaaagtcccgcattccgctagctctgatacactcagcctgatcgcctactccggaatcccttcttatagctcccttagcattctgacctcttccaccgaagcgaagcacgtgtttagccccggcctcttccctaaactgaaccatacaaattgcgacaagtctgccatccccctgacgtggaccggcatgattgacctccccgggtactacgaggctatccacccttgtacagtcttttgcgtgctgtccggaccgggcgccagctgtgaggctttctccgaagggggaattttcaacatcacctctcccatgtgccttgttagcaaacaaaatcgctttagactgacagagcaacaggtgaacttcgtctgtcagcgggtggatatggacatcgttgtgtattgcaacggccaacgcaaggtcattctcaccaagacgctggtgatcgggcagtgtatttacacaatcacctccctttttagcctgctccctggagtggcccacagcattgccgttgaactgtgcgtccccggcttccatggctgggctaccgcggccctgctcgtgacattttgtttcgggtgggtgctgatccctgctattacctttatcatccttacagtcctgaaattcgtggccaatatttttcacacgtccaaccaggagaatagactcaagagcgttctgcggaaaatcaaggaagagttcgagaaaaccaagggatctatggtgtgcgatgtctgtaagtatgaatgcgagacatacaaagaacttaaggcccatggcgtgtcctgcccccaaagccagtgtccgtattgctttacccactgtgagcctacagaagctgccttccaggcgcattacaaagtttgccaggtgacccaccgctttagagacgatctgaagaaaacggtcacaccccaaaacttcacccctgggtgttatcggaccctcaatctgttccgctacaagtctagatgctacatttttacaatgtgggtgttcctgctcatcctggagtccgttctttgggctgccagcgcctctgagacgcccctgacccctgtgtggaacgacaatgctcacggagtcggcagcgtgcccatgcatacagatctcgaactggacttttccctgaccagcagctccaagtatacataccggagaaaacttaccaacccgctcgaggaagcccagagcattgatctgcacatcgagatcgaggaacagaccattggggtggacgtccatgctctgggccactggttcgatggacgcctcaatctgaagacatcctttcactgttatggcgcctgcacgaaatacgagtatccttggcataccgcgaagtgtcactacgaacgggactatcagtacgagacatcttgggggtgcaaccccagcgactgtcccggagttggcaccgggtgcacagcctgcggactttacctggatcaactcaaacctgtgggctccgcttataagatcattaccatcagatactctcgccgggtgtgtgtccagttcggggaagagaatctgtgcaagattatcgacatgaacgattgttttgtgagcagacatgttaaagtgtgcatcattggcacggtctccaagttctctcagggagacacactgctctttttcggcccgcttgaagggggaggcctgatctttaaacactggtgtacctctacctgccagttcggggatcccggagacattatgtcccctcgcgataagggctttctgtgtcccgagttccctgggagcttccggaaaaagtgcaattttgccacaacccccatctgtgagtatgacggcaacatggtgtctggatacaaaaaggttatggctacaattgattccttccagagctttaatacgtctaccatgcatttcacagacgaaagaatcgagtggaaggatcctgacggcatgctccgcgatcacatcaacattctggtgaccaaagacatcgactttgataaccttggggaaaatccctgcaagattggactgcagacatccagcatcgagggcgcctgggggtctggagtcggcttcaccctcacgtgtctggtgtccctgaccgagtgcccgacatttcttaccagcattaaagcgtgcgacaaggccatctgttatggggctgaatccgttacactcacccggggccagaacacagtgaaagtcagcggaaagggcgggcactctggaagcaccttcaagtgctgtcatggcgaggattgctcccagattgggctgcacgccgctgcccctcatctggacaaagtgaatggaatctctgaaatcgagaacagcaaggtgtacgatgacggcgctccccaatgtggcattaaatgctggtttgtcaagtccggggaatggatctctggaattttcagcggcaattggatcgttctcattgtgctgtgtgtgtttcttctgttctccctcgtcctgctgtctatcctttgccctgtgagaaaacacaaaaagagctga

SEQ ID NO: 13339 - RNA, 3408 nt, synthetic construct
  misc_feature 1..3408: note = derived and/or modified CDS sequence (opt5) from HTNV(Fuyuan-Aa-145)__KJ857336.1__GP
  source 1..3408: mol_type = other RNA
atgggcatgtggaagtggctggtgatcgccagcctcgtctggcccgccctgtcccttagaaacgtttacgacatgaaaattgagtgccctcacaccgtgtctttcggggaaaatagcgtgatcggatatgtcgagctgccgcccatgcctctcgccgatacagcgcagatggtgcccgaatcctcttgtagcatggacaaccatcaatccattaatacgatcaccaagtacacacaggttatttggcggggcaaagctgatcctgggcagtctagccagaactcctttgagaccgtgagcacagaagtcgacctgaagggaacctgcgtgcttaaacacaagatggttgaggagtcttatcgctccagaaagagcatcacatgttacgatctgtcttgcaattccaccttctgtaaacccacgctctatatgatcgtgcctattcatgcctgcaacatgatgaaaagctgtctgatcgccctgggcccgtaccgggtccaagtggtgtatgaacgcacctactgcatgacaggggtcctcattgagggaaagtgttttgttcccgaccagtctgtggtgtccatcattaagcacggcatcttcgatattgctagcgtccatgtggtttgctttttcgtggccgtcaaaggcaatacctacaagctgtttgaacaggtgaagaaatccttcgagtctacatgtaacgacaccgagaataaggttcaggggtattacatctgcatcgtgggaggcaacagcgctcctatttatgtccccacgcttgatgactttagatccatggaagccttcacagggatctttaaaagccctcacggagaggatcacgacctggcgggcgaagagattgcctcttactccatcgtggggcccgctaatgccaaggtcccgcatagcgcttctagcgataccctctccctgattgcctattctggaatccctagctactccagcctttctatcctgacatccagcaccgacgcgaaacacgtgttctctcccggcctctttcctaagctgaaccataccaattgcgacaaatccgccattcccctgacatggacgggcatgatcgatctccccgggtattacgaagctattcacccttgtaccgttttctgcgtgctgagcggaccgggcgcctcctgtgaggctttctctgaagggggaatctttaacattacaagccccatgtgccttgtctccaagcaaaatcggttccgcctgaccgagcaacaggtgaactttgtttgtcagagagtggacatggatatcgtcgtgtactgcaacggccagcggaaggtgatcctcacaaaaaccctggttattgggcagtgtatctatacgattacatctcttttcagcctgctccctggagtcgcccactccatcgccgtggagctgtgcgtgcccggctttcatggctgggctaccgcggccctgctcgtcaccttctgttttgggtgggtgctgattcctgctgttacattcatcattcttaccgtgctgaagtttatcgccaatatcttccacacaagcaaccaggaaaatcgcctcaaatctgtcctgagaaagattaaagaggaatttgagaagacgaagggatccatggtgtgcgacgtttgtaaatacgagtgcgaaacctataaggagcttaaagcccatggcgtgagctgcccccaatctcagtgtccgtactgcttcacacactgtgaacctaccgaggctgcctttcaggcgcattataaggtctgccaggtgacacaccggttccgcgatgacctgaaaaagaccgttacgccccaaaacttcacccctgggtgttacagaacactcaatctgtttcggtataagtcccgctgctacatcttcaccatgtgggtgtttctgctcattctggaaagcgtcctttgggctgcctctgccagcgagacacccctgacccctgtgtggaacgataatgctcacggagtgggctccgtccccatgcatacggacctcgagctggatttcagcctgacatcttccagcaaatacacctatagacggaaacttacaaacccgctcgaagaggcccagtccatcgacctgcacattgaaatcgaggagcagaccatcggggttgatgtgcatgctctgggccactggtttgacggaagactcaatctgaagacctctttccactgttacggcgcctgcacaaagtatgaatacccttggcatacggcgaaatgtcactatgagcgcgactaccagtatgaaaccagctgggggtgcaacccctccgattgtcccggagtgggcacagggtgcaccgcctgcggactttacctggaccaactcaagcctgtcggctctgcttacaagattatcacaattcggtatagcagacgcgtgtgtgttcagtttggggaggaaaatctgtgcaaaatcattgatatgaacgactgtttcgtgtcccggcatgtcaaggtgtgcatcatcggcaccgtttctaaatttagccagggagatacgctgcttttctttggcccgctcgaagggggaggcctgattttcaagcactggtgtacatccacatgccagtttggggaccccggagatatcatgagccctagagacaaaggcttcctgtgtcccgagttccctgggtcttttcgcaagaaatgcaatttcgccaccacccccatttgtgagtacgatggcaacatggtgtccggatataagaaggtcatggctaccatcgacagctttcaatctttcaatacatccacgatgcattttaccgatgagcggattgaatggaaagaccctgatggcatgctcagagaccacatcaacatcctggtgacaaaggacattgatttcgacaaccttggggagaatccctgcaaaatcggactgcagaccagctctattgaaggcgcctgggggtccggagttggctttacactcacctgtctggtgagcctgacggagtgcccgaccttccttacatccatcaaggcgtgcgataaagccatttgttacggggctgagagcgtcaccctcacacgcggccagaacaccgtgaaggtgtctggaaagggcgggcacagcggatccacatttaaatgctgtcatggcgaagactgctctaagatcgggctgcacgccgctgcccctcatctggataaagtcaatggaattagcgagatcgaaaactccaaggtttatgacgatggcgctccccagtgtggcatcaaatgctggttcgtgaagtctggggagtggattagcggaatcttttccggcaattggattgtgctcatcgtcctgtgtgtgttccttctgttctctctcgttctgctgagcattctttgccctgtgcggaagcacaaaaagtcctga

SEQ ID NO: 13340 - RNA, 3408 nt, synthetic construct
  misc_feature 1..3408: note = derived and/or modified CDS sequence (opt5) from HTNV(Fuyuan-Aa-26)__KJ857334.1__GP
  source 1..3408: mol_type = other RNA
atgggcatgtggaagtggctggtgatcgccagcctcgtctggcccgccctgtcccttagaaacgtttacgacatgaaaattgagtgccctcacaccgtgtctttcggggaaaatagcgtgatcggatatgtcgagctgccgcccatgcctctcgccgatacagcgcagatggtgcccgaatcctcttgtagcatggacaaccatcaatccattaatacgatcaccaagtacacacaggttatttggcggggcaaagctgatcctgggcagtctagccagaactcctttgagaccgtgagcacagaagtcgacctgaagggaacctgcgtgcttaaacacaagatggttgaggagtcttatcgctccagaaagagcatcacatgttacgatctgtcttgcaattccacctattgtaaacccacgctctacatgatcgtgcctattcatgcctgcaacatgatgaaaagctgtctgatcgccctgggcccgtatcgggtccaagtggtgtacgaacgcacctactgcatgacaggggtcctcattgagggaaagtgtttcgttcccgaccagtctgtggtgtccatcattaagcacggcatctttgatattgctagcgtccatatcgtgtgcttctttgttgccgtgaaaggcaatacctataagctgttcgaacaggtcaagaaatcctttgagtctacatgtaacgacaccgagaataaggtgcaggggtactatatctgcattgttggaggcaacagcgctcctatctacgtgcccacgcttgatgacttcagatccatggaagcctttacagggattttcaaaagccctcacggagaggatcacgacctggcgggcgaagagatcgcctcttattccattgtcgggcccgctaatgccaaggtgccgcatagcgcttctagcgataccctctccctgatcgcctactctggaatccctagctattccagcctttctattctgacatccagcaccgacgcgaaacacgtcttttctcccggcctcttccctaagctgaaccataccaattgcgacaaatccgccatccccctgacatggacgggcatgattgatctccccgggtactacgaagctatccacccttgtaccgtgttttgcgttctgagcggaccgggcgcctcctgtgaggctttctctgaagggggaattttcaacatcacaagccccatgtgccttgtgtccaagcaaaatcggtttcgcctgaccgaacagcaggtcaacttcgtgtgtcagagagttgacatggatatcgtggtctattgcaacggccaacggaaggtgattctcacaaaaaccctggtgatcgggcagtgtatttacacgatcacatctctttttagcctgctccctggagttgcccactccattgccgtcgagctgtgcgtgcccggcttccatggctgggctaccgcggccctgctcgtgaccttttgtttcgggtgggtcctgatccctgctgtgacatttattatccttaccgttctgaagttcatcgccaatatttttcacacaagcaaccaggaaaatcgcctcaaatctgtgctgagaaagatcaaagaggagttcgagaagacgaagggatccatggtctgcgacgtgtgtaaatatgagtgcgaaacctacaaggagcttaaagcccatggcgttagctgcccccaatctcagtgtccgtattgctttacacactgtgaacctaccgaggctgccttccaggcgcattacaaggtgtgccaggtcacacaccggtttcgcgatgacctgaaaaagaccgtgacgccccaaaacttcacccctgggtgttatagaacactcaatctgttccggtacaagtcccgctgctacatttttaccatgtgggttttcctgctcatcctggaaagcgtgctttgggctgcctctgccagcgagacacccctgacccctgtctggaacgataatgctcacggagtgggctccgtgcccatgcatacggacctcgagctggattttagcctgacatcttccagcaaatatacctacagacggaaacttacaaacccgctcgaagaggcccagtccattgacctgcacatcgaaatcgaggagcagaccattggggtcgatgttcatgctctgggccactggttcgacggaagactcaatctgaagacctcttttcactgttatggcgcctgcacaaagtacgaatatccttggcatacggcgaaatgtcactacgagcgcgactatcagtacgaaaccagctgggggtgcaacccctccgattgtcccggagtgggcacagggtgcaccgcctgcggactttacctggaccaactcaagcctgtgggctctgcttataagatcattacaatccggtacagcagacgcgtctgtgtgcagttcggggaggaaaatctgtgcaaaattatcgatatgaacgactgttttgtttcccggcatgtgaaggtctgcatcattggcaccgtgtctaaattcagccagggagatacgctgctctttttcggcccgcttgaagggggaggcctgatctttaagcactggtgtacatccacatgccagttcggggaccccggagatattatgagccctagagacaaaggctttctgtgtcccgagttccctgggtctttccgcaagaaatgcaattttgccaccacccccatctgtgagtatgatggcaacatggtttccggatacaagaaggtgatggctaccattgacagcttccaatcttttaatacatccacgatgcatttcaccgatgagcggatcgaatggaaagaccctgatggcatgctcagagaccacatcaacattctggtcacaaaggacatcgattttgacaaccttggggagaatccctgcaaaattggactgcagaccagctctatcgaaggcgcctgggggtccggagtgggcttcacactcacctgtctggttagcctgacggagtgcccgacctttcttacatccattaaggcgtgcgataaagccatctgttatggggctgagagcgtgaccctcacacgcggccagaacaccgtcaaggtgtctggaaagggcgggcacagcggatccacattcaaatgctgtcatggcgaagactgctctaagattgggctgcacgccgctgcccctcatctggataaagtgaatggaatcagcgagatcgaaaactccaaggtctacgacgatggcgctccccagtgtggcattaaatgctggtttgttaagtctggggagtggatcagcggaattttctccggcaattggatcgtgctcattgtgctgtgtgtctttcttctgttctctctcgtgctgctgagcatcctttgccctgttcggaagcacaaaaagtcctga

SEQ ID NO: 13341 - RNA, 3408 nt, synthetic construct
  misc_feature 1..3408: note = derived and/or modified CDS sequence (opt5) from HTNV(JS1)__KP970560.1__GP
  source 1..3408: mol_type = other RNA
atgggcatctggaagtggctggtgatggccagcctcgtctggcccgttctgacccttagaaacgtgtacgacatgaagattgagtgccctcacacagtgtccttcgggggaaattctgtcatcggctatgtggaactgccgcccgttcctctcgctgatacggcccagatggtgcccgagagctcctgttctatggacaaccatcaaagcctgaataccattgcgaagtacacacaggtctcctggcgggggaaagctgatcagtctcagagctcccaaaacagctttgaaaccgtgtctacagaggttgaccttaagggaacctgcgtgctgaaacacaagatggtcgaagagtcctatcgcagcagaaagtctgtgacatgttacgatctctcctgcaatagcacctattgtaaacctacgctgtacatgatcgtgcccattcatgcctgcaacatgatgaagtcttgtctgatcgccctcggcccttatcgggtccaggttgtgtacgagcgcacctactgcatgacaggggtgctgatcgaaggaaaatgtttcgtcccggaccagtccgtggttagcattatcaagcacggcatttttgatatcgcttccgtgcatattgtctgcttctttgtggccgttaaaggcaatacctataagatcttcgaacaggtgaagaaatcttttgaaagcacatgtaacgacaccgagaataaggtccaagggtactatatttgcatcgtgggaggcaactccgctcccatctacgtccctacgcttgatgacttcagaagcatggaggcctttacagggattttccggtctccccacggagaagatcacgacctggcgggcgaggaaatcgcctcctatagcattgtggggcctgctaatgccaaagttccccattctgctagctccgataccctctctctgatcgcctacagcgggattccgtcctatagctctctttccatcctgacaagctctaccgaggcgaagcacgtgttttcccctggcctcttccccaaactgaaccataccaattgcgacaagagcgccatccctctgatttggacaggcatgatcgacctccccgggtactacgaagctgtccacccctgtacggtgttttgcgttctgtccggacctggcgcctcttgtgaggctttcagcgagggaggaattttcaacatcacctccccgatgtgccttgtgtctaaacagaatcgctttagactgacagaacagcaggtcaacttcgtgtgtcaacgggtggatatggacattgttgtctattgcaacggccagcgcaaggtgatcctcaccaagacactggtgatcgggcagtgtatttacaccatcacgagcctgttttcccttctccccggagtcgcccacagcattgccgtggagctgtgcgttcctggcttccatggctgggctacagcggccctgctcgtgaccttttgtttcgggtgggtcctgatccccgctattacctttatcattcttacagtgctgaaattcatcgccaatatctttcacacctctaaccaagaaaatagactcaagtccgttctgcggaaaattaaggaggagttcgagaaaacaaagggaagcatggtgtgcgatgtctgtaagtatgagtgcgaaacgtacaaagagcttaaggcccatggcgtgtcttgccctcagtcccagtgtccctattgctttacccactgtgaaccgacagaggctgccttccaggcgcattacaaagtttgccaagtgacccaccgctttagagacgatctgaagaaaacagtcacccctcagaacttcacgcccgggtgttatcggaccctcaatctgttccgctacaagagcagatgctacatctttacaatgtggattttcctgctcgtgctggaatctatcctttgggctgccagcgcctccgagacccctctgacacccgtgtggaacgacaatgctcacggagtcggcagcgttcctatgcataccgatctcgagctggacttttctctgacgtccagctccaagtatacataccggagaaaacttaccaaccccctcgaagaggcccagtctattgatctgcacatcgaaatcgaggagcagacaattggggtggacgtgcatgctctgggccactggttcgatggacgcctcaatctgaagaccagctttcactgttatggcgcctgcaccaaatacgaatatccgtggcatacagcgaagtgtcactacgagcgggactatcaatacgaaacgtcctgggggtgcaacccttctgactgtcccggagtcggcaccgggtgcacagcctgcggactttacctggatcagctcaaacccgtgggcagcgcttataagatcattaccatcagatactcccgccgggtttgtgtgcagttcggggagggcaatctgtgcaagattatcgacatgaacgattgttttgtctctagacatgtgaaagtttgcatcattggaacagtgagcaagttctcccagggcgacaccctgctctttttcgggcctcttgaaggaggcgggctgatctttaaacactggtgtacgagcacatgccaattcggagatccgggcgacattatgtctccccgcgataaggggtttctgtgtcctgagttccccggctccttccggaaaaagtgcaattttgccaccacccctatctgtgagtatgacggaaacatggtcagcggctacaaaaaggtgatggctacaattgattctttccagtcctttaataccagcacaatgcatttcacggacgaaagaatcgagtggaaggatcccgacgggatgctccgcgatcacatcaacattctggttaccaaagacatcgactttgataaccttggagaaaatccttgcaagattggcctgcagacatcttccatcgagggggcctggggaagcggcgtggggttcaccctcacatgtctggtctccctgaccgaatgccccacgtttcttaccagcattaaagcgtgcgacaaggccatctgttatggcgctgagtctgtgacactcacccggggacagaacacagtgaaagtcagcggcaaagggggacactccggctctaccttcaagtgctgtcatggggaggattgcagccaaattggactgcacgccgctgccccgcatctggacaaggttaatggcatctccgaaatcgagaactctaaggtgtacgatgacggcgcccctcagtgtgggattaaatgctggtttgtcaagagcggagaatggatctccggcattttctctgggaattggatcgtgctcattgtgctgtgtgtttttcttctgttcagcctcgtgctgctgtccatcctttgccccgtcagaaaacacaaaaagagctga

SEQ ID NO: 13342 - RNA, 3408 nt, synthetic construct
  misc_feature 1..3408: note = derived and/or modified CDS sequence (opt5) from HTNV(LongquanAa-08-150)__JQ912803.1__GP
  source 1..3408: mol_type = other RNA
atgggcatctggaagtggctggtgatggccagcctcgtctggcccgctttcaccctgagaaacgtttacgacatgaaaattgagtgccctcacacagtgtcctttggggaaaattctgtgatcggatatgtcgagcttccgcccatgcctctggccgatacggcgcagatggtgcccgaaagctcctgtaacatggacaatcatcaatctatgaacaccattacaaagtacacccaggttagctggcggggcaaagctgatcaggcccaggcctcccaaaattctttcgaggctgtgagcgccgaagtcgacctcaaggggatctgcgtgctgaaacacaagatgcttgaggagtcctatcgcagcagaaagtctattacatgttacgatctgtcctgcaacagcacctattgtaaacctacactctacatgatcgttcccatccatgcttgcaatatgatgaagtcttgtctgattgccctgggaccttatcgggtgcaggtcgtgtacgaacgcacctactgcatgacgggcgtgctcctggaggggaaatgttttgtcccggaccagtccgttgtgagcatcattaagcacggaatcttcgatattgcgtctgtgcatatcgtctgctttttcgtggccgttaaaggcaacacctataagctcctggaacaggtgaagaaatcctttcaaagcacatgtaatgacaccgagaacaaggtccagggctactatatttgcatcgttgggggaaattccgctcccatctacgtgcctacactcgatgacttcagatctatggaggcctttagcggcattttccggagcccccacggggaagatcacgacctggctggagaggaaatcgccagctattctattgtgggccctgcgaacgccaaagtcccccattccgctagctctgatacccttagcctgatcgcctactccgggattccgtcttatagctccctcagcatcctggcttcttccacggaggccaagcacgtgtttagccctggattctttccccagctgaatcatacaaaatgcgacaagaccgccatccctctcatttggacaggcatgatcgacctgcccggctactacgaagctattcacccctgtaccgtcttctgcgtgctttctgggcctggagcgtcctgtgaggccttcagcgagggcgggatctttaacattacctccccgatgtgcctggtttctaaacagaatcgcttcagactcacagaacaacaggtgaactttgtctgtcagcgggtggatgttgacatcatcgtgtattgcaacggacaacgcaaggtcattctgacgaagacccttgtgatcggccagtgtatttacacaatcaccagcctgttctccctcctgcccggggtggctcactctattgccgttgagctgtgcgtccctggatttcatggctgggccacagctgccctcctggtgaccttctgttttggctgggtgcttatccccgcgctgacgctcattatcctgacaatccttaaattcattgctaatatctttcatacctgcaaccaggaaaatagactgaagtccgtcctccggaaaattaaggaggaatttgagaaaaccaaggggtccatggtgtgtgatgtttgcaagtatgagtgcgaaacatacaaagagctgaaggcccacggagtgagctgtcctcagtctcaatgcccctattgttttacccactgcgaaccgacagaggccgctttccaggcccattaccgcgtctgtcaggtgacgcacagatttcgggacgatctgaaaaagaccgttacacctcagaacttcacccccggctgctatcgcacactcaatctgttcagatacaaatcccggtgttacatctttaccatgtgggtgtgccttctggtcctcgaaagcattctgtgggctgcctctgcgtccgaggtgcctctgaaccccgtttggaatgacaacgcccacggggtgggaagcgtccctatgcatacggatcttgagctcgacttctctctgaccagctccagcaagtatacatacagacgccggctgaccaatcccctcgaagagacacaatctatcaacctgcacatcgaaattgaggagcagaccatcggcgtggatgtgcatgctcttgggcactggtttgacggcagactgaatctcaagacgtccttccactgttatggagcctgcacaaaatacgaatatccgtggcataccgctaagtgtcactacgagcgcgattatcagtacgaaacaagctggggctgcaaccctgccgactgccccggggtcggaaccggctgtaccgcgtgcgggctgtacctggaccagcttaaacccgttggatccgcctataagattatcacaattcggtactctagaaaagtgtgtgtgcaatttggcgaggaaaatctctgcaaggtcatcgatatgaacgactgtttcgtgacgcgccatgttaaggtgtgcatcattgggaccgtcagcaaattttcccagggcgatacactgctgttctttggacctctcgagggcgggggactgatcttcaagcactggtgtacctctacatgccagtttggcgacccgggggatattatgagcccccgggacaaaggattcctttgtcctgagtttcccggctccttcagaaagaaatgcaatttcgctaccacgcctctgtgtgaatatgatgggaacatggtgtctggctacaagaaagttatggccacaatcgacagctttcagtccttcaacaccagcaccatgcattttacagatgagcgcattgaatggaaggaccccgatggaatgctccgggaccacatcaatatcctggtgaccaaggatattgacttcgacaacctgggcgagaatccttgcaaaatcgggcttcaaacatcttccattgaaggagcttggggcagcggggtcggatttacgcttacctgcctgatctctctgacagagtgtcccaccttcctcacatccattaaggcctgcgataaagccatctgttatggcgctgagagcgtgaccctgacgagagggcagaacaccgttaaggtgtctggcaaaggaggccactccgggagcacatttaagtgctgtcatggagaagagtgctcccagattggccttcacgcggccgctccgcatctggacaaggtcaatgggatcagcgaaatcgagaacaataaagtgtacgatgacggagcccctcaatgtggcgtgaagtgctggttcgtcaaatctggcgaatggattagcgggatcttttccggaaactggattgttctcatcgtgctgtgtgtgttcctgcttttctctctcgtcctgctgagcgtgctctgccccgttcgcaagcacaaaaagtcctga

SEQ ID NO: 13343 - RNA, 3408 nt, synthetic construct
  misc_feature 1..3408: note = derived and/or modified CDS sequence (opt5) from HTNV(LongquanAa-08-157)__JQ912804.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgagaatagcgtgatcgggtatgtcgaacttagcccgatgcccctggccgatacggcgcagatggtgcctgagtcctcttgtaacatggacaatcatcaaagcatgaacaccattacaaagtacacccaggtttcctggcggggaaaagctgatcaggcccaggcctctcaaaatagcttcgaagctgtgtccgccgaggtcgacctcaagggcacatgcgtgctgaaacacaagatgcttgaggaaagctatcgctctagaaagtccatcacctgttacgatctgagctgcaactctacatattgtaaacccaccctctacatgattgttcctatccatgcttgcaatatgatgaagtcctgtctgatcgccctggggccctatcgggtgcaggtcgtgtacgagcgcacgtactgcatgaccggagtgctcattgaaggcaaatgttttgtccctgaccagagcgttgtgtctatcattaagcacgggatcttcgatattgcgtccgtgcatatcgtctgctttttcgtggccgttaaaggaaacacatataagctgtttgaacaggtgaagaaatctttccaatccacctgtaatggcacagagaacaaggtccagggctactatatttgcatcgttgggggaaattctgctccgatctacgtgcccacccttgacgattttagaagcatggaagccttctccggcatttttcggagccctcacggggaggaccacgatctggctggagaagagatcgcctcttattccattgtgggccccgcgaacgccaaagtccctcatagcgcttctagcgacacgctctccctgatcgcctactctgggattcccagctattccagcctttctatcctggcttccagcacagaagccaagcacgtgttctctccgggatttttccctcagctcaatcataccaaatgcgataagacagccatccccctgacctggaccggcatgattgacctgcctggctactacgaggctatccacccctgtacagtcttctgcgtgctctccgggcccggagcgagctgtgaggccttttccgaaggcgggattttcaacatcacgtctcctatgtgcctggttagcaaacagaatcgctttagacttaccgagcaacaggtgaacttcgtctgtcagcgggtggacatggatattatcgtttattgcaacggacaacgcaaggtgatcctgacaaagaccctcgtcattggccagtgtatctacacaattacctccctgttttctcttctgccgggggtggctcacagcatcgccgtggaactctgcgttcccggattccatggctgggccacggctgccctgctggtcacattttgtttcggctgggtgctcattcctgcgctgacccttatcattctgaccatcctcaaatttatcgctaatctgttccacacatccaaccaggagaatagacttaagagcgtgctgcggaaaattaaggaagagtttgagaaaaccaaggggtctatggtctgcgacgtgtgtaagtatgaatgcgagacatacaaagaactcaaggcccatggagtttcctgcccccagagccaatgtccttattgcttcacgcactgtgagcccaccgaagccgcttttcaggcccattaccgcgtgtgccaggtcacacacagattccgggatgacctgaaaaagaccgtgacaccgcagaacttcacccctggctgttatcgcacgctgaatctctttagatacaaatctcggtgctacatcttcaccatgtgggtttgtctgcttgtgctggagtccattctctgggctgccagcgcgtctgaggtccccctgaaccctgtgtggaatgataacgcccacggggttggaagcgtgcccatgcatacagacctggaacttgatttttccctcacctctagctccaagtatacatacagacgccggctgaccaatcctctggaggaaacgcaaagcatcaacctccacattgagatcgaggaacagacaatcggcgtcgacgtgcatgctctggggcactggttcgatggcagacttaatctgaagacctcctttcactgctatggagcctgtacaaaatacgagtatccctggcataccgctaagtgccactacgaacgcgactatcagtacgagacctcttggggctgtaacccggccgattgccctggggtgggaacaggctgcacggcgtgtgggctctacctggaccagctgaaacccgtcggaagcgcctataagattatcaccattcggtactccagaaaagtttgcgtgcaattcggcgaagagaatctttgtaaggtgatcgacatgaacgattgctttgtcacacgccatgtgaaggtttgtattatcgggaccgtgtctaaattcagccagggcgacacactcctgtttttcggacccctggagggcgggggactcatctttaagcactggtgcacctccacgtgtcagttcggcgatcctggggacattatgtctccgcgggataaaggatttctgtgccccgagttccctggcagcttcagaaagaaatgtaattttgctacaacacccctttgcgagtatgacgggaacatggtctccggctacaagaaagtgatggccaccatcgatagcttccagtcttttaacacctccaccatgcatttcacagacgaacgcattgagtggaaggatcctgacggaatgctgcgggatcacatcaatattctcgttacgaaggacatcgattttgacaacctgggcgaaaatccctgtaaaatcgggctgcaaaccagctctattgagggagcttggggctccggggtgggattcacacttacctgcctcatcagcctgacagagtgccctacctttctgacgtctattaaggcctgtgacaaagccatctgctatggcgctgaatccgtcaccctcacaagagggcagaacaccgtgaaggttagcggcaaaggaggccactccgggagcacattcaagtgttgccatggagaggaatgttctcagattggcctgcacgcggccgctccccatcttgataaggtgaatgggatcagcgagattgaaaacaataaagtctacgacgatggagccccgcaatgcggcgtgaagtgttggtttgtgaaatccggcgagtggatctctgggatcttcagcggaaactggattgtcctgatcgttctctgcgtgtttctgctgttctcccttgtgctcctgtctgtcctgtgtcctgtgcgcaagcacaaaaagagctga

SEQ ID NO: 13344 - RNA, 3408 nt, synthetic construct
  misc_feature 1..3408: note = derived and/or modified CDS sequence (opt5) from HTNV(LongquanAa-08-196)__JQ912805.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgaacttccgcccatgcctctggccgatacggcgcagatggtgcccgagagctcctgtaacatggacaatcatcaatctatgaacaccattacaaagtacacccaggttagctggcggggaaaagctgatcaggcccaggcctcccaaaattctttcgaagctgtgagcgccgaggtcgacctcaagggcacatgcgtgctgaaacacaagatgcttgaggaatcctatcgcagcagaaagtctatcacctgttacgatctgtcctgcaacagcacatattgtaaacctaccctctacatgattgttcccatccatgcttgcaatatgatgaagtcttgtctgatcgccctggggccttatcgggtgcaggtcgtgtacgagcgcacgtactgcatgaccggagtgctcattgaaggcaaatgttttgtcccggaccagtccgttgtgagcatcattaagcacgggatcttcgatattgcgtctgtgcatatcgtctgctttttcgtggccgttaaaggaaacacatataagctgtttgaacaggtgaagaaatccttccaaagcacctgtaatggcacagagaacaaggtccagggctactatatttgcatcgttgggggaaattccgctcccatctacgtgcctacccttgacgattttagatctatggaggccttcagcggcatttttcggagcccccacggggaggaccacgatctggctggagaagagatcgcctcctattctattgtgggccctgcgaacgccaaagtcccccattccgctagctctgacacgctcagcctgatcgcctactccgggattccgtcttatagctcccttagcatcctggcttcttccacagaagccaagcacgtgttcagccctggatttttcccccagctcaatcataccaaatgcgataagacagccatccctctgacctggaccggcatgattgacctgcccggctactacgaggctatccacccctgtacagtcttctgcgtgctctctgggcctggagcgtcctgtgaggcctttagcgaaggcgggattttcaacatcacgtccccgatgtgcctggtttctaaacagaatcgctttagacttaccgagcaacaggtgaacttcgtctgtcagcgggtggacatggatattatcgtttattgcaacggacaacgcaaggtgatcctgacaaagaccctcgtcattggccagtgtatctacacaattaccagcctgttttcccttctgcccggggtggctcactctatcgccgtggaactctgcgttcctggattccatggctgggccacggctgccctgctggtcacattttgtttcggctgggtgctcattcccgcgctgacccttatcattctgaccatcctcaaatttatcgctaatattttccacacaagcaaccaggagaatagactgaagtccgtgcttcggaaaatcaaggaagagtttgagaaaaccaaggggagcatggtctgcgacgtgtgtaagtatgaatgcgagacatacaaagaactgaaggcccatggagtttcttgccctcagtcccaatgtccctattgcttcacgcactgtgagccgaccgaagccgcttttcaggcccattaccgcgtgtgccaggtcacacacagattccgggatgacctcaaaaagaccgtgacacctcagaacttcacccccggctgttatcgcacgctgaatctgtttagatacaaaagccggtgctacattttcaccatgtgggtttgtctcctggtgcttgagtctatcctgtgggctgcctccgcgagcgaggtccctctcaaccccgtgtggaatgataacgcccacggggttggatctgtgcctatgcatacagacctggaactggattttagccttacctccagctctaagtatacatacagacgccggctcaccaatcccctggaggaaacgcaatccattaacctgcacatcgagatcgaggaacagacaattggcgtcgacgtgcatgctctcgggcactggttcgatggcagactgaatcttaagaccagctttcactgctatggagcctgtacaaaatacgagtatccgtggcataccgctaagtgccactacgaacgcgactatcagtacgagacctcctggggctgtaaccctgccgattgccccggggtgggaacaggctgcacggcgtgtgggctgtacctcgaccagctgaaacccgtcggatctgcctataagatcattaccatccggtacagcagaaaagtttgcgtgcaattcggcgaagagaatctgtgtaaggtgattgacatgaacgattgctttgtcacacgccatgtgaaggtttgtatcatcgggaccgtgtccaaattctctcagggcgacacacttctctttttcggacctctggagggcgggggactgatttttaagcactggtgcaccagcacgtgtcagttcggcgatccgggggacatcatgtctccccgggataaaggatttctctgccctgagttccccggctccttcagaaagaaatgtaattttgctacaacccctctgtgcgagtatgacgggaacatggtcagcggctacaagaaagtgatggccaccattgattccttccagagctttaacacatctaccatgcatttcacagacgaacgcatcgagtggaaggatcccgacggaatgcttcgggatcacattaatatcctggttacgaaggacatcgattttgacaacctcggcgaaaatccttgtaaaattgggctgcaaacctccagcatcgagggagcttggggctctggggtgggattcacactgacctgccttatttccctcacagagtgccccacctttctgacgagcatcaaggcctgtgacaaagccatttgctatggcgctgaatctgtcaccctgacaagagggcagaacaccgtgaaggtttccggcaaaggaggccacagcgggtccacattcaagtgttgccatggagaggaatgtagccagatcggcctccacgcggccgctccgcatctggataaggtgaatgggatttctgagatcgaaaacaataaagtctacgacgatggagcccctcaatgcggcgtgaagtgttggtttgtgaaaagcggcgagtggatctccgggattttctctggaaactggatcgtccttattgttctgtgcgtgtttctcctgttcagcctggtgcttctctccgtcctgtgtcccgtgcgcaagcacaaaaagtcttga

SEQ ID NO: 13345 - RNA, 3408 nt, synthetic construct
  misc_feature 1..3408: note = derived and/or modified CDS sequence (opt5) from HTNV(LongquanAa-08-235)__JQ912810.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgaacttccgcccatgcctctggccgatacggcgcagatggtgcccgagagctcctgtaacatggacaatcatcaatctatgaacaccattacaaagtacacccaggttagctggcggggaaaagctgatcaggcccaggcctcccaaaattctttcgaagctgtgagcgccgaggtcgacctcaagggcacatgcgtgctgaaacacaagatgcttgaggaatcctatcgcagcagaaagtctatcacctgttacgatctgtcctgcaacagcacatattgtaaacctaccctctacatgattgttcccatccatgcttgcaatatgatgaagtcttgtctgatcgccctggggccttatcgggtgcaggtcgtgtacgagcgcacgtactgcatgaccggagtgctcattgaaggcaaatgttttgtcccggaccagtccgttgtgagcatcattaagcacgggatcttcgatattgcgtctgtgcatatcgtctgctttttcgtggccgttaaaggaaacacatataagctgtttgaacaggtgaagaaatccttccaaagcacctgtaatggcacagagaacaaggtccagggctactatatttgcatcgttgggggaaattccgctcccatctacgtgcctacccttgacgattttagatctatggaggccttcagcggcatttttcggagcccccacggggaggaccacgatctggctggagaagagatcgcctcctattctattgtgggccctgcgaacgccaaagtcccccattccgctagctctgacacgctcagcctgatcgcctactccgggattccgtcttatagctcccttagcatcctggcttcttccacagaagccaagcacgtgttcagccctggatttttcccccagctcaatcataccaaatgcgataagacagccatccctctgacctggaccggcatgattgacctgcccggctactacgaggctatccacccctgtacagtcttctgcgtgctctctgggcctggagcgtcctgtgaggcctttagcgaaggcgggattttcaacatcacgtccccgatgtgcctggtttctaaacagaatcgctttagacttaccgagcaacaggtgaacttcgtctgtcagcgggtggacatggatattatcgtttattgcaacggacaacgcaaggtgatcctgacaaagaccctcgtcattggccagtgtatctacacaattaccagcctgttttcccttctgcccggggtggctcactctatcgccgtggaactctgcgttcctggattccatggctgggccacggctgccctgctggtcacattttgtttcggctgggtgctcattcccgcgctgacccttatcattctgaccatcctcaaatttatcgctaatattttccacacaagcaaccaggagaatagactgaagtccgtgcttcggaaaatcaaggaagagtttgagaaaaccaaggggagcatggtctgcgacgtgtgtaagtatgaatgcgagacatacaaagaactgaaggcccatggagtttcttgccctcagtcccaatgtccctattgcttcacgcactgtgagccgaccgaagccgcttttcaggcccattaccgcgtgtgccaggtcacacacagattccgggatgacctcaaaaagaccgtgacacctcagaacttcacccccggctgttatcgcacgctgaatctgtttagatacaaaagccggtgctacattttcaccatgtgggtttgtctcctggtgtttgagtctatcctttgggctgcctccgcgagcgaggtccctctgaaccccgtgtggaatgataacgcccacggggttggatctgtgcctatgcatacagacctcgaactggatttcagcctgacctccagctctaagtatacatacagacgccggcttaccaatcccctcgaggaaacgcaatccattaacctgcacatcgagatcgaggaacagacaattggcgtcgacgtgcatgctctggggcactggtttgatggcagactcaatctgaagaccagcttccactgctatggagcctgtacaaaatacgagtatccgtggcataccgctaagtgccactacgaacgcgactatcagtacgagacctcctggggctgtaaccctgccgattgccccggggtgggaacaggctgcacggcgtgtgggctttacctggaccagctcaaacccgtcggatctgcctataagatcattaccatccggtacagcagaaaagtttgcgtgcaatttggcgaagagaatctgtgtaaggtgattgacatgaacgattgcttcgtcacacgccatgtgaaggtttgtatcatcgggaccgtgtccaaattttctcagggcgacacactgcttttctttggacctctcgagggcgggggactgattttcaagcactggtgcaccagcacgtgtcagtttggcgatccgggggacatcatgtctccccgggataaaggattcctgtgccctgagttccccggctcctttagaaagaaatgtaatttcgctacaacccctctctgcgagtatgacgggaacatggtcagcggctacaagaaagtgatggccaccattgattcctttcagagcttcaacacatctaccatgcattttacagacgaacgcatcgagtggaaggatcccgacggaatgctgcgggatcacattaatatccttgttacgaaggacatcgatttcgacaacctgggcgaaaatccttgtaaaattgggctccaaacctccagcatcgagggagcttggggctctggggtgggatttacactgacctgcctgatttcccttacagagtgccccaccttcctcacgagcatcaaggcctgtgacaaagccatttgctatggcgctgaatctgtcaccctgacaagagggcagaacaccgtgaaggtttccggcaaaggaggccacagcgggtccacatttaagtgttgccatggagaggaatgtagccagatcggcctgcacgcggccgctccgcatctcgataaggtgaatgggatttctgagatcgaaaacaataaagtctacgacgatggagcccctcaatgcggcgtgaagtgttggttcgtgaaaagcggcgagtggatctccgggattttctctgtcaactggatcgttctgattgtgctttgcgtgttcctgctctttagcctggtcctgctttccgtgctctgtcccgttcgcaagcacaaaaagtcttga

SEQ ID NO: 13346 - RNA, 3408 nt, synthetic construct
  misc_feature 1..3408: note = derived and/or modified CDS sequence (opt5) from HTNV(LongquanAa-09-171)__JQ912824.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgaacttccgcccatgcctctggccgatacggcgcagatggtgcccgagagctcctgtaacatggacaatcatcaatctatgaacaccattacaaagtacacccaggttagctggcggggaaaagctgatcaggcccaggcctcccaaaattctttcgaagctgtgagcgccgaggtcgacctcaagggcacatgcgtgctgaaacacaagatgcttgaggaatcctatcgcagcagaaagtctatcacctgttacgatctgtcctgcaacagcacatattgtaaacctaccctctacatgattgttcccatccatgcttgcaatatgatgaagtcttgtctgatcgccctggggccttatcgggtgcaggtcgtgtacgagcgcacgtactgcatgaccggagtgctcattgaaggcaaatgttttgtcccggaccagtccgttgtgagcatcattaagcacgggatcttcgatattgcgtctgtgcatatcgtctgctttttcgtggccgttaaaggaaacacatataagctgtttgaacaggtgaagaaatccttccaaagcacctgtaatggcacagagaacaaggtccagggctactatatttgcatcgttgggggaaattccgctcccatctacgtgcctacccttgacgattttagatctatggaggccttcagcggcatttttcggagcccccacggggaggaccacgatctggctggagaagagatcgccagctattctattgtgggccctgcgaacgccaaagtcccccattccgctagctctgacacgctcagcctgatcgcctactccgggattccgtcttatagctcccttagcatcctggcttcttccacagaagccaagcacgtgttcagccctggatttttcccccagctcaatcataccaaatgcgataagacagccatccctctgacctggaccggcatgattgacctgcccggctactacgaggctatccacccctgtacagtcttctgcgtgctctctgggcctggagcgtcctgtgaggcctttagcgaaggcgggattttcaacatcacgtccccgatgtgcctggtttctaaacagaatcgctttagacttaccgagcaacaggtgaacttcgtctgtcagcgggtggacatggatattatcgtttattgcaacggacaacgcaaggtgatcctgacaaagaccctcgtcattggccagtgtatctacacaattaccagcctgttttcccttctgcccggggtggctcactctatcgccgtggaactctgcgttcctggattccatggctgggccacggctgccctgctggtcacattttgtttcggctgggtgctcattcccgcgctgacccttatcattctgaccatcctcaaatttatcgctaatattttccacacaaacaatcaggagaacagactgaagtccgtgcttcggaaaatcaaggaagagtttgagaaaaccaaggggtccatggtctgcgacgtgtgtaagtatgaatgcgagacatacaaagaactgaaggcccatggagttagctgccctcagtctcaatgtccctattgcttcacgcactgtgagccgaccgaagccgcttttcaggcccattaccgcgtgtgccaggtcacacacagattccgggatgacctcaaaaagaccgtgacacctcagaatttcacccccggctgttatcgcacgctgaacctgtttagatacaaatcccggtgctacattttcaccatgtgggtttgtctcctggtgcttgagagcatcctgtgggctgcctctgcgtccgaggtccctctcaatcccgtgtggaacgataatgcccacggggttggaagcgtgcctatgcatacagacctggaactggatttttctcttaccagctccagcaagtatacatacagacgccggctcaccaaccccctggaggaaacgcaatctattaatctgcacatcgagatcgaggaacagacaattggcgtcgacgtgcatgctctcgggcactggttcgatggcagactgaaccttaagacctcctttcactgctatggagcctgtacaaaatacgagtatccgtggcataccgctaagtgccactacgaacgcgactatcagtacgagaccagctggggctgtaatcctgccgattgccccggggtgggaacaggctgcacggcgtgtgggctgtacctcgaccagctgaaacccgtcggatccgcctataagatcattaccatccggtactctagaaaagtttgcgtgcaattcggcgaagagaacctgtgtaaggtgattgacatgaatgattgctttgtcacacgccatgtgaaggtttgtatcatcgggaccgtgagcaaattctcccagggcgacacacttctctttttcggacctctggagggcgggggactgatttttaagcactggtgcacctctacgtgtcagttcggcgatccgggggacatcatgagcccccgggataaaggatttctctgccctgagttccccggctccttcagaaagaaatgtaactttgctacaacccctctgtgcgagtatgacgggaacatggtctctggctacaagaaagtgatggccaccattgatagcttccagtcctttaatacaagcaccatgcatttcacagacgaacgcatcgagtggaaggatcccgacggaatgcttcgggatcacattaacatcctggttacgaaggacatcgattttgacaatctcggcgaaaacccttgtaaaattgggctgcaaacctcttccatcgagggagcttggggcagcggggtgggattcacactgacctgccttatttctctcacagagtgccccacctttctgacgtccatcaaggcctgtgacaaagccatttgctatggcgctgaaagcgtcaccctgacaagagggcagaataccgtgaaggtttctggcaaaggaggccactccgggagcacattcaagtgttgccatggagaggaatgttcccagatcggcctccacgcggccgctccgcatctggataaggtgaacgggattagcgagatcgaaaataacaaagtctacgacgatggagcccctcaatgcggcgtgaagtgttggtttgtgaaatctggcgagtggatcagcgggattttctccggaaattggatcgtccttattgttctgtgcgtgtttctcctgttctctctggtgcttctcagcgtcctgtgtcccgtgcgcaagcacaaaaagtcctga

SEQ ID NO: 13347 - RNA, 3408 nt, synthetic construct
  misc_feature 1..3408: note = derived and/or modified CDS sequence (opt5) from HTNV(LongquanAa-09-191)__JQ912825.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgaacttccgcggatgcccctggccgatacggcgcagatggtgcctgagagctcctgtaacatggacaatcatcaatctatgaacaccattacaaagtacacccaggttagctggcgcggaaaagctgatcaggcccaggcctcccaaaattctttcgaagctgtgagcgccgaggtcgacctcaagggcacatgcgtgctgaaacacaagatgcttgaggaatcctatagaagccggaagtctatcacctgttacgatctgtcctgcaacagcacatattgtaaacccaccctctacatgattgttcctatccatgcttgcaatatgatgaagtcttgtctgatcgccctggggccctatcgcgtgcaggtcgtgtacgagagaacgtactgcatgaccggagtgctcattgaaggcaaatgttttgtccctgaccagtccgttgtgagcatcattaagcacgggatcttcgatattgcgtctgtgcatatcgtctgctttttcgtggccgttaaaggaaacacatataagctgtttgaacaggtgaagaaatccttccaaagcacctgtaatggcacagagaacaaggtccagggctactatatttgcatcgttgggggaaattccgctccgatctacgtgcccacccttgacgattttcggtctatggaggccttcagcggcatttttcgctcccctcacggggaggaccacgatctggctggagaagagatcgccagctattctattgtgggccccgcgaacgccaaagtccctcattccgctagctctgacacgctcagcctgatcgcctactccgggattccctcttatagctcccttagcatcctggcttcttccacagaagccaagcacgtgttcagcccgggatttttccctcagctcaatcataccaaatgcgataagacagccatccccctgacctggaccggcatgattgacctgcctggctactacgaggctatccacccctgtacagtcttctgcgtgctctctgggcccggagcgtcctgtgaggcctttagcgaaggcgggattttcaacatcacgtcccctatgtgcctggtttctaaacagaatagatttcggcttaccgagcaacaggtgaacttcgtctgtcagcgcgtggacatggatattatcgtttattgcaacggacaaagaaaggtgatcctgacaaagaccctcgtcattggccagtgtatctacacaattaccagcctgttttcccttctgccgggggtggctcactctatcgccgtggaactctgcgttcccggattccatggctgggccacggctgccctgctggtcacattttgtttcggctgggtgctcattcctgcgctgacccttatcattctgaccatcctcaaatttatcgctaatattttccacacaagcaaccaggagaatcggctgaagtccgtgcttcgcaaaatcaaggaagagtttgagaaaaccaaggggagcatggtctgcgacgtgtgtaagtatgaatgcgagacatacaaagaactgaaggcccatggagtttcttgcccccagtcccaatgtccttattgcttcacgcactgtgagcccaccgaagccgcttttcaggcccattacagagtgtgccaggtcacacaccggttccgcgatgacctcaaaaagaccgtgacaccgcagaacttcacccctggctgttatagaacgctgaatctgtttcggtacaaaagcagatgctacattttcaccatgtgggtttgtctcctggtgcttgagtctatcctgtgggctgcctccgcgagcgaggtccccctcaaccctgtgtggaatgataacgcccacggggttggatctgtgcccatgcatacagacctggaactggattttagccttacctccagctctaagtatacataccgccggagactcaccaatcctctggaggaaacgcaatccattaacctgcacatcgagatcgaggaacagacaattggcgtcgacgtgcatgctctcgggcactggttcgatggccgcctgaatcttaagaccagctttcactgctatggagcctgtacaaaatacgagtatccctggcataccgctaagtgccactacgaacgggactatcagtacgagacctcctggggctgtaacccggccgattgccctggggtgggaacaggctgcacggcgtgtgggctgtacctcgaccagctgaaacccgtcggatctgcctataagatcattaccatcagatacagccgcaaagtttgcgtgcaattcggcgaagagaatctgtgtaaggtgattgacatgaacgattgctttgtcacacggcatgtgaaggtttgtatcatcgggaccgtgtccaaattctctcagggcgacacacttctctttttcggacccctggagggcgggggactgatttttaagcactggtgcaccagcacgtgtcagttcggcgatcctggggacatcatgtccccgagagataaaggatttctctgccccgagttccctggctctttccgcaagaaatgtaattttgctacaacacccctgtgcgagtatgacgggaacatggtcagcggctacaagaaagtgatggccaccattgattccttccagagctttaacacctctaccatgcatttcacagacgaacggatcgagtggaaggatcctgacggaatgcttagagatcacattaatatcctggttacgaaggacatcgattttgacaacctcggcgaaaatccctgtaaaattgggctgcaaacctccagcatcgagggagcttggggctctggggtgggattcacactgacctgccttatttccctcacagagtgccctacctttctgacgagcatcaaggcctgtgacaaagccatttgctatggcgctgaatctgtcaccctgacacgcgggcagaacaccgtgaaggtttccggcaaaggaggccacagcgggtccacattcaagtgttgccatggagaggaatgtagccagatcggcctccacgcggccgctccccatctggataaggtgaatgggatttctgagatcgaaaacaataaagtctacgacgatggagccccgcaatgcggcgtgaagtgttggtttgtgaaaagcggcgagtggatctccgggattttctctggaaactggatcgtccttattgttctgtgcgtgtttctcctgttcagcctggtgcttctctccgtcctgtgtcctgtgcggaagcacaaaaagtcttga

SEQ ID NO: 13348 - RNA, 3408 nt, synthetic construct
  misc_feature 1..3408: note = derived and/or modified CDS sequence (opt5) from HTNV(LongquanAa-09-350)__JQ912835.1__GP
  source 1..3408: mol_type = other RNA
atggagatctggaagtggctggtgatggccagcctcgtctggcccgctttcaccagacggaacgtttacgacatgaaaattgaatgccctcacacagtgtcctttggcgaaaattctgtgatcgggtatgtcgaactgccgcccatgcctcttgccgatacggcgcagatggtgcccgagagctcctgtaacatggacaatcatcaatctatgaacaccattacaaagtacacccaggttagctggcgcggaaaagctgatcaggcccaggcctcccaaaattctttcgaagctgtgagcgccgaggtcgacctgaagggcacatgcgtgctcaaacacaagatgctggaggaatcctatagaagccggaagtctatcacctgttacgatctttcctgcaacagcacatattgtaaacctaccctgtacatgattgttcccatccatgcttgcaatatgatgaagtcttgtctcatcgccctggggccttatcgcgtgcaggtcgtgtacgagagaacgtactgcatgaccggagtgctgattgaaggcaaatgttttgtcccggaccagtccgttgtgagcatcattaagcacgggatcttcgatattgcgtctgtgcatatcgtctgctttttcgtggccgttaaaggaaacacatataagctctttgaacaggtgaagaaatccttccaaagcacctgtaatggcacagagaacaaggtccagggctactatatttgcatcgttgggggaaattccgctcccatctacgtgcctaccctggacgattttcggtctatggaggccttcagcggcatttttcgcagcccccacggggaggaccacgatcttgctggagaagagatcgcctcctattctattgtgggccctgcgaacgccaaagtcccccattccgctagctctgacacgctgagcctcatcgcctactccgggattccgtcttatagctccctgagcatccttgcttcttccacagaagccaagcacgtgttcagccctggatttttcccccagctgaatcataccaaatgcgataagacagccatccctctcacctggaccggcatgattgacctgcccggctactacgaggctatccacccctgtacagtcttctgcgtgctgtctgggcctggagcgtcctgtgaggcctttagcgaaggcgggattttcaacatcacgtccccgatgtgcctcgtttctaaacagaatagatttcggctgaccgagcaacaggtgaacttcgtctgtcagcgcgtggacatggatattatcgtttattgcaacggacaaagaaaggtgatccttacaaagaccctggtcattggccagtgtatctacacaattaccagcctcttttccctgcttcccggggtggctcactctatcgccgtggaactgtgcgttcctggattccatggctgggccacggctgccctcctggtcacattttgtttcggctgggtgctgattcccgcgctcaccctgatcattcttaccatcctgaaatttatcgctaatattttccacacaagcaaccaggagaatcggctcaagtccgtgctgcgcaaaatcaaggaagagtttgagaaaaccaaggggagcatggtctgcgacgtgtgtaagtatgaatgcgagacatacaaagaacttaaggcccatggagtttcttgccctcagtcccaatgtccctattgcttcacgcactgtgagccgaccgaagccgcttttcaggcccattacagagtgtgccaggtcacacaccggttccgcgatgacctgaaaaagaccgtgacacctcagaacttcacccccggctgttatagaacgctcaatctgtttcggtacaaaagcagatgctacattttcaccatgtgggtttgtctgctcgtgctggagtctatcctttgggctgcctccgcgagcgaggtccctctgaaccccgtgtggaatgataacgcccacggggttggatctgtgcctatgcatacagacctcgaactggattttagcctgacctccagctctaagtatacataccgccggagacttaccaatcccctcgaggaaacgcaatccattaacctgcacatcgagatcgaggaacagacaattggcgtcgacgtgcatgctctggggcactggttcgatggccgcctcaatctgaagaccagctttcactgctatggagcctgtacaaaatacgagtatccgtggcataccgctaagtgccactacgaacgggactatcagtacgagacctcctggggctgtaaccctgccgattgccccggggtgggaacaggctgcacggcgtgtgggctttacctggaccagctcaaacccgtcggatctgcctataagatcattaccatcagatacagccgcaaagtttgcgtgcaattcggcgaagagaatctgtgtaaggtgattgacatgaacgattgctttgtcacacggcatgtgaaggtttgtatcatcgggaccgtgtccaaattctctcagggcgacacactgctgtttttcggacctctcgagggcgggggactgatttttaagcactggtgcaccagcacgtgtcagttcggcgatccgggggacatcatgtcccccagagataaaggatttctgtgccctgagttccccggctctttccgcaagaaatgtaattttgctacaacccctctctgcgagtatgacgggaacatggtcagcggctacaagaaagtgatggccaccattgattccttccagagctttaacacatctaccatgcatttcacagacgaacggatcgagtggaaggatcccgacggaatgctgagagatcacattaatatccttgttacgaaggacatcgattttgacaacctgggcgaaaatccttgtaaaattgggctccaaacctccagcatcgagggagcttggggctctggggtgggattcacactgacctgcctgatttcccttacagagtgccccacctttctcacgagcatcaaggcctgtgacaaagccatttgctatggcgctgaatctgtcaccctgacacgcgggcagaacaccgtgaaggtttccggcaaaggaggccacagcgggtccacattcaagtgttgccatggagagaagtgtagccagatcggcctgcacgcggccgctccgcatctcgataaagtgaatgggatttctgaaatcgagaacaataaggtctacgacgatggagcccctcaatgcggcgtgaaatgttggtttgtcaagagcggcgaatggatctccgggattttctctggaaactggatcgtgctgattgttctttgcgtgtttcttctcttcagcctggtgctgctttccgtcctctgtcccgtgcggaaacacaagaagtcttga

SEQ ID NO: 13349 - RNA, 3408 nt, synthetic construct
  misc_feature 1..3408: note = derived and/or modified CDS sequence (opt5) from HTNV(LongquanAa-09-489)__JQ912844.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgagaatagcgtgatcgggtatgtcgaacttccgcggatgcccctggccgatacggcgcagatggtgcctgagagctcctgtaacatggacaatcatcaatctatgaacaccattacaaagtacacccaggttagctggcgcggaaaagctgatcaggcccaggcctcccaaaattctttcgaagctgtgagcgccgaggtcgacctcaagggcacatgcgtgctgaaacacaagatgcttgaggaatcctatagaagccggaagtctatcacctgttacgatctgtcctgcaacagcacatattgtaaacccaccctctacatgattgttcctatccatgcttgcaatatgatgaagtcttgtctgatcgccctggggccctatcgcgtgcaggtcgtgtacgagagaacgtactgcatgaccggagtgctcattgaaggcaaatgttttgtccctgaccagtccgttgtgagcatcattaagcacgggatcttcgatattgcgtctgtgcatatcgtctgctttttcgtggccgttaaaggaaacacatataagctgtttgaacaggtgaagaaatccttccaaagcacctgtaatggcacagagaacaaggtccagggctactatatttgcatcgttgggggaaattccgctccgatctacgtgcccacccttgacgattttcggtctatggaggccttcagcggcatttttcgctcccctcacggggaggaccacgatctggctggagaagagatcgccagctattctattgtgggccccgcgaacgccaaagtccctcattccgctagctctgacacgctcagcctgatcgcctactccgggattccctcttatagctcccttagcatcctggcttcttccacagaagccaagcacgtgttcagcccgggatttttccctcagctcaatcataccaaatgcgataagacagccatccccctgacctggaccggcatgattgacctgcctggctactacgaggctatccacccctgtacagtcttctgcgtgctctctgggcccggagcgtcctgtgaggcctttagcgaaggcgggattttcaacatcacgtcccctatgtgcctggtttctaaacagaatagatttcggcttaccgagcaacaggtgaacttcgtctgtcagcgcgtggacatggatattatcgtttattgcaacggacaaagaaaggtgatcctgacaaagaccctcgtcattggccagtgtatctacacaattaccagcctgttttcccttctgccgggggtggctcactctatcgccgtggaactctgcgttcccggattccatggctgggccacggctgccctgctggtcacattttgtttcggctgggtgctcattcctgcgctgacccttatcattctgaccatcctcaaatttatcgctaatattttccacacaagcaaccaggagaatcggctgaagtccgtgcttcgcaaaatcaaggaagagtttgagaaaaccaaggggagcatggtctgcgacgtgtgtaagtatgaatgcgagacatacaaagaactgaaggcccatggagtttcttgcccccagtcccaatgtccttattgcttcacgcactgtgagcccaccgaagccgcttttcaggcccattacagagtgtgccaggtcacacaccggttccgcgatgacctcaaaaagaccgtgacaccgcagaacttcacccctggctgttatagaacgctgaatctgtttcggtacaaaagcagatgctacattttcaccatgtgggtttgtctcctggtgcttgagtctatcctgtgggctgcctccgcgagcgaggtccccctcaaccctgtgtggaatgataacgcccacggggttggatctgtgcccatgcatacagacctgcaactggattttagccttacctccagctctaagtatacataccgccggagactcaccaatcctctggaagagacgcagtccattaacctgcacatcgaaatcgaggagcagacaattggcgtcgacgtgcatgctctcgggcactggttcgatggccgcctgaatcttaagaccagctttcactgctatggagcctgtacaaaatacgaatatccctggcataccgctaagtgccactacgagcgggactatcagtacgaaacctcctggggctgtaacccggccgattgccctggggtgggaacaggctgcacggcgtgtgggctgtacctcgaccaactgaaacccgtcggatctgcctataagatcattaccatcagatacagccgcaaagtttgcgtgcagttcggcgaggaaaatctgtgtaaggtgattgacatgaacgattgctttgtcacacggcatgtgaaggtttgtatcatcgggaccgtgtccaaattctctcagggcgacacacttctctttttcggacccctggagggcgggggactgatttttaagcactggtgcaccagcacgtgtcagttcggcgatcctggggacatcatgtccccgagagataaaggatttctctgccccgagttccctggctctttccgcaagaaatgtaattttgctacaacacccctgtgcgaatatgacgggaacatggtcagcggctacaagaaagtgatggccaccattgattccttccaatcttttaacacctctaccatgcatttcacagacgagcggatcgaatggaaggatcctgacggaatgcttagagatcacattaatatcctggttacgaaggacatcgattttgacaacctcggcgagaatccctgtaaaattgggctgcagacctccagcatcgaaggagcttggggctctggggtgggattcacactgacctgccttatttccctcacagagtgccctacctttctgacgagcatcaaggcctgtgacaaagccatttgctatggcgctgagtctgtcaccctgacacgcgggcagaacaccgtgaaggtttccggcaaaggaggccacagcgggtccacattcaagtgttgccatggagaagagtgtagccaaatcggcctccacgcggccgctccccatctggataaggtgaatgggatttctgaaatcgagaacaataaagtctacgacgatggagccccgcagtgcggcgtgaagtgttggtttgtgaaaagcggcgaatggatctccgggattttctctggaaactggatcgtccttattgttctgtgcgtgtttctcctgttcagcctggtgcttctctccgtcctgtgtcctgtgcggaagcacaaaaagtcttga

SEQ ID NO: 13350 - RNA, 3408 nt, synthetic construct
  misc_feature 1..3408: note = derived and/or modified CDS sequence (opt5) from HTNV(LongquanAa-09-541)__JQ912850.1__GP
  source 1..3408: mol_type = other RNA
atgggcatctggaagtggctggtgatggccagcctcgtctggcccgctttcaccctgagaaacgtttacgacatgaaaattgagtgccctcacacagtgtcctttggggaaaattctgtgatcggatatgtcgagcttccgcccatgcctctggccgatacggcgcagatggtgcccgaaagctcctgtaacatggacaatcatcaatctatgaacaccattacaaagtacacccaggttagctggcggggcaaagctgatcaggcccaggcctcccaaaattctttcgaggctgtgagcgccgaagtcgacctcaaggggatctgcgtgctgaaacacaagatgcttgaggagtcctatcgcagcagaaagtctattacatgttacgatctgtcctgcaacagcacctattgtaaacctacactctacatgatcgttcccatccatgcttgcaatatgatgaagtcttgtctgattgccctgggaccttatcgggtgcaggtcgtgtacgaacgcacctactgcatgacgggcgtgctcctggaggggaaatgttttgtcccggaccagtccgttgtgagcatcattaagcacggaatcttcgatattgcgtctgtgcatatcgtctgctttttcgtggccgttaaaggcaacacctataaactttttgaacaggtgaagaagtccttccaaagcacatgtaatggcaccgagaacaaggtccaggggtactatatttgcatcgtgggaggcaattccgctcccatctacgttcctacactggacgattttagatctatggaggccttcagcgggatttttcggagcccccacggagaagaccacgatctcgctggcgaggaaatcgccagctattctattgtggggcctgcgaacgccaaagtcccccattccgctagctctgacaccctgagccttatcgcctactccgggattccgtcttatagctccctgagcatcctcgcttcttccacggaggccaagcacgtgttcagccctggctttttcccccagctgaatcatacaaaatgcgataagaccgccatccctctgacatggaccggcatgattgacctccccgggtactacgaagctatccacccctgtaccgtcttctgcgtgctgtctggacctggcgcgtcctgtgaggcctttagcgagggaggaattttcaacatcacatccccgatgtgccttgtttctaaacagaatcgctttagactgacggaacaacaggtgaacttcgtctgtcagcgggtggacatggatattatcgtttattgcaacggccaacgcaaggtgatcctcaccaagacactggtcattgggcagtgtatctacaccattacaagcctgttttcccttctccccggagtggctcactctatcgccgtggagctgtgcgttcctggcttccatggctgggccaccgctgccctgctcgtcacgttttgtttcgggtgggtgctgattcccgcgcttacactgatcattctcaccatcctgaaatttatcgctaatattttccacaccagcaaccaggaaaatagacttaagtccgtgctgcggaaaatcaaggaggaatttgagaaaacaaagggaagcatggtctgcgacgtgtgtaagtatgagtgcgaaacctacaaagagctcaaggcccatggcgtttcttgccctcagtcccaatgtccctattgcttcacacactgtgaaccgacggaggccgcttttcaggcccattaccgcgtgtgccaggtcacccacagattccgggatgacctgaaaaagacagtgacccctcagaacttcacacccgggtgttatcgcaccctgaatctctttagatacaaaagccggtgctacattttcacgatgtgggtttgtctgcttgtgctggaatctatcctctgggctgcctccgcgagcgaggtccctctgaaccccgtgtggaatgataacgcccacggagttggctctgtgcctatgcataccgacctggagcttgattttagcctcacatccagctctaagtatacctacagacgccggctgacaaatcccctggaagagacccaatccattaacctccacatcgaaatcgaggagcagacgattggggtcgacgtgcatgctctgggccactggttcgatggaagacttaatctgaagacatcctttcactgctatggcgcctgtaccaaatacgaatatccgtggcatacagctaagtgccactacgagcgcgactatcagtacgaaacctcctgggggtgtaaccctgccgattgccccggagtgggcaccgggtgcacagcgtgtggactctacctggaccagctgaaacccgtcggctctgcctataagatcattacgatccggtacagcagaaaagtttgcgtgcaattcggggaggaaaatctttgtaaggtgattgacatgaacgattgctttgtcacccgccatgtgaaggtttgtatcatcggcacagtgtccaaattctctcagggagacaccctcctgtttttcggccctctggaagggggaggcctcatttttaagcactggtgcacaagcacctgtcagttcggggatccgggagacatcatgtctccccgggataaaggctttctgtgccctgagttccccgggtccttcagaaagaaatgtaattttgctacgacacctctttgcgagtatgacggcaacatggtcagcggatacaagaaagtgatggccaccattgattccttccagagctttaacacctctacaatgcatttcaccgacgagcgcatcgaatggaaggatcccgacggcatgctgcgggatcacattaatatcctcgttacaaaggacatcgattttgacaacctgggggagaatccttgtaaaattggactgcaaacgtccagcatcgaaggcgcttgggggtctggagtgggcttcacccttacatgcctcatttccctgaccgagtgccccacatttctgaccagcatcaaggcctgtgacaaagccatttgctatggggctgagtctgtcacgctcaccagaggccagaacacagtgaaggtttccggaaaaggcgggcacagcggatccaccttcaagtgttgccatggcgaagagtgtagccagatcgggctgcacgcggccgctccgcatcttgataaggtgaatggaatttctgaaatcgagaacaataaagtctacgacgatggcgcccctcaatgcggcgtgaagtgttggtttgtgaaaagcggggaatggatctccggaattttctctggcaactggatcgtcctgattgttctctgcgtgtttctgctgttcagccttgtgctcctgtccgtcctgtgtcccgtgcgcaagcacaaaaagtcttga

SEQ ID NO: 13351 - RNA, 3408 nt, synthetic construct
  misc_feature 1..3408: note = derived and/or modified CDS sequence (opt5) from HTNV(LongquanAa-09-698)__JQ912854.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgaacttccgcccatgcctctggccgatacggcgcagatggtgcccgagagctcctgtaacatggacaatcatcaatctatgaacaccattacaaagtacacccaggttagctggcggggaaaagctgatcaggcccaggcctcccaaaattctttcgaagctgtgagcgccgaggtcgacctcaagggcacatgcatcctgaaacacaagatgcttgaggaatcctatcgcagcagaaagtctattacctgttacgatctgtcctgcaacagcacatattgtaaacctaccctctacatgatcgtgcccatccatgcttgcaatatgatgaagtcttgtctgattgccctggggccttatcgggttcaggtggtctacgagcgcacgtactgcatgaccggagtgctcatcgaaggcaaatgttttgtgccggaccagtccgtcgttagcattatcaagcacgggattttcgatatcgcgtctgtgcatattgtgtgctttttcgtcgccgtgaaaggaaacacatataagctgtttgagcaggttaagaaatccttccaaagcacctgtaatggcacagagaacaaggtgcagggctactatatctgcatcgtcgggggaaattccgctcccatttacgtgcctacccttgacgattttagatctatggaagccttcagcggcatctttcggagcccccacggggaggaccacgatctggctggagaagagattgcctcctattctatcgttggccctgcgaacgccaaagtgccccattccgctagctctgacacgctcagcctgattgcctactccgggatcccgtcttatagctcccttagcatcctggcttcttccacagaagccaagcacgtcttcagccctggatttttcccccagctcaatcataccaaatgcgataagacagccattcctctgacctggaccggcatgatcgacctgcccggctactacgaggctattcacccctgtacagtgttctgcgtcctctctgggcctggagcgtcctgtgaggcctttagcgaaggcgggatcttcaacattacgtccccgatgtgcctggtgtctaaacagaatcgctttagacttaccgagcaacaggttaacttcgtgtgtcagcgggtcgacatggatatcatcgtgtattgcaacggacaacgcaaggttattctgacaaagaccctcgtgatcggccagtgtatttacacaatcaccagcctgttttcccttctgcccggggtcgctcactctattgccgtggaactctgcgtgcctggattccatggctgggccacggctgccctgctggttacattttgtttcggctgggtcctcatccccgcgctgacccttattatcctgaccatcctcaaatttattgctaatatcttccacacaagcaaccaggagaatagactgaagtccgtgcttcggaaaattaaggaagagtttgagaaaaccaaggggagcatggtgtgcgacgtctgtaagtatgaatgcgagacatacaaagaactgaaggcccatggagtgtcttgccctcagtcccaatgtccctattgcttcacgcactgtgagccgaccgaagccgcttttcaggcccattaccgcgtttgccaggtgacacacagattccgggatgacctcaaaaagaccgtcacacctcagaacttcacccccggctgttatcgcacgctgaatctgtttagatacaaaagccggtgctacatcttcaccatgtgggtgtgtctcctggttcttgagtctattctgtgggctgcctccgcgagcgaggtgcctctcaaccccgtctggaatgataacgcccacggggtgggatctgttcctatgcatacagacctggaactggattttagccttacctccagctctaagtatacatacagacgccggctcaccaatcccctggaggaaacgcaatccatcaacctgcacatcgagattgaggaacagacaatcggcgtggacgtccatgctctcgggcactggttcgatggcagactgaatcttaagaccagctttcactgctatggagcctgtacaaaatacgagtatccgtggcataccgctaagtgccactacgaacgcgactatcagtacgagacctcctggggctgtaaccctgccgattgccccggggtgggaacaggctgcacggcgtgtgggctgtacctcgaccagctgaaacccgtgggatctgcctataagattatcaccattcggtacagcagaaaagtctgcgttcaattcggcgaagagaatctgtgtaaggtgatcgacatgaacgattgctttgtgacacgccatgtcaaggtgtgtatcattgggaccgtttccaaattctctcagggcgacacacttctctttttcggacctctggagggcgggggactgatctttaagcactggtgcaccagcacgtgtcagttcggcgatccgggggacattatgtctccccgggataaaggatttctctgccctgagttccccggctccttcagaaagaaatgtaattttgctacaacccctctgtgcgagtatgacgggaacatggtgagcggctacaagaaagtcatggccaccatcgattccttccagagctttaacacatctaccatgcatttcacagacgaacgcattgagtggaaggatcccgacggaatgcttcgggatcacatcaatatcctggtgacgaaggacattgattttgacaacctcggcgaaaatccttgtaaaatcgggctgcaaacctccagcattgagggagcttggggctctggggttggattcacactgacctgccttatctccctcacagagtgccccacctttctgacgagcattaaggcctgtgacaaagccatctgctatggcgctgaatctgtgaccctgacaagagggcagaacaccgtcaaggtgtccggcaaaggaggccacagcgggtccacattcaagtgttgccatggagaggaatgtagccagattggcctccacgcggccgctccgcatctggataaggttaatgggatctctgagatcgaaaacaataaagtgtacgacgatggagcccctcaatgcggcgtcaagtgttggtttgtgaaaagcggcgagtggatttccgggatcttctctggaaactggattgtgcttatcgtcctgtgcgtttttctcctgttcagcctggtgcttctctccgtgctgtgtcccgtccgcaagcacaaaaagtcttga

SEQ ID NO: 13352 - RNA, 3408 nt, synthetic construct
  misc_feature 1..3408: note = derived and/or modified CDS sequence (opt5) from HTNV(LongquanAa-10-393)__JQ912859.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgaacttccgcccatgcctctggccgatacggcgcagatggtgcccgagagctcctgtaacatggacaatcatcaatctatgaacaccattacaaagtacacccaggttagctggcggggaaaagctgatcaggcccaggcctcccaaaattctttcgaagctgtgagcgccgaggtcgacctcaagggcacatgcgtgctgaaacacaagatgcttgaggaatcctatcgcagcagaaagtctatcacctgttacgatctgtcctgcaacagcacatattgtaaacctaccctctacatgattgttcccatccatgcttgcaatatgatgaagtcttgtctgatcgccctggggccttatcgggtgcaggtcgtgtacgagcgcacgtactgcatgaccggagtgctcattgaaggcaaatgttttgtcccggaccagtccgttgtgagcatcattaagcacgggatcttcgatattgcgtctgtgcatatcgtctgctttttcgtggccgttaaaggaaacacatataagctgtttgaacaggtgaagaaatccttccaaagcacctgtaatggcacagagaacaaggtccagggctactatatttgcatcgttgggggaaattccgctcccatctacgtgcctacccttgacgattttagatctatggaggccttcagcggcatttttcggagcccccacggggaggaccacgatctggctggagaagagatcgcctcctattctattgtgggccctgcgaacgccaaagtcccccattccgctagctctgacacgctcagcctgatcgcctactccgggattccgtcttatagctcccttagcatcctggcttcttccacagaagccaagcacgtgttcagccctggatttttcccccagctcaatcataccaaatgcgataagacagccatccctctgacctggaccggcatgattgacctgcccggctactacgaggctatccacccctgtacagtcttctgcgtgctctctgggcctggagcgtcctgtgaggcctttagcgaaggcgggattttcaacatcacgtccccgatgtgcctggtttctaaacagaatcgctttagacttaccgagcaacaggtgaacttcgtctgtcagcgggtggacatggatattatcgtttattgcaacggacaacgcaaggtgatcctgacaaagaccctcgtcattggccagtgtatctacacaattaccagcctgttttcccttctgcccggggtggctcactctatcgccgtggaactctgcgttcctggattccatggctgggccacggctgccctgctggtcacattttgtttcggcagagtgctcattcccgcgctgacccttatcattctgaccatcctcaaatttatcgctaatattttccacacaagcaaccaggagaatcggctgaagtccgtgcttcgcaaaatcaaggaagagtttgagaaaaccaaggggagcatggtctgcgacgtgtgtaagtatgaatgcgagacatacaaagaactgaaggcccatggagtttcttgccctcagtcccaatgtccctattgcttcacgcactgtgagccgaccgaagccgcttttcaggcccattacagagtgtgccaggtcacacaccggttccgcgatgacctcaaaaagaccgtgacacctcagaacttcacccccggctgttatagaacgctgaatctgtttcggtacaaaagcagatgctacattttcaccatgtgggtttgtctcctggtgcttgagtctatcctgtgggctgcctccgcgagcgaggtccctctcaaccccgtgtggaatgataacgcccacggggttggatctgtgcctatgcatacagacctggaactggattttagccttacctccagctctaagtatacataccgccggagactcaccaatcccctggaggaaacgcaatccattaacctgcacatcgagatcgaggaacagacaattggcgtcgacgtgcatgctctcgggcactggttcgatggccgcctgaatcttaagaccagctttcactgctatggagcctgtacaaaatacgagtatccgtggcataccgctaagtgccactacgaacgggactatcagtacgagacctcctggggctgtaaccctgccgattgccccggggtgggaacaggctgcacggcgtgtgggctgtacctcgaccagctgaaacccgtcggatctgcctataagatcattaccatcagatacagccgcaaagtttgcgtgcaattcggcgaagagaatctgtgtaaggtgattgacatgaacgattgctttgtcacacggcatgtgaaggtttgtatcatcgggaccgtgtccaaattctctcagggcgacacacttctctttttcggacctctggagggcgggggactgatttttaagcactggtgcaccagcacgtgtcagttcggcgatccgggggacatcatgtcccccagagataaaggatttctctgccctgagttccccggctctttccgcaagaaatgtaattttgctacaacccctctgtgcgagtatgacgggaacatggtcagcggctacaagaaagtgatggccaccattgattccttccagagctttaacacatctaccatgcatttcacagacgaacggatcgagtggaaggatcccgacggaatgcttagagatcacattaatatcctggttacgaaggacatcgattttgacaacctcggcgaaaatccttgtaaaattgggctgcaaacctccagcatcgagggagcttggggctctggggtgggattcacactgacctgccttatttccctcacagagtgccccacctttctgacgagcatcaaggcctgtgacaaagccatttgctatggcgctgaatctgtcaccctgacacgcgggcagaacaccgtgaaggtttccggcaaaggaggccacagcgggtccacattcaagtgttgccatggagaggaatgtagccagatcggcctccacgcggccgctccgcatctggataaggtgaatgggatttctgagatcgaaaacaataaagtctacgacgatggagcccctcaatgcggcgtgaagtgttggtttgtgaaaagcggcgagtggatctccgggattttctctggaaactggatcgtccttattgttctgtgcgtgtttctcctgttcagcctggtgcttctctccgtcctgtgtcccgtgcggaagcacaaaaagtcttga

SEQ ID NO: 13353 - RNA, 3408 nt, synthetic construct
  misc_feature 1..3408: note = derived and/or modified CDS sequence (opt5) from HTNV(LongquanAa-10-58)__JQ912861.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgaacttccgcccatgcctctggccgatacggcgcagatggtgcccgagagctcctgtaacatggacaatcatcaatctatgaacaccattacaaagtacacccaggttagctggcggggaaaagctgatcaggcccaggcctcccaaaattctttcgaagctgtgagcgccgaggtcgacctcaagggcacatgcgtgctgaaacacaagatgcttgaggaatcctatcgcagcagaaagtctatcacctgttacgatctgtcctgcaacagcacatattgtaaacctaccctctacatgattgttcccatccatgcttgcaatatgatgaagtcttgtctgatcgccctggggccttatcgggtgcaggtcgtgtacgagcgcacgtactgcatgaccggagtgctcattgaaggcaaatgttttgtcccggaccagtccgttgtgagcatcattaagcacgggatcttcgatattgcgtctgtgcatatcgtctgctttttcgtggccgttaaaggaaacacatataagctgtttgaacaggtgaagaaatccttccaaagcacctgtaatggcacagagaacaaggtccagggctactatatttgcatcgttgggggaaattccgctcccatctacgtgcctacccttgacgattttagatctatggaggccttcagcggcatttttcggagcccccacggggaggaccacgatctggctggagaagagatcgcctcctattctattgtgggccctgcgaacgccaaagtcccccattccgctagctctgacacgctcagcctgatcgcctactccgggattccgtcttatagctcccttagcatcctggcttcttccacagaagccaagcacgtgttcagccctggatttttcccccagctcaatcataccaaatgcgataagacagccatccctctgacctggaccggcatgattgacctgcccggctactacgaggctatccacccctgtacagtcttctgcgtgctctctgggcctggagcgtcctgtgaggcctttagcgaaggcgggattttcaacatcacgtccccgatgtgcctggtttctaaacagaatcgctttagacttaccgagcaacaggtgaacttcgtctgtcagcgggtggacatggatattatcgtttattgcaacggacaacgcaaggtgatcctgacaaagaccctcgtcattggccagtgtatctacacaattaccagcctgttttcccttctgcccggggtggctcactctatcgccgtggaactctgcgttcctggattccatggctgggccacggctgccctgctggtcacattttgtttcggctgggtgctcattcccgcgctgacccttatcattctgaccatcctcaaatttatcgctaatattttccacacaagcaaccaggagaatagactgaagtccgtgcttcggaaaatcaaggaagagtttgagaaaaccaaggggagcatggtctgcgacgtgtgtaagtatgaatgcgagacatacaaagaactgaaggcccatggagtttcttgccctcagtcccaatgtccctattgcttcacgcactgtgagccgaccgaagccgcttttcaggcccattaccgcgtgtgccaggtcacacacagattccgggatgacctcaaaaagaccgtgacacctcagaacttcacccccggctgttatcgcacgctgaatctgtttagatacaaaagccggtgctacattttcaccatgtgggtttgtctcctggtgcttgagtctatcctgtgggctgcctccgcgagcgaggtccctctcaaccccgtgtggaatgataacgcccacggggttggatctgtgcctatgcatacagacctggaactggattttagccttacctccagctctaagtatacatacagacgccggctcaccaatcccctggaggaaacgcaatccattaacctgcacatcgagatcgaggaacagacaattggcgtcgacgtgcatgctctcgggcactggttcgatggcagactgaatcttaagaccagctttcactgctatggagcctgtacaaaatacgagtatccgtggcataccgctaagtgccactacgaacgcgactatcagtacgagacctcctggggctgtaaccctgccgattgccccggggtgggaacaggctgcacggcgtgtgggctgtacctcgaccagctgaaacccgtcggatctgcctataagatcattaccatccggtacagcagaaaagtttgcgtgcaattcggcgaagagaatctgtgtaaggtgattgacatgaacgattgctttgtcacacgccatgtgaaggtttgtatcatcgggaccgtgtccaaattctctcagggcgacacacttctctttttcggacctctggagggcgggggactgatttttaagcactggtgcaccagcacgtgtcagttcggcgatccgggggacatcatgtctccccgggataaaggatttctctgccctgagttccccggctccttcagaaagaaatgtaattttgctacaacccctctgtgcgagtatgacgggaacatggtcagcggctacaagaaagtgatggccaccattgattccttccagagctttaacacatctaccatgcatttcacagacgaacgcatcgagtggaaggatcccgacggaatgcttcgggatcacattaatatcctggttacgaaggacatcgattttgacaacctcggcgaaaatccttgtaaaattgggctgcaaacctccagcatcgagggagcttggggctctggggtgggattcacactgacctgccttatttccctcacagagtgccccacctttctgacgagcatcaaggcctgtgacaaagccatttgctatggcgctgaatctgtcaccctgacaagagggcagaacaccgtgaaggtttccggcaaaggaggccacagcgggtccacattcaagtgttgccatggagaggaatgtagccagatcggcctccacgcggccgctccgcatctggataaggtgaatgggatttctgagatcgaaaacaataaagtctacgacgatggagcccctcaatgcggcgtgaagtgttggtttgtgaaaagcggcgagtggatctccgggattttctctggaaactggatcgtccttattgttctgtgcctctttctgctgttcagccttgtgctcctgtccgtgctgtgtcccgtccgcaagcacaaaaagtcttga

SEQ ID NO: 13354 - RNA, 3408 nt, synthetic construct
  misc_feature 1..3408: note = derived and/or modified CDS sequence (opt5) from HTNV(LongquanAa-10-74)__JQ912864.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgaacttccgcccatgcctctggccgatacggcgcagatggtgcccgagagctcctgtaacatggacaatcatcaatctatgaacaccattacaaagtacacccaggttagctggcggggaaaagctgatcaggcccaggcctcccaaaattctttcgaagctgtgagcgccgaggtcgacctcaagggcacatgcgtgctgaaacacaagatgcttgaggaatcctatcgcagcagaaagtctatcacctgttacgatctgtcctgcaacagcacatattgtaaacctaccctctacatgattgttcccatccatgcttgcaatatgatgaagtcttgtctgatcgccctggggccttatcgggtgcaggtcgtgtacgagcgcacgtactgcatgaccggagtgctcattgaaggcaaatgttttgtcccggaccagtccgttgtgagcatcattaagcacgggatcttcgatattgcgtctgtgcatatcgtctgctttttcgtggccgttaaaggaaacacatataagctgtttgaacaggtgaagaaatccttccaaagcacctgtaatggcacagagaacaaggtccagggctactatatttgcatcgttgggggaaattccgctcccatctacgtgcctacccttgacgattttagatctatggaggccttcagcggcatttttcggagcccccacggggaggaccacgatctggctggagaagagatcgccagctattctattgtgggccctgcgaacgccaaagtcccccattccgctagctctgacacgctcagcctgatcgcctactccgggattccgtcttatagctcccttagcatcctggcttcttccacagaagccaagcacgtgttcagccctggatttttcccccagctcaatcataccaaatgcgataagacagccatccctctgacctggaccggcatgattgacctgcccggctactacgaggctatccacccctgtacagtcttctgcgtgctctctgggcctggagcgtcctgtgaggcctttagcgaaggcgggattttcaacatcacgtccccgatgtgcctggtttctaaacagaatcgctttagacttaccgagcaacaggtgaacttcgtctgtcagcgggtggacatggatattatcgtttattgcaacggacaacgcaaggtgatcctgacaaagaccctcgtcattggccagtgtatctacacaattaccagcctgttttcccttctgcccggggtggctcactctatcgccgtggaactctgcgttcctggattccatggctgggccacggctgccctgctggtcacattttgtttcggctgggtgctcattcccgcgctgacccttatcattctgaccatcctcaaatttatcgctaatattttccacacaagcaaccaggagaatagactgaagtccgtgcttcggaaaatcaaggaagagtttgagaaaaccaaggggagcatggtctgcgacgtgtgtaagtatgaatgcgagacatacaaagaactgaaggcccatggagtttcttgccctcagtcccaatgtccctattgcttcacgcactgtgagccgaccgaagccgcttttcaggcccattaccgcgtgtgccaggtcacacacagattccgggatgacctcaaaaagaccgtgacacctcagaacttcacccccggctgttatcgcacgctgaatctgtttagatacaaaagccggtgctacattttcaccatgtgggtttgtctcctggtgcttgagtctatcctgtgggctgcctccgcgagcgaggtccctctcaaccccgtgtggaatgataacgcccacggggttggatctgtgcctatgcatacagacctggaactggattttagccttacctccagctctaagtatacatacagacgccggctcaccaatcccctggaggaaacgcaatccattaacctgcacatcgagatcgaggaacagacaattggcgtcgacgtgcatgctctcgggcactggttcgatggcagactgaatcttaagaccagctttcactgctatggagcctgtacaaaatacgagtatccgtggcataccgctaagtgccactacgaacgcgactatcagtacgagacctcctggggctgtaaccctgccgattgccccggggtgggaacaggctgcacggcgtgtgggctgtacctcgaccagctgaaacccgtcggatctgcctataagatcattaccatccggtacagcagaaaagtttgcgtgcaattcggcgaagagaatctgtgtaaggtgattgacatgaacgattgctttgtcacacgccatgtgaaggtttgtatcatcgggaccgtgtccaaattctctcagggcgacacacttctctttttcggacctctggagggcgggggactgatttttaagcactggtgcaccagcacgtgtcagttcggcgatccgggggacatcatgtctccccgggataaaggatttctctgccctgagttccccggctccttcagaaagaaatgtaattttgctacaacccctctgtgcgagtatgacgggaacatggtcagcggctacaagaaagtgatggccaccattgattccttccagagctttaacacatctaccatgcatttcacagacgaacgcatcgagtggaaggatcccgacggaatgcttcgggatcacattaatatcctggttacgaaggacatcgattttgacaacctcggcgaaaatccttgtaaaattgggctgcaaacctccagcatcgagggagcttggggctctggggtgggattcacactgacctgccttatttccctcacagagtgccccacctttctgacgagcatcaaggcctgtgacaaagccatttgctatggcgctgaatctgtcaccctgacaagagggcagaacaccgtgaaggtttccggcaaaggaggccacagcgggtccacattcgagtgttgccatggagaagagtgtagccagatcggcctccacgcggccgctccgcatctggataaggtgaatgggatttctgaaatcgagaacaataaggtctacgacgatggagcccctcaatgcggcgtgaaatgttggtttgtgaagtccggcgagtggatctccgggattttctctggaaactggatcgtccttattgttctgtgcgtgtttctcctgttcagcctggtgcttctctccgtcctgtgtcccgtgcgcaaacacaagaaatcttga

SEQ ID NO: 13355 - RNA, 3408 nt, synthetic construct
  misc_feature 1..3408: note = derived and/or modified CDS sequence (opt5) from HTNV(LongquanAa-10-98)__JQ912866.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgagcttccgcccatgcctctggccgatacggcgcagatggtgcccgagagctcctgtaacatggacaatcatcaatctatgaacaccattacaaagtacacccaggttagctggcggggaaaagctgatcaggcccaggcctcccaaaattctttcgaagctgtgagcgccgaggtcgacctcaagggcacatgcgtgctgaaacacaagatgcttgaggaatcctatcgcagcagaaagtctatcacctgttacgatctgtcctgcaacagcacatattgtaaacctaccctctacatgattgttcccatccatgcttgcaatatgatgaagtcttgtctgatcgccctggggccttatcgggtgcaggtcgtgtacgagcgcacgtactgcatgaccggagtgctcattgaaggcaaatgttttgtcccggaccagtccgttgtgagcatcattaagcacgggatcttcgatattgcgtctgtgcatatcgtctgctttttcgtggccgttaaaggaaacacatataagctgcttgaacaggtgaagaaatcctttcaaagcacctgtaatgacacagagaacaaggtccagggctactatatttgcatcgtgggcggaaattccgctcccatctacgttcctaccctggatgacttcagatctatggaggcctttagcgggattttccggagcccccacggcgaggatcacgacctcgctggggaagagatcgcctcctattctattgtgggacctgcgaacgccaaagtcccccattccgctagctctgatacgctgagccttatcgcctactccggcattccgtcttatagctccctgagcatcctcgcttcttccacagaagccaagcacgtgtttagccctgggttctttccccagctgaatcataccaaatgcgacaagacagccatccctctgacctggaccggaatgattgacctccccggctactacgaggctatccacccctgtacagtcttctgcgtgctgtctggccctggggcgtcctgtgaggccttcagcgaaggaggcatttttaacatcacgtccccgatgtgccttgtttctaaacagaatcgcttcagactgaccgagcaacaggtgaactttgtctgtcagcgggtggatatggacattatcgtttattgcaacgggcaacgcaaggtgatcctcacaaagaccctggtcattggacagtgtatctacacaattaccagccttttctccctgctccccggcgtggctcactctatcgccgtggaactgtgcgttcctgggtttcatggatgggccacggctgccctgctcgtcacattctgttttggctgggtgctgattcccgcgcttaccctgatcattctcaccatcctgaaattcatcgctaatatttttcacacaagcaaccaggagaatagacttaagtccgtgctgcggaaaatcaaggaagagttcgagaaaaccaagggcagcatggtctgcgatgtgtgtaagtatgaatgcgagacatacaaagaactcaaggcccatggggtttcttgccctcagtcccaatgtccctattgctttacgcactgtgagccgaccgaagccgctttccaggcccattaccgcgtgtgccaggtcacacacagatttcgggacgatctgaaaaagaccgtgacacctcagaacttcacccccggatgttatcgcacgctgaatctcttcagatacaaaagccggtgctacatttttaccatgtgggtttgtctgcttgtgctggagtctatcctctgggctgcctccgcgagcgaggtccctctgaaccccgtgtggaatgacaacgcccacggcgttgggtctgtgcctatgcatacagatctggaacttgacttcagcctcacctccagctctaagtatacatacagacgccggctgaccaatcccctggaggaaacgcaatccattaacctccacatcgagatcgaggaacagacaattggagtcgatgtgcatgctctgggccactggtttgacgggagacttaatctgaagaccagcttccactgctatggcgcctgtacaaaatacgagtatccgtggcataccgctaagtgccactacgaacgcgattatcagtacgagacctcctggggatgtaaccctgccgactgccccggcgtggggacaggatgcacggcgtgtggcctctacctggaccagctgaaacccgtcgggtctgcctataagatcattaccatccggtacagcagaaaagtttgcgtgcaatttggagaagagaatctttgtaaggtgattgatatgaacgactgcttcgtcacacgccatgtgaaggtttgtatcatcggcaccgtgtccaaattttctcagggggatacactcctgttctttggccctctggagggaggcgggctcattttcaagcactggtgcaccagcacgtgtcagtttggagacccgggcgatatcatgtctccccgggacaaagggttcctgtgccctgaatttcccggatccttcagaaagaaatgtaatttcgctacaacccctctttgcgagtatgatggcaacatggtcagcgggtacaagaaagtgatggccaccattgactcctttcagagcttcaacacatctaccatgcattttacagatgaacgcatcgagtggaaggaccccgatggcatgctgcgggaccacattaatatcctcgttacgaaggatatcgacttcgacaacctgggagaaaatccttgtaaaattggcctgcaaacctccagcatcgagggggcttggggatctggcgtggggtttacacttacctgcctcatttccctgacagagtgccccaccttcctgacgagcatcaaggcctgtgataaagccatttgctatggagctgaatctgtcaccctcacaagaggccagaacaccgtgaaggtttccgggaaaggcggacacagcggctccacatttaagtgttgccatggggaggaatgtagccagatcggactgcacgcggccgctccgcatcttgacaaggtgaatggcatttctgagatcgaaaacaataaagtctacgatgacggggcccctcaatgcggagtgaagtgttggttcgtgaaaagcggcgagtggatctccggcatcttttctgggaactggattgtcctgattgttctctgcgtgttcctgctgtttagccttgtgctcctgtccgtcctgtgtcccgtgcgcaagcacaaaaagtcttga

SEQ ID NO: 13356 - RNA, 3408 nt, synthetic construct
  misc_feature 1..3408: note = derived and/or modified CDS sequence (opt5) from HTNV(LongquanAa-11-452)__KC344264.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgagcttccgcccatgcctctggccgatacggcgcagatggtgcccgagagctcctgtaacatggacaatcatcaatctattaacaccatcacaaagtacacccaggttagctggcggggaaaagctgatcaggcccaggcctcccaaaattctttcgaagctgtgagcgccgaggtcgacctcaagggcacatgcgtgctgaaacacaagatgcttgaggaatcctatcgcagcagaaagtctattacctgttacgatctgtcctgcaacagcacatattgtaaacctaccctctacatgatcgttcccatccatgcttgcaatatgatgaagtcttgtctgattgccctggggccttatcgggtgcaggtcgtgtacgagcgcacgtactgcatgaccggagtgctcatcgaaggcaaatgttttgtcccggaccagtccgttgtgagcattatcaagcacgggattttcgatatcgcgtctgtgcatattgtctgctttttcgtggccgttaaaggaaacacatataagctgcttgaacaggtgaagaaatcctttcaaagcacctgtaatgacacagagaacaaggtccagggctactatatctgcatcgtgggcggaaattccgctcccatttacgttcctaccctggatgacttcagatctatggaggcctttagcgggatcttccggagcccccacggcgaggatcacgacctcgctggggaagagattgcctcctattctatcattggacctgcgaacgccaaagtgccccattccgctagctctgatacgctgagccttatcgcctactccggcatcccgtcttatagctccctgagcattctcgcttcttccacagaagccaagcacgtctttagccctgggttctttccccagctgaatcataccaaatgcgacaagacagccatccctctgacctggaccggaatgattgacctccccggctactacgaggctatccacccctgtacagtgttctgcgtcctgtctggccctggggcgtcctgtgaggccttcagcgaaggaggcatttttaacatcacgtccccgatgtgccttgtgtctaaacagaatcgcttcagactgaccgagcaacaggttaactttgtgtgtcagcgggtcgatatggacatcattgtgtattgcaacgggcaacgcaaggttatcctcacaaagaccctggtgattggacagtgtatctacacaattaccagccttttctccctgctccccggcgtcgctcactctatcgccgtggaactgtgcgtgcctgggtttcatggatgggccacggctgccctgctcgttacattctgttttggctgggtcctgattcccgcgcttaccctgatcatcctcaccattctgaaattcatcgctaatatttttcacacaagcaaccaggagaatagacttaagtccgtgctgcggaaaatcaaggaagagttcgagaaaaccaagggcagcatggtgtgcgatgtctgtaagtatgaatgcgagacatacaaagaactcaaggcccatggggtgtcttgccctcagtcccaatgtccctattgctttacgcactgtgagccgaccgaagccgctttccaggcccattaccgcgtttgccaggtgacacacagatttcgggacgatctgaaaaagaccgtcacacctcagaacttcacccccggatgttatcgcacgctgaatctcttcagatacaaaagccggtgctacatttttaccatgtgggtgtgtctgcttgttctggagtctatcctctgggctgcctccgcgagcgaggtgcctctgaaccccgtctggaatgacaacgcccacggcgtggggtctgttcctatgcatacagatctggaacttgacttcagcctcacctccagctctaagtatacatacagacgccggctgaccaatcccctggaggaaacgcaatccatcaacctccacattgagatcgaggaacagacaattggagtggatgtccatgctctgggccactggtttgacgggagacttaatctgaagaccagcttccactgctatggcgcctgtacaaaatacgagtatccgtggcataccgctaagtgccactacgaacgcgattatcagtacgagacctcctggggatgtaaccctgccgactgccccggcgtggggacaggatgcacggcgtgtggcctctacctggaccagctgaaacccgtggggtctgcctataagatcattaccatccggtacagcagaaaagtctgcgttcaatttggagaagagaatctttgtaaggtgatcgatatgaacgactgcttcgtgacacgccatgtcaaggtgtgtattatcggcaccgtttccaaattttctcagggggatacactcctgttctttggccctctggagggaggcgggctcattttcaagcactggtgcaccagcacgtgtcagtttggagacccgggcgatatcatgtctccccgggacaaagggttcctgtgccctgaatttcccggatccttcagaaagaaatgtaatttcgctacaacccctctttgcgagtatgatggcaacatggtgagcgggtacaagaaagtcatggccaccattgactcctttcagagcttcaacacatctaccatgcattttacagatgaacgcatcgagtggaaggaccccgatggcatgctgcgggaccacatcaatattctcgtgacgaaggatatcgacttcgacaacctgggagaaaatccttgtaaaattggcctgcaaacctccagcatcgagggggcttggggatctggcgttgggtttacacttacctgcctcatttccctgacagagtgccccaccttcctgacgagcatcaaggcctgtgataaagccatttgctatggagctgaatctgtgaccctcacaagaggccagaacaccgtcaaggtgtccgggaaaggcggacacagcggctccacatttaagtgttgccatggggaggaatgtagccagatcggactgcacgcggccgctccgcatcttgacaaggttaatggcatctctgagattgaaaacaataaagtgtacgatgacggggcccctcaatgcggagtcaagtgttggttcgtgaaaagcggcgagtggatctccggcatcttttctgggaactggattgtgctgattgtcctctgcgttttcctgctgtttagccttgtgctcctgtccgtgctgtgtcccgtccgcaagcacaaaaagtcttga

SEQ ID NO: 13357 - RNA, 3408 nt, synthetic construct
  misc_feature 1..3408: note = derived and/or modified CDS sequence (opt5) from HTNV(LongquanAa-11-473)__KC344263.1__GP
  source 1..3408: mol_type = other RNA
atgggcatctggaagtggctggtgatggccagcctcgtctggcccgctttcaccctgagaaacgtttacgacatgaaaattgagtgccctcacacagtgtcctttggggaaaattctgtgatcggatatgtcgagcttccgcccatgcctctggccgatacggcgcagatggtgcccgaaagctcctgtaacatggacaatcatcaatctatgaacaccattacaaagtacacccaggttagctggcggggcaaagctgatcaggcccaggcctcccaaaattctttcgaggctgtgagcgccgaagtcgacctcaaggggatctgcgtgctgaaacacaagatgcttgaggagtcctatcgcagcagaaagtctattacatgttacgatctgtcctgcaacagcacctattgtaaacctacactctacatgatcgttcccatccatgcttgcaatatgatgaagtcttgtctgattgccctgggaccttatcgggtgcaggtcgtgtacgaacgcacctactgcatgacgggcgtgctcctggaggggaaatgttttgtcccggaccagtccgttgtgagcatcattaagcacggaatcttcgatattgcgtctgtgcatatcgtctgctttttcgtggccgttaaaggcaacacctataaactttttgaacaggtgaagaagtccttccaaagcacatgtaatgacaccgagaacaaggtccagggctactatatttgcatcgttgggggaaattccgctcccatctacgtgcctacactggatgactttagatctatggaggccttcagcggcatttttcggagcccccacggggaagatcacgacctcgctggagaggaaatcgcctcctattctattgtgggccctgcgaacgccaaagtcccccattccgctagctctgataccctgagccttatcgcctactccgggattccgtcttatagctccctgagcatcctcgctaattctacggaggccaagcacgtgttctcccctggatttttcccccagctgaaccatacaaaatgcgacaagaccgccatccctctgatttggacaggcatgatcgacctccccggctactacgaagctattcacccctgtaccgtcttctgcgtgctgagcgggcctggagcgtcttgtgaggccttttccgagggcgggatcttcaatattaccagcccgatgtgccttgtttccaaacagaaccgctttagactgacagaacaacagatcaacttcgtgtgtcagcgggtcgatgtggacatcattgtttattgcaatggacaacgcaaggtgatcctcacgaagaccctggtcattggccagtgtatctacacaattacctctctttttagcctgctccccggggtggctcactccatcgccgtggagctgtgcgttcctggattccatggctgggccacagctgccctgctcgtcaccttttgtttcggctgggtgctgattcccgcgcttacgctgatcatcctcacaattctgaaatttatcgctaacattttccacacctctaatcaggaaaacagacttaagagcgtgctgcggaaaatcaaggaggaatttgagaaaaccaaggggtccatggtctgcgatgtgtgtaagtatgagtgcgaaacatacaaagagctcaaggcccatggagttagctgccctcagtctcaatgtccctattgcttcacccactgtgaaccgacagaggccgcttttcaggcccattaccgcgtgtgccaggtcacgcacagattccgggacgatctgaaaaagaccgtgacacctcagaatttcacccccggctgttatcgcacactgaacctctttagatacaaatcccggtgctacattttcaccatgtgggtttgtctgcttgtgctggaaagcatcctctgggctgcctctgcgtccgaggtccctctgaatcccgtgtggaacgacaatgcccacggggttggaagcgtgcctatgcatacggatctggagcttgacttttctctcaccagctccagcaagtatacatacagacgccggctgaccaaccccctggaagagacacaatctatcaatctccacattgaaatcgaggagcagaccattggcgtcgatgtgcatgctctggggcactggttcgacggcagacttaacctgaagacgtcctttcactgctatggagcctgtacaaaatacgaatatccgtggcataccgctaagtgccactacgagcgcgattatcagtacgaaacaagctggggctgtaatcctgccgactgccccggggtgggaaccggctgcaccgcgtgtgggctctacctggaccagctgaaacccgtcggatccgcctataagatcattacaatccggtactctagaaaagtttgcgtgcaattcggcgaggaaaacctttgtaaggtgatcgatatgaatgactgctttgtcacgcgccatgtgaaggtttgtattatcgggaccgtgagcaaattctcccagggcgatacactcctgtttttcggacctctggagggcgggggactcatttttaagcactggtgcacctctacatgtcagttcggcgacccgggggatatcatgagcccccgggacaaaggatttctgtgccctgagttccccggctccttcagaaagaaatgtaactttgctaccacgcctctttgcgaatatgatgggaacatggtctctggctacaagaaagtgatggccacaattgacagcttccagtcctttaataccagcaccatgcatttcacagatgagcgcatcgaatggaaggaccccgatggaatgctgcgggaccacatcaacattctcgttaccaaggatatcgactttgacaatctgggcgagaacccttgtaaaattgggctgcaaacatcttccatcgaaggagcttggggcagcggggtgggattcacgcttacctgcctcatttctctgacagagtgccccacctttctgacatccatcaaggcctgtgataaagccatttgctatggcgctgagagcgtcaccctcacgagagggcagaataccgtgaaggtttctggcaaaggaggccactccgggagcacattcaagtgttgccatggagaagagtgttcccagatcggcctgcacgcggccgctccgcatcttgacaaggtgaacgggatcagcgaaattgagaataacaaagtctacgatgacggagcccctcaatgcggcgtgaagtgttggtttgtgaaatctggcgaatggatcagcgggattttctccggaaattggatcgtcctgattgttctctgcgtgtttctgctgttctctcttgtgctcctgagcgtcctgtgtcccgtgcgcaagcacaaaaagtcctga

SEQ ID NO: 13358 - RNA, 3408 nt, synthetic construct
  misc_feature 1..3408: note = derived and/or modified CDS sequence (opt5) from HTNV(LongquanAa-11-642)__KC344262.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgaacttccgcccatgcctctggccgatacggcgcagatggtgcccgagagctcctgtaacatggacaatcatcaatctatgaacaccattacaaagtacacccaggttagctggcggggaaaagctgatcaggcccaggcctcccaaaattctttcgaagctgtgagcgccgaggtcgacctcaagggcacatgcgtgctgaaacacaagatgcttgaggaatcctatcgcagcagaaagtctatcacctgttacgatctgtcctgcaacagcacatattgtaaacctaccctctacatgattgttcccatccatgcttgcaatatgatgaagtcttgtctgatcgccctggggccttatcgggtgcaggtcgtgtacgagcgcacgtactgcatgaccggagtgctcctggaaggcaaatgttttgtcccggaccagtccgttgtgagcattatcaagcacgggattttcgatatcgcgtctgtgcatattgtctgctttttcgtggccgttaaaggaaacacatataaactttttgaacaggtgaagaagtccttccaaagcacctgtaatgacacagagaacaaggtccagggctactatatctgcattgtgggcggaaattccgctcccatctacgttcctaccctggatgactttagatctatggaggccttcagcgggatctttcggagcccccacggcgaggatcacgacctcgctggggaagagattgccagctattctatcgtgggacctgcgaacgccaaagtcccccattccgctagctctgatacgctgagccttattgcctactccggcatcccgtcttatagctccctgagcattctcgcttcttccacagaagccaagcacgtgttcagccctgggtttttcccccagctgaatcataccaaatgcgacaagacagccatccctctgatctggaccggaatgattgacctccccggctactacgaggctatccacccctgtaccgtcttctgcgtgctgtctggccctggggcgtcctgtgaggcctttagcgaaggaggcattttcaacatcacatccccgatgtgccttgtttctaaacagaatcgctttagactgacggagcaacaggtgaacttcgtctgtcagcgggtggatgttgacattatcgtgtattgcaacgggcaacgcaaggtcatcctcaccaagacactggtgattggacagtgtatctacaccattacaagcctgttttcccttctccccggcgtggctcactctatcgccgttgaactgtgcgtccctgggttccatggatgggccaccgctgccctgctcgtgacgttttgtttcggctgggtgctgattcccgcgcttacactgatcattctcaccatcctgaaatttatcgctaatattttccacaccagcaaccaggagaatagacttaagtccgtcctgcggaaaatcaaggaagagtttgagaaaacaaagggcagcatggtgtgcgatgtttgtaagtatgaatgcgagacctacaaagaactcaaggcccatggggtgtcttgccctcagtcccaatgtccctattgcttcacacactgtgagccgacggaagccgcttttcaggcccattaccgcgtctgccaggtgacccacagattccgggacgatctgaaaaagacagttacccctcagaacttcacacccggatgttatcgcaccctgaatctctttagatacaaaagccggtgctacattttcacgatgtgggtgtgtctgcttgtcctggagtctatcctctgggctgcctccgcgagcgaggtgcctctgaaccccgtttggaatgacaacgcccacggcgtggggtctgtccctatgcataccgatctggaacttgactttagcctcacatccagctctaagtatacctacagacgccggctgacaaatcccctggaggaaacccaatccattaacctccacatcgagatcgaggaacagacgattggagtggatgtgcatgctctgggccactggttcgacgggagacttaatctgaagacatcctttcactgctatggcgcctgtaccaaatacgagtatccgtggcatacagctaagtgccactacgaacgcgattatcagtacgagacctcctggggatgtaaccctgccgactgccccggcgtcgggaccggatgcacagcgtgtggcctctacctggaccagctgaaacccgttgggtctgcctataagatcattacgatccggtacagcagaaaagtgtgcgtgcaattcggagaagagaatctttgtaaggtcattgatatgaacgactgctttgtgacccgccatgttaaggtgtgtatcatcggcacagtctccaaattctctcagggggataccctcctgtttttcggccctctggagggaggcgggctcatttttaagcactggtgcacaagcacctgtcagttcggagacccgggcgatatcatgtctccccgggacaaagggtttctgtgccctgagttccccggatccttcagaaagaaatgtaattttgctacgacacctctttgcgagtatgatggcaacatggtgagcgggtacaagaaagttatggccaccattgactccttccagagctttaacacctctacaatgcatttcaccgatgaacgcatcgagtggaaggaccccgatggcatgctgcgggaccacattaatatcctcgtgacaaaggatatcgactttgacaacctgggagaaaatccttgtaaaattggcctgcaaacgtccagcatcgagggggcttggggatctggcgtcgggttcacccttacatgcctcatttccctgaccgagtgccccacatttctgaccagcatcaaggcctgtgataaagccatttgctatggagctgaatctgtgacgctcaccagaggccagaacacagttaaggtgtccgggaaaggcggacacagcggctccaccttcaagtgttgccatggggaggaatgtagccagatcggactgcacgcggccgctccgcatcttgacaaggtcaatggcatttctgagatcgaaaacaataaagtgtacgatgacggggcccctcaatgcggagtgaagtgttggtttgtcaaaagcggcgagtggatctccggcattttctctgggaactggatcgttctgattgtgctctgcgtgtttctgctgttcagccttgtcctcctgtccgtgctgtgtcccgttcgcaagcacaaaaagtcttga

SEQ ID NO: 13359 - RNA, 3408 nt, synthetic construct
  misc_feature 1..3408: note = derived and/or modified CDS sequence (opt5) from HTNV(LongquanAa-11-774)__KC344257.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgaacttccgcccatgcctctggccgatacggcgcagatggtgcccgagagctcctgtaacatggacaatcatcaatctatgaacaccattacaaagtacacccaggttagctggcggggaaaagctgatcaggcccaggcctcccaaaattctttcgaagctgtgagcgccgaggtcgacctcaagggcacatgcgtgctgaaacacaagatgcttgaggaatcctatcgcagcagaaagtctatcacctgttacgatctgtcctgcaacagcacatattgtaaacctaccctctacatgattgttcccatccatgcttgcaatatgatgaagtcttgtctgatcgccctggggccttatcgggtgcaggtcgtgtacgagcgcacgtactgcatgaccggagtgctcattgaaggcaaatgttttgtcccggaccagtccgttgtgagcatcattaagcacgggatcttcgatattgcgtctgtgcatatcgtctgctttttcgtggccgttaaaggaaacacatataagctgtttgaacaggtgaagaaatccttccaaagcacctgtaatggcacagagaacaaggtccagggctactatatttgcatcgttgggggaaattccgctcccatctacgtgcctacccttgacgattttagatctatggaggccttcagcggcatttttcggagcccccacggggaggaccacgatctggctggagaagagatcgccagctattctattgtgggccctgcgaacgccaaagtcccccattccgctagctctgacacgctcagcctgatcgcctactccgggattccgtcttatagctcccttagcatcctggcttcttccacagaagccaagcacgtgttcagccctggatttttcccccagctcaatcataccaaatgcgataagacagccatccctctgacctggaccggcatgattgacctgcccggctactacgaggctatccacccctgtacagtcttctgcgtgctctctgggcctggagcgtcctgtgaggcctttagcgaaggcgggattttcaacatcacgtccccgatgtgcctggtttctaaacagaatcgctttagacttaccgagcaacaggtgaacttcgtctgtcagcgggtggacatggatattatcgtttattgcaacggacaacgcaaggtgatcctgacaaagaccctcgtcattggccagtgtatctacacaattaccagcctgttttcccttctgcccggggtggctcactctatcgccgtggaactctgcgttcctggattccatggctgggccacggctgccctgctggtcacattttgtttcggctgggtgctcattcccgcgctgacccttatcattctgaccatcctcaaatttatcgctaatattttccacacaagcaaccaggagaatagactgaagtccgtgcttcggaaaatcaaggaagagtttgagaaaaccaaggggagcatggtctgcgacgtgtgtaagtatgaatgcgagacatacaaagaactgaaggcccatggagtttcttgccctcagtcccaatgtccctattgcttcacgcactgtgagccgaccgaagccgcttttcaggcccattaccgcgtgtgccaggtcacacacagattccgggatgacctcaaaaagaccgtgacacctcagaacttcacccccggctgttatcgcacgctgaatctgtttagatacaaaagccggtgctacattttcaccatgtgggtttgtctcctggtgcttgagtctatcctgtgggctgcctccgcgagcgaggtccctctcaaccccgtgtggaatgataacgcccacggggttggatctgtgcctatgcatacagacctggaactggattttagccttacctccagctctaagtatacatacagacgccggctcaccaatcccctggaggaaacgcaatccattaacctgcacatcgagatcgaggaacagacaattggcgtcgacgtgcatgctctcgggcactggttcgatggcagactgaatcttaagaccagctttcactgctatggagcctgtacaaaatacgagtatccgtggcataccgctaagtgccactacgaacgcgactatcagtacgagacctcctggggctgtaaccctgccgattgccccggggtgggaacaggctgcacggcgtgtgggctgtacctcgaccagctgaaacccgtcggatctgcctataagatcattaccatccggtacagcagaaaagtttgcgtgcaattcggcgaagagaatctgtgtaaggtgattgacatgaacgattgctttgtcacacgccatgtgaaggtttgtatcatcgggaccgtgtccaaattctctcagggcgacacacttctctttttcggacctctggagggcgggggactgatttttaagcactggtgcaccagcacgtgtcagttcggcgatccgggggacatcatgtctccccgggataaaggatttctctgccctgagttccccggctccttcagaaagaaatgtaattttgctacaacccctctgtgcgagtatgacgggaacatggtcagcggctacaagaaagtgatggccaccattgattccttccagagctttaacacatctaccatgcatttcacagacgaacgcatcgagtggaaggatcccgacggaatgcttcgggatcacattaatatcctggttacgaaggacatcgattttgacaacctcggcgaaaatccttgtaaaattgggctgcaaacctccagcatcgagggagcttggggctctggggtgggattcacactgacctgccttatttccctcacagagtgccccacctttctgacgagcatcaaggcctgtgacaaagccatttgctatggcgctgaatctgtcaccctgacaagagggcagaacaccgtgaaggtttccggcaaaggaggccacagcgggtccacattcaagtgttgccatggagagaagtgtagccagatcggcctccacgcggccgctccgcatctggataaagtgaatgggatttctgaaatcgagaacaataaggtctacgacgatggagcccctcaatgcggcgtgaaatgttggtttgtgaagtccggcgaatggatctccgggattttctctggaaactggatcgtccttattgttctgtgcgtgtttctcctgttcagcctggtgcttctctccgtcctgtgtcccgtgcgcaaacacaagaagtcttga

SEQ ID NO: 13360 - RNA, 3408 nt, synthetic construct
  misc_feature 1..3408: note = derived and/or modified CDS sequence (opt5) from HTNV(LongquanMf-09-8)__JQ912875.1__GP
  source 1..3408: mol_type = other RNA
atggagatctggaagtggctggtgatggccagcctcgtctggcccgctttcaccctgagaaacgtttacgacatgaaaattgaatgccctcacacagtgtcctttggcgaaaattctgtgatcgggtatgtcgaacttccgcccatgcctctggccgatacggcgcagatggtgcccgagagctcctgtaacatggacaatcatcaatctatgaacaccattacaaagtacacccaggttagctggcggggaaaagctgatcaggcccaggcctcccaaaattctttcgaagctgtgagcgccgaggtcgacctcaagggcacatgcgtgctgaaacacaagatgcttgaggaatcctatcgcagcagaaagtctatcacctgttacgatctgtcctgcaacagcacatattgtaaacctaccctctacatgattgttcccatccatgcttgcaatatgatgaagtcttgtctgatcgccctggggccttatcgggtgcaggtcgtgtacgagcgcacgtactgcatgaccggagtgctcattgaaggcaaatgttttgtcccggaccagtccgttgtgagcatcattaagcacgggatcttcgatattgcgtctgtgcatatcgtctgctttttcgtggccgttaaaggaaacacatataagctgtttgaacaggtgaagaaatccttccaaagcacctgtaatggcacagagaacaaggtccagggctactatatttgcatcgttgggggaaattccgctcccatctacgtgcctacccttgacgattttagatctatggaggccttcagcggcatttttcggagcccccacggggaggaccacgatctggctggagaagagatcgcctcctattctattgtgggccctgcgaacgccaaagtcccccattccgctagctctgacacgctcagcctgatcgcctactccgggattccgtcttatagctcccttagcatcctggcttcttccacagaagccaagcacgtgttcagccctggatttttcccccagctcaatcataccaaatgcgataagacagccatccctctgacctggaccggcatgattgacctgcccggctactacgaggctatccacccctgtacagtcttctgcgtgctctctgggcctggagcgtcctgtgaggcctttagcgaaggcgggattttcaacatcacgtccccgatgtgcctggtttctaaacagaatcgctttagacttaccgagcaacaggtgaacttcgtctgtcagcgggtggacatggatattatcgtttattgcaacggacaacgcaaggtgatcctgacaaagaccctcgtcattggccagtgtatctacacaattaccagcctgttttcccttctgcccggggtggctcactctatcgccgtggaactctgcgttcctggattccatggctgggccacggctgccctgctggtcacattttgtttcggctgggtgctcattcccgcgctgacccttatcattctgaccatcctcaaatttatcgctaatattttccacacaagcaaccaggagaatagactgaagtccgtgcttcggaaaatcaaggaagagtttgagaaaaccaaggggagcatggtctgcgacgtgtgtaagtatgaatgcgagacatacaaagaactgaaggcccatggagtttcttgccctcagtcccaatgtccctattgcttcacgcactgtgagccgaccgaagccgcttttcaggcccattaccgcgtgtgccaggtcacacacagattccgggatgacctcaaaaagaccgtgacacctcagaacttcacccccggctgttatcgcacgctgaatctgtttagatacaaaagccggtgctacattttcaccatgtgggtttgtctcctggtgcttgagtctatcctgtgggctgcctccgcgagcgaggtccctctcaaccccgtgtggaatgataacgcccacggggttggatctgtgcctatgcatacagacctggaactggattttagccttacctccagctctaagtatacatacagacgccggctcaccaatcccctggaggaaacgcaatccattaacctgcacatcgagatcgaggaacagacaattggcgtcgacgtgcatgctctcgggcactggttcgatggcagactgaatcttaagaccagctttcactgctatggagcctgtacaaaatacgagtatccgtggcataccgctaagtgccactacgaacgcgactatcagtacgagacctcctggggctgtaaccctgccgattgccccggggtgggaacaggctgcacggcgtgtgggctgtacctcgaccagctgaaacccgtcggatctgcctataagatcattaccatccggtacagcagaaaagtttgcgtgcaattcggcgaagagaatctgtgtaaggtgattgacatgaacgattgctttgtcacacgccatgtgaaggtttgtatcatcgggaccgtgtccaaattctctcagggcgacacacttctctttttcggacctctggagggcgggggactgatttttaagcactggtgcaccagcacgtgtcagttcggcgatccgggggacatcatgtctccccgggataaaggatttctctgccctgagttccccggctccttcagaaagaaatgtaattttgctacaacccctctgtgcgagtatgacgggaacatggtcagcggctacaagaaagtgatggccaccattgattccttccagagctttaacacatctaccatgcatttcacagacgaacgcatcgagtggaaggatcccgacggaatgcttcgggatcacattaatatcctggttaacaaggacatcgattttgacaatctcggcgaaaacccttgtaaaattgggctgcaaacgtccagcatcgagggagcttggggctctggggtgggattcaccctgacatgccttatttccctcaccgagtgccccacatttctgaccagcatcaaggcctgtgacaaagccatttgctatggcgctgaatctgtcacgctgaccagagggcagaatacagtgaaggtttccggcaaaggaggccacagcgggtccaccttcaagtgttgccatggagaggaatgtagccagatcggcctccacgcggccgctccgcatctggataaggtgaacgggatttctgagatcgaaaataacaaagtctacgacgatggagcccctcaatgcggcgtgaagtgttggtttgtgaaaagcggcgagtggatctccgggattttctctggaaattggatcgtccttattgttctgtgcgtgtttctcctgttcagcctggtgcttctctccgtcctgtgtcccgtgcgcaagcacaaaaagtcttga

SEQ ID NO: 13361 - RNA, 3408 nt, synthetic construct
  misc_feature 1..3408: note = derived and/or modified CDS sequence (opt5) from HTNV(ROKA14-11)__KU207203.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacactggatgacttcagaagcatggaggcttttaccggcatcttccggtctccccacggggaggatcacgacctcgccggagaagagacagcgacctattccattgtgggccctgccaatgctaaagtcccccatagcgcctctagcgataccctgtcccttatcgctttttctgggattccgagctactccagcctgtctatcctcacatccagcacggaagccaagcacgtgttctctcctggactgtttcccaaactgaaccataccaattgcgacaagggcgcgatccctctcatgtggacaggcatgattgacctgcccgggtattacgaggccatccacccctgtaccgttttctgcgtgctttccggacctggcgctagctgtgaggccttctccgaagggggaatttttaacatcacatctccgatgtgcctggtcagcaaacagaatcgcttcagactcaccgagcaacaggtgaactttgtttgtcaacgggtggatgtcgacattgtggtgtactgcaacggccagcgcaaggttatcctgacgaagacacttgtcatcgggcagtgtatttataccatcacctccctgttctctctcctgcccggagtggctcacagcattgccgtggaactgtgcgtccctggctttcatggctgggccacagctgcgctcctggtgaccttctgttttgggtgggttcttatccccgccattacattcatcattctgacgatcctcaaatttatcgctaatattttccacacctccaaccaagagaatagacttaagagcgtgctgcggaaaatcaaggaagagtttgagaaaacaaagggatctatggtctgcgatgtgtgtaagtacgaatgcgagacctataaagaactgaaggcccatggcgtttcctgccctcagagccagtgtccctactgcttcacacactgtgagccgaccgaagccgcttttcaggcccattataaagtgtgccaagtcacgcaccgcttcagagacgatctcaagaaaaccgtgacacctcagaacttcacccccgggtgttaccggacactgaatctgtttcgctataagtctagatgctacattttcaccatgtggatctttctcctggttcttgagtccattctgtgggcggctagcgcctctgagacgcctctcacacccgtgtggaacgacaatgcccacggagtcggcagcgtgcctatgcataccgatctggaactggacttctcccttacatcctcttccaagtacacctatcggagaaaactcaccaaccccctggaggaagctcagagcatcgatctgcacatcgagattgaggaacagacaatcggggtggacgtccatgccctcggccactggtttgatggacgcctgaatcttaagacgtccttccactgttacggcgcttgcaccaaatatgagtacccgtggcatacagccaagtgtcactatgaacgggactaccaatatgagacctcttgggggtgcaaccctagcgactgtcccggagttggcacagggtgcaccgcgtgcggactgtacctcgatagactgaaacccgtgggctccgcctacaagattatcacgattcgctattctcggagagtgtgtgtccagtttggggaagagaatctgtgcaagatcatcgacatgaacgattgtttcgtgagccgccatgttaaagtgtgcattatcggcacagtctccaagttttctcagggagacacccttctcttctttggccctctggaagggggaggcctgattttcaaacactggtgtaccagcacatgccagtttggggatccgggagacatcatgtcccccagagataagggcttcctctgtcctgagttccccgggagctttcggaaaaagtgcaatttcgctaccacacctatttgtgaatacgacggcaacatggtgtctggatataaaaaggttatggccacgatcgattcctttcagagcttcaatacctctacaatgcattttaccgacgaacgcatcgagtggaaggatcccgacggcatgctgcgggatcacattaacatccttgtgacaaaagacattgacttcgataacctgggggaaaatccttgcaagatcggactccagacctccagcattgagggcgcttgggggtctggagtcggctttacgtccacctgtctggtgagcctgacagagtgccccaccttccttacatccatcaaagcctgcgacaaggcgatttgttacggggccgaaagcgttaccctcacaagaggccagaacaccgtgaaagtctctggaaagggcgggcacagcggatccacgtttaagtgctgtcatggcgaggattgctctcagatcgggctgcacgctgccgctccgcatctggacaaagtgaatggaatcagcgaaatggagaactccaaggtgtatgatgacggcgcccctcaatgtggcattaaatgctggttcgtcaagtctggggaatggatcagcggaatttttagcggcaattggatcgttctcattgtgctgtgtgtgttccttctgttctctctcgtcctgctgagcatcctttgccccgtgcgcaaacacaagaagtcctga

SEQ ID NO: 13362 - RNA, 3408 nt, synthetic construct
  misc_feature 1..3408: note = derived and/or modified CDS sequence (opt5) from HTNV(US8A15-1)__KU207205.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacactggatgacttcagaagcatggaggcttttaccggcatcttccggtctccccacggggaggatcacgacctcgccggagaagagacagcgacctattccattgtgggccctgccaatgctaaagtcccccatagcgcctctagcgataccctgtcccttatcgctttttctgggattccgagctactccagcctgtctatcctcacatccagcacggaagccaagcacgtgttctctcctggactgtttcccaaactgaaccataccaattgcgacaagggcgcgatccctctcatgtggacaggcatgattgacctgcccgggtattacgaggccatccacccctgtaccgttttctgcgtgctttccggacctggcgctagctgtgaggccttctccgaagggggaatttttaacatcacatctccgatgtgcctggtcagcaaacagaatcgcttcagactcaccgagcaacaggtgaactttgtttgtcaacgggtggatgtcgacattgtggtgtactgcaacggccagcgcaaggttatcctgacgaagacacttgtcatcgggcagtgtatttataccatcacctccctgttctctctcctgcccggagtggctcacagcattgccgtggaactgtgcgtccctggctttcatggctgggccacagctgcgctcctggtgaccttctgttttgggtgggttcttatccccgccattacattcatcattctgacgatcctcaaatttatcgctaatattttccacacctccaaccaagagaatagacttaagagcgtgctgcggaaaatcaaggaagagtttgagaaaacaaagggatctatggtctgcgatgtgtgtaagtacgaatgcgagacctataaagaactgaaggcccatggcgtttcctgccctcagagccagtgtccctactgcttcacacactgtgagccgaccgaagccgcttttcaggcccattataaagtgtgccaagtcacgcaccgcttcagagacgatctcaagaaaaccgtgacacctcagaacttcacccccgggtgttaccggacactgaatctgtttcgctataagtctagatgctacattttcaccatgtggatctttctcctggttcttgagtccattctgtgggcggctagcgcctctgagacgcctctcacacccgtgtggaacgacaatgcccacggagtcggcagcgtgcctatgcataccgatctggaactggacttctcccttacatcctcttccaagtacacctatcggagaaaactcaccaaccccctggaggaagctcagagcatcgatctgcacatcgagattgaggaacagacaatcggggtggacgtccatgccctcggccactggtttgatggacgcctgaatcttaagacgtccttccactgttacggcgcttgcaccaaatatgagtacccgtggcatacagccaagtgtcactatgaacgggactaccaatatgagacctcttgggggtgcaaccctagcgactgtcccggagttggcacagggtgcaccgcgtgcggactgtacctcgatagactgaaacccgtgggctccgcctacaagattatcacgattcgctattctcggagagtgtgtgtccagtttggggaagagaatctgtgcaagatcatcgacatgaacgattgtttcgtgagccgccatgttaaagtgtgcattatcggcacagtctccaagttttctcagggagacacccttctcttctttggccctctggaagggggaggcctgattttcaaacactggtgtaccagcacatgccagtttggggatccgggagacatcatgagcccccgggataagggcttcctctgtcctgagttccccgggagctttagaaaacattgcaatttcgctaccacacctatttgtgaatacgacggcaacatggtgtctggatataagaaagttatggccacgatcgattcctttcagagcttcaatacctctacaatgcactttaccgacgaacgcatcgagtggaaggatcccgacggcatgctgcgggatcacattaacatccttgtgacaaaggacattgacttcgataacctgggggaaaatccttgcaaaatcggactccagacctccagcattgagggcgcttgggggtctggagtcggctttacgctgacctgtctggtgtcccttacagagtgccccaccttcctcacaagcatcaaggcctgcgacaaagcgatttgttacggggccgaatccgttaccctgacaagaggccagaacaccgtgaaggtcagcggaaaaggcgggcattctggaagcacgtttaagtgctgtcacggcgaggattgctcccagatcgggctgcatgctgccgctccgcacctcgacaaggtgaatggaatctctgaaatggagaacagcaaagtgtatgatgacggcgcccctcaatgtggcattaagtgctggttcgtcaaatccggggaatggatctctggaatttttagcggcaattggatcgttctgacagtgctttgtgtgttcctcctgttctccctggtcctgctttctattctctgccccgtgcgcaagcataaaaagagctga

SEQ ID NO: 13363 - RNA, 3408 nt, synthetic construct
  misc_feature 1..3408: note = derived and/or modified CDS sequence (opt5) from HTNV(Lee)__D00377.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaacatcttttgagaccgtctctacagaagtggacctgaaggggacctgcgttctcaaacacaagatggtggaggagtcctatcgcagcagaaagtctatcacgtgttacgatctgtcctgcaacagcacctattgtaaacctacactgtacatgattgtccccatccatgcttgcaatatgatgaagtcttgtctcatcgccctgggaccttatcgggtccaggtggtgtacgaacgcacctactgcatgacaggcgttcttattgaggggaaatgtttcgtgccggaccagtccgtggtcagcatcattaagcacggaatctttgatattgcctccgtgcatatcgtttgcttctttgtggctgtcaaaggcaacacctataagattttcgaacaggtgaagaaatcttttgagagcacgtgtaatgacacagagaacaaggttcaaggctactatatctgcatcgtcgggggaaattccgcccccatttacgtgcctaccctggatgacttcagaagcatggaggcttttacaggcatcttccggtctccccacggggaggatcacgacctcgccggagaagagaccgcgacctattccattgtgggccctgccaacgctaaagtcccccatagcgcctctagcgatacactgtcccttatcgctttttctgggattccgagcgactccagcctgtctatcctcacgtccagcaccgaagccaagcacgtgttctctcctggactgtttcccaaactgaatcatacaaactgcgacaagggcgcgatccctctcatgtggaccggcatgattgatctgcccgggtactatgaggccatccacccctgtacagttttctgcgtgctttccggacctggcgctagctgtgaggccttctccgaagggggaatttttaatatcacctacccgatgtgcctggtctctaaacagaaccgcttcagactcacggagcaacaggtgaattttgtttgtcagcgggtggacgtcgatattgtggtgtactgcaacggccagcgcaaggttatcctgacaaagacccttgtcatcgggcagtgtatttataccatcacaagcctgttctccctcctgcccggagtggctcactctattgccgtggaactgtgcgtccctggctttcatggctgggccaccgctgcgctcctggtgacattctgttttgggtgggttcttatccccgccattacgttcatcattctgaccatcctcaaatttatcgctaacattttccacacaagcaatcaagagaacagactgaagtccgtgcttcggaaaatcaaggaagagtttgagaaaaccaagggaagcatggtctgcgacgtgtgtaagtacgaatgcgagacatataaagaactgaaggcccatggcgtttcttgccctcagtcccagtgtccctactgcttcacccactgtgagccgacggaagccgcttttcaggcccattataaagtgtgccaagtcacccaccgcttcagagatgacctcaagaaaacagtgacccctcagaatttcacacccgggtgttaccggaccctgaacctgtttcgctataagagcagatgctacattttcacgatgtggatctttctcctggttcttgagtctattctgtgggcggcttccgccagcgagacacctctcacccccgtgtggaatgataacgcccacggagtcggctctgtgcctatgcatacagacctggaactggatttcagccttacctccagctctaagtacacctatcggagaaaactcacaaatcccctggaggaagctcagtccatcgacctgcacatcgagattgaggaacagacgatcggggtggatgtccatgccctcggccactggtttgacggacgcctgaaccttaagaccagcttccactgttacggcgcttgcacaaaatatgagtacccgtggcataccgccaagtgtcactatgaacgggactaccaatatgagacatcctgggggtgcaatccttctgattgtcccggagttggcaccgggtgcacggcgtgcggactgtacctcgacagactgaaacccgtgggcagcgcctacaagattatcacaattcgctattcccggagagtgtgtgtccagtttggggaagagaacctgtgcaagatcatcgatatgaatgactgtttcgtgtctcgccatgttaaagtgtgcattatcggcaccgtcagcaagttttcccagggagatacccttctcttctttggccctctggaagggggaggcctgattttcaaacactggtgtacatctacctgccagtttggggacccgggagatatcatgagcccccgggacaagggcttcctctgtcctgagttccccgggtcctttcgcaaaaagtgcaacttcgctacaacgcctatttgtgagtacgatggcaatatggtgagcggatataaaaaggttatggccaccatcgactcttttcaatccttcaacacaagcaccatgcattttacagatgaaagaatcgagtggaaggaccccgatggcatgctgcgggaccacattaatatccttgtgaccaaagacattgatttcgacaacctgggggaaaacccttgcaagatcggactccagacgtcttccattgagggcgcttgggggagcggagtcggctttaccctgacatgtctggtgtctcttaccgagtgccccacattcctcacctccatcaaagcctgcgataaggcgatttgttacggggccgaaagcgttacactgaccagaggccagaatacggtgaaagtctccggaaagggcgggcacagcggatctacatttaagtgctgtcatggcgaggactgcagccagatcgggctgcacgctgccgctccgcatctcgataaagtgaacggaatctccgaaatggaaaattctaaggaatatgacgatggcgcccctcaatgtggcattaaatgctggttcgtcaagagcggggagtggatctccggaatttttagcggcaactggatcgtgctgattgttctttgtgtgttcctcctgttcagcctggtgctgctttccatcctctgccccgtccgcaaacacaagaagtcttga

SEQ ID NO: 13364 - RNA, 3384 nt, synthetic construct
  misc_feature 1..3384: note = derived and/or modified CDS sequence (opt5) from HTNV(M)__U38177.1__GP
  source 1..3384: mol_type = other RNA
atggccagcctggtgtggcccgtcctcaccctgagaaacgtttacgacatgaagatcgagtgccctcacacagtgtccttcggcgaaaattctgtgattgggtatgtcgagcttccgcccgtgcctctggctgatacggcccagatggttcccgaaagctcctgtaacatggacaatcatcaatctctcaacaccatcacaaaatacacccaggtgagctggcggggaaaggcggatcagtcccagtctagccaaaattcctttgagacagtcagcaccgaagtggacctgaaaggcacatgcgttcttaagcacaaaatggtggaggagtcttatcgctccagaaagagcgtcacctgttacgatctgtcttgcaactccacgtattgtaagcctaccctctacatgattgtgcccatccatgcttgcaatatgatgaaaagctgtctgattgccctggggccttatcgggtgcaggtcgtttacgaacgctcttactgcatgacaggagtgctcatcgagggcaagtgtttcgtgccggaccagtccgtcgtgagcatcattaaacacgggatctttgatattgcctccgttcatatcgtgtgcttctttgtcgctgtgaagggaaacacctataaaattttcgaacaggttaagaagtcttttgagagcacatgtaatgacaccgagaacaaagtgcaaggctactatatctgcattgtcggcggaaattccgcccccatctacgtgcctacgctggatgacttcagaagcatggaagcctttacagggatcttccggtctccccacggcgaggatcacgaccttgccggggaagagattgcgtcctatagcatcgtcggagccgctaacgccaaggtgcctcattctgctagctccgataccctgcgcctcattgcctactctggcatccccagctattccagcctgtctattcttacatccagcaccgaagcgaaacacgtgttttctccggggctgttccctaagctcaatcataccaactgcgacaaatccgccatccccctgatctggacaggaatgattgacctgcctggctactacgaggctgtgcacccctgtacggtcttttgcgtgctcagcggccccggggcctcctgtgaggctttctctgaaggaggcatcttcaatattaccagccctatgtgcctggtttccaagcagaacagatttcggcttacagagcagcaggttaacttcgtctgtcaacgcgtggatatggacatcgtggtttattgcaatgggcagagaaaagtcattctgaccaagacactcgtgatcggacagtgtatctacaccattacgtctctgtttagccttctgccgggcgtggcccactccatcgccgtcgaactctgcgtgcccgggttccatggatgggctacagcggccctgctggttaccttttgtttcggctgggtgctcattcctgctatcacctttattatcctgacagtccttaagttcattgccaacatctttcacaccagcaatcaagagaaccggctgaaatctgtgctccgcaagatcaaagaagagttcgagaagacaaaaggctccatggtttgcgatgtgtgtaagtatgaatgcgagacgtacaaggaactgaaagcccatggggtcagctgcccccagtctcagtgtccttattgctttacccactgtgagcccacagaagctgccttccaggcgcattacaaggtgtgccaagttacccacagatttcgggacgatcttaaaaagacagtgaccccgcagaatttcacgcctggatgttatcgcaccctgaacctcttcagatacaaatcccggtgctacatttttacaatgtggatcttcctgctggtcctcgagagcattctgtgggctgcctctgccagcgagacaccccttacccctgtgtggaatgacaacgctcacggcgtggggtccgtccccatgcataccgatctggaactcgactttagcctgacgtcttccagcaagtatacatacagacgcaagctgaccaatcctcttgaggaagcccagtccatcgatctccacattgagatcgaggaacagacaatcggagttgacgtgcatgctctgggccactggttcgatgggcggctgaacctcaaaacctcttttcactgttatggcgcctgcaccaagtacgagtatccctggcatacagcgaaatgtcactacgaaagagactatcaatacgagacgagctggggatgcaatccgtccgactgtcctggcgtggggaccggatgcacagcctgcggcctgtaccttgatcagctgaagcccgtcgggtctgcttataaaattatcaccattcgctacagccggagagtgtgtgttcagttcggagaagagaacctctgcaagatcattgacatgaatgattgttttgtgtcccgccatgtcaaggtgtgcatcatcggcacagtttctaaattcagccagggggacaccctgctgtttttcggcccccttgagggaggcgggctcatttttaagcactggtgtacgtccacatgccaattcggagatcctggcgacatcatgagcccgcgggataaagggtttctgtgtcccgagttccctggatctttcagaaagaaatgcaactttgccaccacccccatttgtgagtatgacggcaatatggtgtccgggtacaagaaagtcatggctacaatcgatagcttccagtcttttaacacctccacaatgcatttcacggacgaacgcattgagtggaaggatcctgacggcatgctgcgggatcacatcaacatcctcgtgaccaaggacattgactttgataatctgggagaaaacccctgcaaaatcggccttcagacaagctctattgagggggcctggggatccggcgttgggttcaccctgacatgtctcgtgagcctgaccgagtgccctacgtttctgacctccatcaaggcgtgcgacaaagccatttgttatggagctgaaagcgtcacacttaccagaggccagaatacagtgaaggtgtctgggaaaggcggacacagcggctccaccttcaagtgctgtcatggggaggattgctctcaaatcggactccacgccgctgctccccatctggacaaggtcaacggcattagcgaaatcgaaaattccaaagtttacgatgacggggccccgcagtgtggaatcaagtgctggtttgtgaaatctggcgaatggattagcggcatcttctccgggaactggattgtgctgatcgtcctctgtgtgtttctgcttttctctctggttctcctgagcattctgtgccctgtgcgcaagcacaaaaagtcctga

SEQ ID NO: 13365 - RNA, 3408 nt, synthetic construct
  misc_feature 1..3408: note = derived and/or modified CDS sequence (opt5) from HTNV(N8)__EF077656.1__GP
  source 1..3408: mol_type = other RNA
atgggcatctggaagtggctggtgatggccagcctcgtctggcccgcttacaccctgagaaacgtttatgacatgaaaattgagtgccctcacacagtgtccttcggggaaaattctgtgatcggatacgtcgagcttccgcccatgcctctggccgatacggcgcagatggtgcccgaaagctcctgtaacatggacaatcatcaatctatgaacaccattacaaagtatacccaggttagctggcggggcaaagctgatcaggcccaggcctcccaaaattcttttgaggctgtgagcgccgaagtcgacctcaaggggacatgcgtgctgaaacacaagatgcttgaggagtcctaccgcagcagaaagtctatcacctgttatgatctgtcctgcaacaatacatactgtaaacctaccctctatatgattgttcccatccatgcttgcaacatgatgaaaagctgtctgatcgccctgggaccttaccgggtgcaggtcatttacgaacgcacgtattgcatgaccggcgtgctcatcgaggggaagtgtttcgtgccggaccagtctgtcgtttccattatcaagcacggaatttttgatatcgcgagcgtgcatattgtgtgcttctttgtcgccgtgaaaggcaatacatacaagctgttcgaacaggttaagaaatcttttcaatccacctgtaacgacacagagaataaggtgcagggctattacatctgcatcgtcgggggaaacagcgctcccatttatgtgcctacccttgatgacttcagatccatggaggccttttctggcatcttccggagcccccacggggaagatcacgacctggctggagaggaaattgcctcctacagcatcgttggccctgcgaatgccaaagtgccccattctgcttccagcgatacgctctctctgattgcctatagcgggatcccgtcctactctagcctttccatcctgacaggaagcaccgaggctaagcacgtcttttctcctggcttctttccccagctcaaccatacaaaatgcgacaagaccgccattcctctgacctggacaggcatgatcgacctgcccgggtactatgaagccattcacccctgtacggtgttctgcgtcctctccggacctggcgctagctgtgaggcgttctctgaagggggaatctttaatattacctccccgatgtgcctggtgagcaaacagaaccgcttcagacttacagagcaacaggttaactttgtgtgtcagcgggtcgatatggacatcatcgtgtactgcaatggccaacgcaaggttattctgaccaagacactcgtgatcgggcagtgtatttataccatcacgtccctgttctctcttctgcccggagtcgcccacagcattgctgtggagctctgcgtgcctggctttcatggctgggccacagccgctctgctggttaccttctgttttgggtgggtcctcatccccgccattaccttcatcatcctgacagtgcttaaatttattgcgaacatcttccacacctccaatcaggaaaacagactgcgggctgtgctccgcaagattaaagaggaatttgagaagacaaaaggatctatggtctgcgatgtgtgtaagtacgagtgcgaaacgtataaggagctgaaagcccatggcgttagctgccctcagtcccaatgtccctactgcttcacccactgtgaaccgacagaggccgcttttcaggcccattatagagtgtgccaggtcacccaccggttccgcgacgatcttaagaaaacagtgacccctcagaatttcacgcccgggtgttacagaaccctgaacctctttcggtacaagagcagatgctatatcttcacaatgtgggtttgtctgctggtgctcgaatctattctgtgggctgcctccgcgagcgaggtccctcttaatcccgtgtggaacgacaatgcccacggagttggctctgtgcctatgcataccgatctggagctcgacttttccctgacaagctctagcaaatacacctatcgccggagactgacgaacccccttgaagagacacaagctatcaatctccacatcgaaattgaggagcagaccatcggggtcgatgtgcatgccctgggccactggttcgacggacgcctgaacctcaagacatcctttcactgctacggcgcttgtaccaagtatgaatacccgtggcataccgccaaatgccactatgagcgggattaccagtacgaaacaagctgggggtgtaatcctgcggactgccccggagtgggcacggggtgcaccgcctgtggactgtatattgaccagcttaagcccgtcggctctgcttacaaaatcattacaatcagatattcccgcaaggtttgcgtgcaattcggggaggaaaacctgtgtaaagtgatcgatatgaatgactgctttgtcagccggcatgtgaaggtttgtattatcggcaccgtgtccaagttctctcagggagatacactcctgtttttcggccctctggaagggggaggccttatttttaaacactggtgcaccagcacgtgtcagttcggggacccgggagatatcatgtcccccagagacaagggctttctctgccctgagttccccgggtctttccgcaaaaagtgtaactttgccacaacccctctgtgcgagtacgatggcaacatggtcagcggatataaaaaggtgatggctaccattgactccttccagtcttttaatacaagcaccatgcatttcacagatgagcggatcgaatggaaagaccccgatggcatgctgagagaccacatcaacattctcgttacgaaggatatcgactttgacaatctgggggagaacccttgtaagattggacttcaaacctccagcatcgaaggcgcctgggggtctggagtgggcttcacactgacctgcctcgtctccctgacagagtgccccacctttctgacgagcattaaagcctgtgataaggctatctgctacggggcggagtctgtggcccttacccgcggccagaatacagttaaagtgtccggaaagggcgggcacagcggatctaccttcaaatgttgccatggcgaagagtgttcccagattgggctccacgctgccgccccgcatctggacaaggtcaacggaatcagcgaagtggagaataacaaggtgtatgatgacggcgctcctcaatgcggcgtcaaatgttggtttgttaagtccggggaatggatcagcggaattttctctggcaattggatcgtgctgattgtgctctgcgtctttctgcttttcagcctggtgctcctgtccgttctgtgtcccgtgcggaaacacaagaaatcttga

SEQ ID NO: 13366 - RNA, 3408 nt, synthetic construct
  misc_feature 1..3408: note = derived and/or modified CDS sequence (opt5) from HTNV(Q32)__DQ371905.1__GP
  source 1..3408: mol_type = other RNA
atgggcatctggaagtggctggtgatggccagcctcgtctggcccgctttcgccctgagaaacgtttacgacatgaaaattgagtgccctcacaccgtgtcctttggggaaaattctgtgatcggatatgtcgagcttccgcccatgcctctggcggatacaacgcagatggtgcccgaaagctcctgttctatggacaaccatcaaagcctcaataccattacaaagtacacccagatcatttggcggggcaaagctgatcagtcccagtctagccaaaactccttcgagacagttagcaccgaagtggacctgaaggggacatgcgtccttaaacacaagatgatcgaggagtcttatcgctccagaaagagcatcacctgttacgatctgtcttgcaattccacgtattgtaaacctaccctctacatgattgtgcccatccatgcctgcaacatgatgaagtcctgtctgattgccctgggaccttatcgggttcaggtggtctacgaacgcacatactgcatgaccggcgtgctcatcgaggggaaatgttttgtgccggaccagtctgtcgtttccattatcaagcacggaattttcgatatcgctagcgtgcatatcgtgtgctttttcgtcgccgtgaaaggcaatacatataagatttttgaacaggttaagaaatccttcgagtctaactgtaatgacaccgagaacaaggtgcaaggctactatatctgcattatcgggggaaatagctcccccgtctacgtgcctacgctggatgactttagaagcatggaggctttctctggcatttttcggagcccccacggggaggatcacgaccttgccggagaagaggttgcgagctattctatcgtgggccctgccaacgctaaagtcccccatagcgcctcctctgatacactggggctcatcgcttacttcggcattccgagctattccagcctgtctatccttacctccagcacagaagccaagcacgtgttttctcctggactgttcccccagctcaatcataccaaatgcgacaagaccgcgattcctctgacatggacgggcatgatcgacctgcccgggtactacgaggccattcacccctgtaccgtcttctgcgtgctctccggacctggcgctagctgtgaggccttttccgaagggggaatcttcaacatcacatctccgatgtgcctggttagcaaacagaatcgctttagacttaccgagcagcaagtgaacttcgtctgtcagcgggtggatgttgacattatcgtgtattgcaacggccagcgcaaggtcattctgacaaagaccctcgtgatcgggcaatgtatttacacgatcacatccctgttttctcttctgcccggagtggctcacagcattgccgttgaactctgcgtccctggcttccatggctgggccaccgctgcgctgctggtgaccttttgtttcgggtgggtgctcatccccgccatcacatttattatcctgaccattcttaaattcatcgctaatatttttcacacatccaaccaggagaatagactcaagagcgtcctgcggaaaatcaaggaagagttcgagcgcacgaaaggatctatggtgtgcgatatctgtaagtatgaatgcgagacctacaaggaactgaaagcccatggcgtttcctgccctcagagccagtgtccctattgctttacacactgtgagccgaccgaagccgctttccaagcccattacaaggtgtgccaggtcacacacagattccgggacgatcttaaaaagaccgtgacgcctcagaactttacccccgggtgttatcgcacactgaatctcttcagatacaaatctcggtgctacatttttaccatgtgggttttcctgctggtgctcgagtccatcctgtgggcggctagcgcctctgagattcctcttaaccccgtctggaatgacaacgcccacggagtgggcagcatccctatgcatacagatctggaactcgacttttccctgacctcctcttccaagtatacgtacagacgcaagctgacaaatccccttgaggaaagccaggctattgatctccacgttgagatcgaggaacaaaccatcggggtggacgtccatgccctgggccactggttcgatggacggctgaacctcaaaacatcctttcactgttatggcgcttgcaccaagtacgagtatccgtggcataccgccaaatgtcactacgaaagagactatcagtacgagacatcttgggggtgcaatcctagcgactgtcccggagtgggcacggggtgcaccgcgtgcggactgtaccttgatcagctgaagcccgtgggctccgcctataaaattatcacaattcgctactctcggagagtctgtgttcagttcggggaagagaacctctgcaagatcattgacatgaatgattgttttgtgagccgccatgtgaaggtctgcatcatcggcaccgtgtccaaattctctcaaggagacacactgctgtttttcggccctcttgaagggggaggcctcatttttaagcactggtgtaccagcacgtgccagttcggggatccgggagacatcatgagcccccgggataaaggcttcctgtgtcctgaatttcccgggagcttcagaaagaaatgcaactttgctacaacccctgtttgtgagtatgacggcaatatggtgtctggatacaagaaagtcatggccaccattgattccttccagagctttaacacatctaccatgcatttcacagacgaacgcatcgagtggaaggatcccgacggcatgctgcgggatcacattaacatcctcgtgacgaaggacattgactttgataatctgggggaaaacccttgcaaaatcggacttcagacctccagcatcgagggcgcttgggggtctggagttggcttcacactgacctgtctcatttccctgacagagtgcagcacctttctgacgtccatcaaggcctgcgacaaagcgatttgttatggggccgaaagcgtgacccttatcagaggccaaaatacagtcaaggtgtctggaaaaggcgggcacagcggatcctctttcaagtgctgtcatggcgaggaatgcagccagattgggctccacgctgccgctccccatctggataaggttaacggaatctccgagatggaaaattctaaagtgtttgacgatggcgccccgcagtgtggcatcaagtgctggttcgtcaaaagcggggagtggatttccggaatcttctctggcaactggattgtgctgatcgtgctctgtgtctttctgcttttcagcctggttctcctgtccattctgtgccctgtgcgcaagcacaaaaagagctga

SEQ ID NO: 13367 - RNA, 3408 nt, synthetic construct
  misc_feature 1..3408: note = derived and/or modified CDS sequence (opt5) from HTNV(Bao14)__AB127995.1__GP
  source 1..3408: mol_type = other RNA
atgggcatgtggaagtggctggtgatcgccagcctcgtctggcccgctctggcccttagaaacgtttacgacatgaaaattgagtgccctcacaccgtgtccttcggggaaaattctgtgatcggatatgtcgagctgccgcccatgcctctcgcggatacagctcagatggtgcccgaaagctcctgttctatggacaaccatcaaagcattaatacgatcaccaagtacacacaggttatttggcggggcaaagccgatcctgggcagtcctctcagaacagctttgagaccgtgtccacagaagtcgacctgaagggaacctgcgtgcttaaacacaagatggttgaggagagctatcgctctagaaagtccatcacatgttacgatctgagctgcaattctacctattgtaaacccacgctctacatgatcgtgcctattcatgcctgcaacatgatgaagtcctgtctgatcgctctgggcccgtatcgggtccaagtggtgtacgaacgcacctactgcatgacaggggtcctcattgagggaaaatgtttcgttcccgaccagagcgtggtgtctatcattaagcacggcatctttgatattgcctccgtccatatcgtgtgcttctttgttgctgtgaaaggcaatacctataagctgttcgaacaggtcaagaaatcttttgagtccacatgtaacgacaccgagaataaggtgcaggggtactatatctgcattgttggaggcaactctgcccctatctacgtgcccacgcttgatgacttcagaagcatggaagcgtttacagggattttcaaatcccctcacggagaggatcacgacctggccggcgaagagatcgctagctattctattgtcgggcccgccaatgctaaggtgccgcattccgccagctctgataccctcagcctgatcgcgtactccggaatcccttcttatagctcccttagcattctgacatcttccaccgacgccaaacacgtctttagccccggcctcttccctaagctgaaccataccaattgcgacaaatctgctatccccctgacatggacgggcatgattgatctccccgggtactacgaagccatccacccttgtaccgtgttttgcgttctgtccggaccgggcgctagctgtgaggccttctccgaagggggaattttcaacatcacatctcccatgtgccttgtgagcaagcaaaatcggtttcgcctgaccgaacagcaggtcaacttcgtgtgtcagagagttgacatggatatcgtggtctattgcaacggccaacggaaggtgattctcacaaaaaccctggtgatcgggcagtgtatttacacgatcacatccctttttagcctgctccctggagttgcccacagcattgctgtcgagctgtgcgtgcccggcttccatggctgggcgaccgccgctctgctcgtgaccttttgtttcgggtgggtcctgatccctgccgtgacatttattatccttaccgttctgaagttcatcgccaatatttttcacacatccaaccaggaaaatcgcctcaaaagcgtgctgagaaagatcaaagaggagttcgagaagacgaagggatctatggtctgcgacgtgtgtaaatatgagtgcgaaacctacaaggagcttaaagctcatggcgtttcctgcccccaaagccagtgtccgtattgctttacacactgtgaacctaccgaggccgcgttccaggctcattacaaggtgtgccaggtcacacaccggtttcgcgatgacctgaaaaagaccgtgacgccccaaaacttcacccctgggtgttatagaacactcaatctgttccggtacaagtctcgctgctacatttttaccatgtgggttttcctgctcatcctggaatccgtgctttgggccgccagcgcttctgagacacccctgacccctgtctggaacgataatgcccacggagtgggcagcgtgcccatgcatacggacctcgagctggatttttccctgacaagcagctccaaatatacctacagacggaaacttacaaacccgctcgaagaggctcagagcattgacctgcacatcgaaatcgaggagcagaccattggggtcgatgttcatgccctgggccactggttcgacggaagactcaatctgaagacctcctttcactgttatggcgcgtgcacaaagtacgaatatccttggcatacggccaaatgtcactacgagcgcgactatcagtacgaaacctcttgggggtgcaaccccagcgattgtcccggagtgggcacagggtgcaccgcttgcggactttacctggaccaactcaagcctgtgggctccgcctataagatcattacaatccggtactctagacgcgtctgtgtgcagttcggggaggaaaatctgtgcaaaattatcgatatgaacgactgttttgttagccggcatgtgaaggtctgcatcattggcaccgtgtccaaattctctcagggagatacgctgctctttttcggcccgcttgaagggggaggcctgatctttaagcactggtgtacatctacctgccagttcggggaccccggagatattatgtcccctagagacaaaggctttctgtgtcccgagttccctgggagcttccgcaagaaatgcaattttgctaccacacccatctgtgagtatgatggcaacatggtttctggatacaagaaggtgatggccaccattgactccttccagagctttaatacatctacgatgcatttcaccgatgagcggatcgaatggaaagaccctgatggcatgctcagagaccacatcaacattctggtcacaaaggacatcgattttgacaaccttggggagaatccctgcaaaattggactgcaaacctccagcatcgaaggcgcgtgggggtctggagtgggcttcacactcacctgtctggtttccctgacggagtgcccgacctttcttacaagcattaaggcctgcgataaagctatctgttatggggccgagtccgtgaccctcacacgcggccagaacaccgtccgggtgagcggaaagggcgggcactctggaagcacattcaagtgctgtcatggcgaagactgctccaaaattgggctgcacgctgccgcccctcatctggataaggtgaatggaatctctgagatcgaaaacagcaaagtctacgacgatggcgctccccagtgtggcattaagtgctggtttgttaaatccggggagtggatctctggaattttcagcggcaattggatcgtgctcattgtgctgtgtgtctttcttctgttctccctcgtgctgctgtctatcctttgccctgttagaaagcacaagaaaagctga

SEQ ID NO: 13368 - RNA, 3408 nt, synthetic construct
  misc_feature 1..3408: note = derived and/or modified CDS sequence (opt5) from HTNV(HubeiHu02)__JQ665881.1__GP
  source 1..3408: mol_type = other RNA
atgggcatctggaagtggctggtgatggccagcctcgtctggcccgctttcgccctgagaaacgtttacgacatgaagattgagtgccctcacaccgtgtcctttggggaaaattctgtgatcggatatgtcgagcttccgcccatgcctctggcggatacagctcagatggtgcccgaaagctcctgttctatggacaaccatcaaagcctcaatacgattaccaagtacacacagatcgtttggcggggcaaagccgatcagtcccagtctagccaaaactccttcgagaccgtgagcacagaagtcgacctgaaggggacctgcgtgcttaaacacaagatggttgaggagtcttatcgctccagaaagagcattacatgttacgatctgtcttgcaattccacctattgtaaacctacgctctacatgatcgtgcccatccatgcctgcaacatgatgaagtcctgtctgattgctctgggaccttatcgggtccaggtggtgtacgaacgcacctactgcatgacaggcgtcctcatcgaggggaaatgttttgttccggaccagtctgtggtgtccattatcaagcacggaattttcgatatcgccagcgtccatattgtgtgctttttcgttgctgtgaaaggctccacctataagctgtttgaacaggtcaagaaatctttcgagagcaattgtaacgacacagagaataaggtgcaaggccactacatctgcatcgttgggggaaactccgcccccatttatgtgcctacccttgatgactttagaagcatggaagcgttctctggcatctttaaaagcccccacggggaggatcatgacctggccggagaagaggtcgctagctactctattgtgggccctgccaatgctaaggtcccccacagcgcctcctctgatacgctcagcctgatcgcgtattccgggattccgagctactcttcccttagcatcctgacatctctcaccgaagccaaacatgtgttctcccctggactgtttccccagctgaaccacacaaagtgcgacaaaaccgctatccctctcacctggacaggcatgattgacctgcccggctattacgaggccgttcacccctgtacggtgttctgcgtccttagcgggcctggagcttcctgtgaggccttctctgaaggcgggatcctgaatattaccagcccgatgtgcctcgtgtccaagcagaaccggtttcgcctgacagagcagcaagttaatttcgtgtgtcagagagtcgatgtggacatcgtggtttactgcaacggacagcggaaggtcattcttaccaaaacactggtgatcggccaatgtatctataccattacgtctctctttagcctgctgcccggggtggcccattccatcgctgtcgaactctgcgtgcctggattccacggctgggcgacagccgctctgcttgttaccttttgtttcggctgggtgctgattcccgccatcacctttattatcctcacaattctgaagttcatcgccaacatctttcataccagcaatcaggagaaccgccttaaatctgtcctgagaaagattaaagaagagttcgagcggacaaaggggtccatggtgtgcgatgtttgtaagtacgaatgcgagacgtataaagaactcaaggctcacggagtgagctgccctcagtctcagtgtccctactgctttacccattgtgagccgacagaagccgcgttccaagctcactataaagtctgccaggtgacccaccgctttagagacgatctgaagaaaacagttacccctcagaatttcacgcccggctgttaccggaccctgaacctcttccgctataagtccagatgctacatctttacaatgtgggtgttcctgcttgtcctggagagcattctctgggccgcctctgctagcgagacccctctgaatcccgtgtggaacgacaatgcccatggggtgggatccgtccctatgcacacagatctggaacttgactttagcctcacctcttccagcaagtacacgtatcggagaaaactgacaaaccccctggaggaatcccaggctatcaatctccatattgagatcgaggaacaaaccatcggcgttgatgtgcacgccctggggcactggttcgacggccgccttaacctgaagacatcttttcattgttacggagcgtgcaccaaatatgagtacccgtggcacaccgccaagtgtcattatgaacgggattaccagtatgagacaagctggggctgcaatccttccgactgtcccggggtgggaacgggctgcaccgcttgcgggctctacctggaccagctgaaacccgtcggatctgcctacaagattatcacaattagatatagccgccgggtgtgtgttcagttcggcgaagagaacctttgcaagatcattgatatgaatgactgttttgtgtccagacacgtcaaagtgtgcatcatcgggaccgtttctaagttcagccaaggcgatacactcctgtttttcggacctctggagggcgggggactcatttttaaacattggtgtacctccacgtgccagttcggcgacccgggggatatcatgagcccccgcgacaagggatttctgtgtcctgagttccccggctctttccggaaaaagtgcaactttgctacaacccctatttgtgaatacgatgggaatatggtgtccggctataaaaaggtcatggccaccatcgacagcttccagtcttttaacacatccaccatgcacttcacagatgaaagaattgagtggaaggaccccgatggaatgcttcgcgaccacatcagcatcctggtgacgaaagatattgactttgacaacctcggcgaaaatccttgcaagatcgggctgcagacctcttccattgagggagcgtggggcagcggggttggatacacactgacctgtcttatctccctcacagagtgccccaccttcctgacgagcattaaagcctgcgataaggctatctgttatggcgccgaatctgtgaccctgacacgggggcaaaacaccgtcaaagtgagcggcaagggaggccattccgggtctagctttaagtgctgtcacggagaggactgctcccagattggcctccatgctgccgccccgcacctggataaagtgaatgggatctctgaaatcgagaacagcaaggtcttcgacgatggagctcctcagtgtggcattaaatgctggtttgttaagtccggcgaatggatctctgggattttcaatggaaactggatcgtgcttattgtgctgtgtgtctttctcctgttcagcctggtgcttctctccatcctgtgccccgttagaaaacataaaaagagctga

SEQ ID NO: 13369 - RNA, 3408 nt, synthetic construct
  misc_feature 1..3408: note = derived and/or modified CDS sequence (opt5) from HTNV(HV004)__JQ083394.1__GP
  source 1..3408: mol_type = other RNA
atgggcatctggaagtggctggtgatggccagcctcgtctggcccgctttcgccctgagaaacgtttacgacatgaaaattgagtgccctcacaccgtgtcctttggggaaaattctgtgatcggatatgtcgagcttccgcccatgcctctggcggatacagctcagatggtgcccgaaagctcctgttctatggacaaccatcaaagcctcaatacgattaccaagtacacacagatcatttggcggggcaaagccgatcagtcccagtctagccaaaactccttcgagaccgttagcacagaagtggacctgaaggggacctgcgtccttaaacacaagatggtggaggagtcttatcgctccagaaagagcatcacatgttacgatctgtcttgcaattccacctattgtaaacctacgctctacatgatcgttcccattcatgcctgcaacatgatgaaaagctgtctgatcgctctgggaccttatcgggtgcaggtcgtgtacgaacgcacctactgcatgacaggcgtgctcattgaggggaagtgttttgtcccggaccagtctgttgtgtccatcattaagcacggaatcttcgatattgccagcgtgcatatcgtctgctttttcgtggctgttaaaggctccacctataagctgtttgaacaggtgaagaaatctttcgagagcaattgtaacgacacagagaataaggtccaaggctactatatctgcattgttgggggaaactccgcccccatctacgtgcctacccttgatgactttagaagcatggaagcgttctctggcatttttaaaagcccccacggggaggatcacgacctggccggagaagaggtggctagctattctatcgtcggccctgccaatgctaaggtgccccatagcgcctcctctgatacgctcagcctgattgcgtactccgggatcccgagctattcttcccttagcatcctgacatcttccaccgaagccaaacacgtcttcagccctggactctttccccagctgaaccatacaaagtgcgacaaaaccgctattcctctgacctggacaggcatgatcgacctccccggctactacgaggccattcacccctgtacggtgttctgcgttctgtccgggcctggagcttcttgtgaggccttcagcgaaggcgggatctttaatattacctccccgatgtgccttgtgtctaagcagaaccggttccgcctgacagagcagcaagtcaattttgtgtgtcagagagttgatgtggacatcgtcgtgtattgcaacggacagcggaaggtgatcctcaccaaaacactggttattggccaatgtatctacaccattacgagccttttctccctgctccccggggtcgcccacagcatcgctgtggaactgtgcgtgcctggatttcatggctgggcgacagccgctctgctcgtcaccttctgttttggctgggtgctgattcccgccatcaccttcattatccttacaatcctgaagtttattgccaacatcttccacacctctaatcaggagaacaaactcaagtccgttctgcgcaaaattaaggaagagtttgagagaacaaaggggagcatggtgtgcgatgtctgtaaatatgaatgcgagacgtacaaggaacttaaagctcatggagtgtcttgccctcagtcccagtgtccctattgcttcacccactgtgagccgacagaagccgcgtttcaagctcattacaaggtttgccaggtgacccaccggttccgcgacgatctgaaaaagacagtcacccctcagaatttcacgcccggctgttatagaaccctcaacctgtttcggtacaagagccgctgctacatcttcacaatgtgggtgtttctgctcgttctggagtctattctttgggccgccagcgcttccgagacccctctgaatcccgtgtggaacgacaatgcccacggggtcggaagcgtgcctatgcatacagatctcgaactggacttctctctgacctccagctccaaatatacgtacagacggaaacttacaaaccccctcgaggaatctcaggctatcaatctgcacatcgagattgaggaacaaaccatcggcgtggatgtccatgccctggggcactggtttgacggcagactcaacctgaagacatccttccactgttatggagcgtgcaccaagtacgagtatccgtggcataccgccaaatgtcactacgaacgcgattatcagtacgagacatcctggggctgcaatccttctgactgtcccggggttggaacgggctgcaccgcttgcgggctttacctggaccagctcaagcccgtgggaagcgcctataagattatcacaattcggtactccagacgcgtgtgtgtccagtttggcgaagagaacctgtgcaaaatcatcgatatgaatgactgtttcgtgtctcggcatgttaaggtgtgcattatcgggaccgtcagcaaattttcccaaggcgatacactgcttttctttggacctctcgagggcgggggactgattttcaagcactggtgtaccagcacgtgccagtttggcgacccgggggatatcatgtctcccagagacaaaggattcctgtgtcctgagttccccggctcctttcgcaagaaatgcaacttcgctacaacccctatttgtgaatatgatgggaatatggtgagcggctacaagaaggttatggccaccatcgactcttttcagtccttcaacacaagcaccatgcattttacagatgaacggatcgagtggaaagaccccgatggaatgctcagagaccacattaacatcctggtgacgaaggatattgacttcgacaatcttggcgaaaacccttgcaaaatcgggctgcagacctcttccattgagggagcgtggggcagcggggtcggatttacactcacctgtctgatctccctgacagagtgccccaccttccttacgagcattaaggcctgcgataaagctatctgttatggcgccgaatctgtgaccctcacacgcgggcaaaataccgttaaggtgagcggcaagggaggccactccgggtctagctttaaatgctgtcatggagaggactgctcccagatcggcctgcacgctgccgccccgcatctggataaggtcaacgggatttctgaaatcgagaatagcaaagtgttcgacgatggagctcctcagtgtggcattaagtgctggtttgtgaaatccggcgaatggatctctgggattttcaacggaaattggatcgtcctcatcgttctgtgtgtgttccttctgtttagcctcgtgctgctgtccattctttgccccgtccggaagcacaagaaaagctga

SEQ ID NO: 13370 - RNA, 3405 nt, synthetic construct
  misc_feature 1..3405: note = derived and/or modified CDS sequence (opt5) from HTNV(NC167)__AB027115.2__GP
  source 1..3405: mol_type = other RNA
atgtggggcctgctcgtggtcgccgggctgatcggaccctgcattagccttagaaacgtttacgacatgaagatcgagtgtcctcacaccgtgaatttcggcgaaaactccgtgattgggtatgtcgagctgccgcccgtgcctatcgctgatattacacagatggttcccgaatctagctgcaatatggacaaccatcaatccctctctacgtttaccaaatacacacagctgatctggcggaagaaagccgagcaggcgcaggctagccaaaattccttcgaaaccgtgtctcgcgaggtcgattttaagggaacatgtgtgttcaaacacaagatggttgaggaaagctataagaacagaaaatccatcatttgctacgaccttagctgtaatatcacccattgcaagcctacactgtatatgattatccccgtgcacgcctgtaacatgatgaaatcttgcctcattgccctgggcccttttcgggtccaggtggtgtacgagcgcacctattgtatgtccgggatcctgacggaaggaagatgcttcgtcccgtaccagagcgttgtgtctattatcaagcatggcatctttgatattgcttccatccacattatctgtttctttattgccgtggagggcaatacctacaaactcttcgaggaagtcaaaaagagctttgctctgaactgcaatgacacagagaacaagatccaggggtattacatctgcattatcggaggcaattctgcccccgtgtatgcgccttcccccgatgacttccggagcatggaagccttttccgggattttccgctctcctcacggagagaaccatgatcttaatggcgggagaaacgctccctacagcatcgttggaccgaccgacggcaaggtgcctcactccagcaaacattataacattgagttcgattctatctttcaaaagttccccacatactccagcttttctatcctggccggcagcgtcgaacctaaacacgtgttccagcccgggctctttcccaagctgaatcacaccaaatgtacgaagtccgctattcctcttgtttggacaggacggatcgacattccgggctattacgaggccgtgcatcccctgaccgtctactgcgaactctctgggcctggagcgagctgtgaggccttctccgaaggcgggatctttaacattacaagccccatgtgcctggtgtctaagcagaatcgcttcagatccctgcggcagcaagtcagctttgtgtgtcagcgcgttgatatggacatcgtggtctattgcaacggacagaaaaagaccattctcaccaaaacactggtgatcggccaatgtatctacacgattacctctcttttctccctgctccctagcgttgctcactccatcgccgtggagctgtgcgtccccggctttcatgggtgggctacagccgcccttctgattaccttctgttttggatgggtgctcatcccggctctgacattcattatcctgaccatcctcaagttcattgcgaatatctttcacacgtctaaccaggaaaataaactgaaggccgtgcttagaaagattaaagaggagttcgaaaagacaaaaggcagcatggtttgcgacatctgtaagtatgagtgcgatacctacaaagaactgaaggctcatgggctctcctgccctcagtctcagtgtccctattgctttacccactgtgagcctacagaaagcgccttccaagcccactacaaggtctgccaggtgacccatcggtttcgcgaggagctgaaaaagacagtgacgccccagaacttcacccctggatgttatagaacacttaatctgtttcggtacaaatccagatgctacattttcaccatgtggatcctcctgctggtctttgaaagcatcctctgggctgcctctgcgtccgacgtgcccctgagcacagattggaacgacaatgctcacggcgttgggtctgtgccgatgcataccgatcttgagctggacttctccctcacgagctctagcaagtatacctaccgccggaaactgacaaaccctgtcgatacctcccaggccgtggacctgcacattgaacttgaggagcaaacaatcggcctcgatgttcacgccctgggacattggtttgacggcagactgaatctcaagaccagcttccactgttatggggcttgcacgaagtacgaatatccctggcatacagccaaatgtcactttgagcgcgatttccagtacgaaacctcttggggatgcaatccccctgactgtccgggcgtggggacaggatgcaccgcttgcggcctgtatattgaccagcttcggcccgtcgggaacgcctacaagatcattaccatcagatactcccgcaaagtgtgtgttcagttcggcgatgagaacctgtgcaagacaatcgacatgaacgattgttttgtgagcaaacatgtcaaggtgtgcattatcggaacggtgtccaaattctctcaaggcgacaccctcctgtttctggggcctatggaaggaggcgggattatcttcaagcactggtgtacatctacctgccagtttggagatcccggcgacattatgtcccctaaggataaagggttctcttgtcccgagtttagcggctccttccggaagaaatgcaattttgcgacaacccctgcctgtgagtatggaggcaacatggtctctgggtacagaaaggttatggctacgatcgacagcttccaggcctttaatacatccaccattcacttcaccgatgaacgcatcgagtggaaagaccccgatggaatgcttcgggaccatatcaacattctcgtgacaagagatatcgacttcgacaatctggctgaaaacccgtgcaagattggcctccaggtgagcgccatcgagggggcgtggggatctggcgtcgggtttaccctgacatgtcaagtgtccctgacggaatgcagcaccttccttacatctattaaggcctgcgataaagctatctgttatggcgcccagtccgttaccctggtgcgcggacagaatacagtcaagatcagcggcaaagggggacactctggctccgcttttaagtgctgtcatggggaggactgcagccaaaccggactccaggccgatgcccctcacctggacaaagtgaacggcatttccgaggttgaaaatgataaggtgtacgacgatggcgctcccgagtgtgggatcaagtgctggttcgtcaaaagcggagaatgggtggcgggcatttttagcgggaactggatcgttctggtggtcctttgtattttcctcatcatcagcctgattctgctctccatcctgtgccctgtgcggaagcataaaaagtcttga

SEQ ID NO: 13371 - RNA, 3408 nt, synthetic construct
  misc_feature 1..3408: note = derived and/or modified CDS sequence (opt5) from HTNV(WuhanAaJ10)__JQ665882.1__GP
  source 1..3408: mol_type = other RNA
atgggcatctggaagtggctggtgatggccagcctcgtctggcccgctttcgccctgagaaacgtttacgacatgaaaattgagtgccctcacaccgtgtcctttggggaaaattctgtgatcggatatgtcgagcttccgcccatgcctctggcggatacagctcagatggtgcccgaaagctcctgttctatggacaaccatcaaagcctcaatacgattaccaagtacacacagatcatttggcggggcaaagccgatcagtcccagtctagccaaaactccttcgagaccgttagcacagaagtggacctgaaggggacctgcgtccttaaacacaagatggtggaggagtcttatcgctccagaaagagcatcacatgttacgatctgtcttgcaattccacctattgtaaacctgccctctacatgatcgttcccattcatgcttgcaacatgatgaagtcctgtctgatcgccctgggaccttatcgggtgcaggtcgtgtacgaacgcacgtactgcatgaccggcgtgctcattgaggggaaatgttttgtcccggaccagtctgttgtgtccatcattaagcacggaatcttcgatattgctagcgtgcatacagtctgctttttcgtggccgttaaaggctccacctataagctgtttgaacaggcgaagaaatctttccaaagcaattgtaacgacacagagaataaggtgcagggctactatatctgcatcgtcgggggatccagcgcccccatttacgtgcctacccttgatgactttagatctatggaggctttctccggcctgtttaaaagcccccacggggaagatcacgacctcgccggagaggaagttgcttcttatagcatcgtgggccctgccaacgcgaaggtcccccattccgcctctagcgatacgctgtcccttattgcttacagcgggatcccgtcttattccagcctgtctattctcacatccagcaccgaggccaaacacgtgttctcccctggactgtttccccagctgaatcatacaaagtgcgacaaaaccgctatccctctcacctggacaggcatgatcgacctgcccggctactacgaagccgtccacccctgtacggtgttctgcgttctttctgggcctggagccagctgtgaggctttctccgagggcgggatttttaacatcacctctccgatgtgcctggtgagcaagcagaatcggttccgcctcacagaacaacaggtcaactttgtgtgtcagagagttgatgtggacattatcgtctattgcaatggacaacggaaggtgattctgaccaaaacacttgtgatcggccagtgtatctacaccattacgtccctgatcagcctcctgcccggggttgcgcactctattgccgtcgagctgtgcgtgcctggatcccatggctgggctacagccgccctcctggtgaccttctgttttggctgggtccttatccccgctattaccttcatcattctgacaatcctcaagtttatcgccaacattttccacaccagcaaccaggaaaatcgcctgaaatctgtgcttagaaagatcaaagaggaatttgagcggacaaaggggtccatggtttgcgatgtgtgtaagtatgagtgcgaaacgtacaaagagctgaaggcgcatggagtcagctgccctcagtctcaatgtccctattgcttcacccactgtgaaccgacagaggctgcctttcaggcccattacaaagtgtgccaggttacccaccgcttcagagacgatctcaagaaaacagtgacccctcagaactttacgcccggctgttatcggaccctgaatctgttccgctacaagagcagatgctacattttcacaatgtgggtctttctcctggtgcttgaatccatcctgtgggctgccagcgcttctgagacccctctcaaccccgtttggaatgacaacgcccacggggtgggatccgtccctatgcatacagatctggagctggacttcagccttacctcctctagcaagtatacgtaccggagaaaactcacaaatcccctggaagagtcccaagcgattgatctgcacatcgaaatcgaggaccagaccattggcgtggatgtgcatgccctcgggcactggtttgacggccgcctgaaccttgagacatctttccactgttatggagcttgcaccaagtacgaatatccgtggcataccgccaaatgtcactacgagcgggactatcagtacgaaacaagctggggctgctccccttctgattgtcccggggtcggaacgggctgcaccgcttgcgggctgtacctcgaccagctgaagcccgttggaagcgcctataaaatcattacaatcagatactcccgccgggtgtgtgtgcaaagcggcgaggaaaatctgtgcaagattatcgatatgaacgactgttttgtctctagacatgtgaaggtttgcatcattgggaccgtgtccaaattcagccagggcgatacacttctctttttcggacctctggagggcgggggactgatctttaagcactggtgtacctctacgtgccagttcggcgacccgggggatattatgagcccccgcgacaaaggatttctctgtcctgagttccccggcagctttcggaagaaatgcaatttcgcgacaacccctatctgtgaatatgatgggaacatggtctctggctacaagaaagtgatggccaccattgactccttccagagctttaatacatccaccatgcatttcacagatgagagaatcgaatggaaggaccgcgatggaatgctgcgggaccacatcaacattcttgttacgaaggacatcgattttgacaatctgggcgagaacccctgcaaaattgggctccaaaccagctctatcgaaggagcttggggcagcggggtgggattcacactgacctgtctgatttcccttacagagtgccctacctttctcacgtctatcaaggcctgcgataaagctatttgttatggcgccgagagcgtcaccctgacaagagggcagaacaccgtgaaggtttccggcaaaggaggccactctgggagctccttcaagtgctgtcatggagaagactgctctcagatcggcctgcacgccgctgcgccccatctcgataaggtgaatgggatcagcgagattgaaaactccaaagtctttgacgatggagccccgcaatgtggcatcaagtgctggagcgtgaaatctggcgagtggatttccgggatcttcagcggaaattggattgtgctgatcgtcctttgtgtttttctcctgttctctctggtgctgctttccatcctctgccctgtgcgcaagcacaaaaagagctga

SEQ ID NO: 13372 - RNA, 3408 nt, synthetic construct
  misc_feature 1..3408: note = derived and/or modified CDS sequence (opt5) from HTNV(Z5)__EU074224.1__GP
  source 1..3408: mol_type = other RNA
atgggcatctggaagtggctggtgatggccagcctcgtctggcccgcttgcaccctgagaaacgtttacgacatgaaaattgagtgtcctcacacagtgtccttcggggaaaattctgtgatcggatatgtcgagcttccgcccatgcctctggccgatacggcgcagctcgtgcccgaaagctcctgcaacatggacaatcatcaatctatgaacaccattacaaagtacacccaggttagctggcggtccaaagtggatcaggctcaggcctctcaaaatagctttgaggccgtctccgctgaagtggacctgaagggcacatgtgttcttaaacacaagatgctggaggagagctatcgctctagaaagtccattacctgctacgatctcagctgtaactctacatattgcaaacctaccctgtacatgatcgtgcccatccatgcctgtaatatgatgaaggggtgcctgatcgctctcggaccttatcgggtccaggtggtgtacgaacgcacgtactgtatgaccggcgtcctgattgaggggaaatgcttcgttccggaccagtccgtggtgagcatcattaagcacggaatctttgatattgcctctgtccatatcgtgtgtttctttgttgcggtgaaaggcaacacatataaacttttcgaacaggtcaagaagtcctttcaaagcacatgcaatgacaccgagaacaaggtgcagggctactatatttgcatcgttgggggaaattccgcccccatctgtgtgcctaccctggatgacttcagatctatggaggcttttagcggcattttccggagcccccacggggaagatcacgacctcgccggagaggaaatcgcttcctactctattgtcggccctgccaacgcgaaagtgccccattccgccagctctgatacgctgagccttatcgcttattccgggattccgtcttacagctccctgagcatcctcgccggatctacagaggctaagcacgtcttttcccctggcttctttccccagctgaatcataccaaatgcgacaagacagccatccctctgacctggaccggcatgattgacctccccgggtattacgaagccatccacccctgtacagtgttctgcgttctgagcggacctggcgcttcttgtgaggcgttctccgaagggggaatttttaacatcacgagcccgatgtgccttgtgtccaaacagaatcgcttcagactgaccgaacaacaggtcaactttgtgtgtcagcgggttgatatggacattatcgtgtactgcaacggccaacgcaaggtcatcctcacaaagaccctggtgattgggcagtgtatctatacaattacctctcttttcagcctgctccccggagtggcccactccatcgctgttgagctgtgcgtccctggctttcatggctgggccacggccgctctgctcgtgacattctgttttgggtgggtgctgattcccgccatcaccttcgtcattcttaccatcctgaaatttatcgcgaatattttccacacatctaaccagggaaatagactcaagagcgtgctgaaaaagatcaaagaagagtttgaaaagaccaagggctccatggtttgcgatgtgtgcaaatacgagtgtgagacatataaggaacttaaagctcatggggtcagctgccctcagtctcaatgtccctactgcttcacgcactgtgagccgaccgaagccgcctttcaggctcattatcgggtgtgccaggttacacaccgcttcagagacgatctgaagaaaaccgtgacacctcagaacttcacccccggatgttaccggacgctcaatctgtttcgctataagtccagatgctacattttcaccatgtgggtctgtctgctcgtgctggagagcatcctttgggccgcttctgcctccgaagttcctctgaaccccatttggaatgacaacgcgcacggcgtggggagcgtccctatgcatacagatctcgagctggacttttctctgaccagctccagcaagtacacatatcggagacgccttaccaatcccctcgaggaaacgcaagccatcaacctgcacatcgagattgaggagcagacaatcggcgtggatgtgcatgctctgggacactggttcgacggccggctcaatctgaaaacctcttttcactgctacggggcctgtacaaagtatgagtacccgtggcataccgctaaatgccactatgaaagagattaccagtatgagacctcctggggatgcaaccctgccgactgtcccggcgtcgggacaggatgcacggcgtgtggcctttacctggaccagctcaagcccgttgggagcgcctacaaaattatcaccattcgctattcccggaaggtgtgcgtgcaattcggcgaagagaatctgtgtaaggtcatcgatatgaacgactgctttgtgtctagacatgttaaagtgtgtatcattggaacagtcagcaagttctcccagggcgataccctgctgtttttcgggcctctcgaaggaggcgggctgatctttaaacactggtgcacatctacctgtcagttcggagacccgggcgatattatgagcccccgcgacaaggggtttctgtgccctgagttccccggctccttccggaaaaagtgtaattttgctacgacacctctctgcgagtacgatggaaacatggtgtctggctataaaaaggttatggccaccatcgacagcttccagtcctttaacaccagcacaatgcatttcaccgatgaaagaattgagtggaaggaccccgatgggatgctgcgcgaccacatcaatatccttgtgacaaaagatattgactttgacaacctgggagaaaatccttgcaaggtcggcctccaaacgtcttccatcgagggggcttggggaagcggcgtggggttcaccctgacatgtctggtttctcttaccgaatgccccacatttctcacctccattaaagcctgtgataaggccatctgctacggcgctgagagcgtgacgctgacccggggacagaacacagtcaaagtgtctggcaaagggggacactccggcagcaccttcaagtgttgccatggggaggaatgttcccagattggactgcacgcggccgctccgcatctcgacaaggtgaatggcatcagcgagattgaaaacaataaggtctatgatgacggcgcccctcaatgcggggttaaatgttggtttgtgaagtctggagagtggatcagcggcatcttctccgggaactggattgtgctgatcgtcctttgcgtgtttcttctcttctctctggccctgcttagcgttctctgtcccgtgagacgccacaaaaagtcctga

SEQ ID NO: 13373 - RNA, 3408 nt, synthetic construct
  misc_feature 1..3408: note = derived and/or modified CDS sequence (opt5) from HTNV(ZLS-12)__FJ753399.1__GP
  source 1..3408: mol_type = other RNA
atgggcatctggaagtggctgattatggccagcctcgtgtggcccgcttacaccctgagaaacgtctatgacatgcggatcgagtgccctcacacagtttccttcggggaaaattctgtgattggatacgtggagcttccgcccatgcctctggccgatacgagccagatggtccccgaatcctcttgtagcatggacaaccatcaatccctcaataccatcacaaaatatacccaggtgtcttggcgcggcaaggcggatcagagccaggcttcccaaaacagctttgaggccgtttctgccgaagtggacctgaaagggacatgcgtccttaagcacaaaatgctggaggagtcctacagaagccggaagtctattacctgttatgatctctcctgcaatagcacatactgtaagcctaccctgtatatgatcgtgcccatccatgcttgcaacatgatgaaatcttgtctgattgccctcggaccttaccgcgttcaggtggtctacgaaagaacgtattgcatgaccggcatcctgattgaggggaagtgtttcgtgccggaccagtccgtggtcagcatcattaaacacggaatctttgatattgcttccgttcatatcgtgtgcttctttgtggccgtcaagggcaatacatacaaacttttcgaacaggtgaagaagtcttttcaaagcacctgtaacgacacagaggataaagttcagggctattacatctgcattgccgggggaaattccgcgcccatctatgtgcctaccctggacgatttccggagcatggaggctttttctggcattttcaagagcccccacggggaagaccacgatctcgccggagaggaaatcgctagctactctattgtcggccctgccaacgcgaaagtgccccatagcgcctcctctgacacgctgagccttacagcttattccgggatcccgagctactcttccctgagcatcctcacctcttccacagaggccaagcacgtttttagccctggattctttccccagctgaatcataccaaatgcgacaagaccgctattcctctgatgtggacaggcatgatcgatctccccggctactatgaagccattcacccctgtacggtgttctgcgtcctgtccgggcctggagcctcttgtgaggctttcagcgagggcgggatctttaacattacctccccgatgtgccttgtgtctaaacagaatcgcttcagactgacagaacaacaggtcaactttgtgtgtcagcgggttgacatggatatcgtggtctactgcaatggacaacgcaaggtgatcctcaccaagacactggttattggccagtgtatctataccattacgagccttttctccctgctccccggggtggcgcacagcatcgccgtcgagctgtgcgtgcctggatttcatggctgggctacagccgccctgctcgtgaccttctgttttggctgggttctgattcccgctatcaccttcattatccttacaatcctgaaatttattgccaacatcttccacacctctaaccaggaaaatagactcaagtccgtcctgcggaaaattaaggaggaatttgagaaaacaaaggggagcatggtgtgcgacgtgtgtaagtacgagtgcgaaacgtataaagagcttaaggcgcatggagtctcttgccctcagtcccaatgtccctactgcttcacccactgtgaaccgacagaggctgcctttcaggcccattatcgcgtgtgccaggttacccacagattccgggatgacctgaaaaagacagtgacccctcagaacttcacgcccggctgttaccgcaccctcaatctgtttagatacaaaagccggtgctatatcttcacaatgtgggtctttctgctcgtgctggaatctattctttgggctgccagcgcttccgaggttcctctgagccccgtgtggaacgataatgcccacggggtcggatctatccctatgcataccgacctcgagctggatttctccctgacaagctcctctaagtacacctatagacgcaaacttacgaaccccctcgaagagacacaagcgatcaatctgcacattgaaatcgaggagcagaccattggcgtggacgttcatgccctggggcactggtttgatggccggctcaacctgaagacatccttccactgttacggagcttgcaccaagtatgaatacccgtggcataccgccaaatgtcactatgagagagactaccagtacgaaacatcctggggctgcaatcctgctgactgtcccggggtgggaacgggctgcaccgcctgcgggctttatctggatcagctcaagcccgtcggatctgcgtacaaaatcattacaatccgctatagccggagagtgtgtgtgcaactgggcgaggaaaacctgtgcaagatcattgacatgaatgattgttttgtctcccgccatgttaaggtgtgcatcattgggaccgtgtctaaattcagccagggcgacacacttctctttttcggacctctggagggcgggggactgatctttaagcactggtgtacctccacgtgccagttcggcgatccgggggacattatgagcccccgggataaaggatttctctgtcctgagttccccggctctttcagaaagaaatgcaactttgccacaacccctctgtgtgaatacgacgggaatatggtctccggctataagaaagtgatggctaccatcgatagcttccagtcttttaacacatccaccatgcatttcacagacgagcgcatcaagtggaaggatcccgacggaatgcttcgggatcacattaatatcctggttacgaaagacattgactttgataacctcggcgaaaacccttgcaagatcgggctgcaaaccagcgccattgagggagcttggggctctggggtgggattcacactgacctgtcttgtctccctcacagaatgccccacctttctgacgagcatcaaagcctgcgacaaggccatttgttacggcgctgagtccgtgaccctgacaagagggcagaataccgttaaagtgagcggcaagggaggccactctgggagcctcttcaagtgctgtcatggagaggaatgctcccagatcggcctgcacgcggccgctccgcatcttgataaagtcaacgggatctctgagattgaaaataacaaggtgtatgacgatggagcccctcaatgtggcgttaaatgctggtttgtcaagagcggcgagtggatctccgggattttctctggaaattggatcgtgctgattgtgctctgtgtgtttctgctgttcagccttgtcctcctgtccgttctgtgccccgtgcgcaaacacaagaagtcttga

SEQ ID NO: 13374 - RNA, 3408 nt, synthetic construct
  misc_feature 1..3408: note = derived and/or modified CDS sequence (opt5) from HTNV(ZLS6-11)__FJ753397.1__GP
  source 1..3408: mol_type = other RNA
atgggcatctggaagtggctgattatggccagcctcgtgtggcccgcttacaccctgagaaacgtctatgacatgcggatcgagtgccctcacacagtttccttcggggaaaattctgtgattggatacgtggagcttccgcccatgcctctggccgatacgagccagatggtccccgaatcctcttgtagcatggacaaccatcaatccctcaataccatcacaaaatatacccaggtgtcttggcgcggcaaggcggatcagagccaggcttcccaaaacagctttgaggccgtttctgccgaagtggacctgaaagggacatgcgtccttaagcacaaaatgctggaggagtcctacagaagccggaagtctattacctgttatgatctctcctgcaatagcacatactgtaagcctaccctgtatatgatcgtgcccatccatgcttgcaacatgatgaaatcttgtctgattgccctcggaccttaccgcgttcaggtggtctacgaaagaacgtattgcatgaccggcatcctgattgaggggaagtgtttcgtgccggaccagtccgtggtcagcatcattaaacacggaatctttgatattgcttccgttcatatcgtgtgcttctttgtggccgtcaagggcaatacatacaaacttttcgaacaggtgaagaagtcttttcaaagcacctgtaacgacacagaggataaagttcagggctattacatctgcattgccgggggaaattccgcgcccatctatgtgcctaccctggacgatttccggagcatggaggctttttctggcattttcaagagcccccacggggaagaccacgatctcgccggagaggaaatcgctagctactctattgtcggccctgccaacgcgaaagtgccccatagcgcctcctctgacacgctgagccttacagcttattccgggatcccgagctactcttccctgagcatcctcacctcttccacagaggccaagcacgtttttagccctggattctttccccagctgaatcataccaaatgcgacaagaccgctattcctctgatgtggacaggcatgatcgatctccccggctactatgaagccattcacccctgtacggtgttctgcgtcctgtccgggcctggagcctcttgtgaggctttcagcgagggcgggatctttaacattacctccccgatgtgccttgtgtctaaacagaatcgcttcagactgacagaacaacaggtcaactttgtgtgtcagcgggttgacatggatatcgtggtctactgcaatggacaacgcaaggtgatcctcaccaagacactggttattggccagtgtatctataccattacgagccttttctccctgctccccggggtggcgcacagcatcgccgtcgagctgtgcgtgcctggatttcatggctgggctacagccgccctgctcgtgaccttctgttttggctgggttctgattcccgctatcaccttcattatccttacaatcctgaaatttattgccaacatcttccacacctctaaccaggaaaatagactcaagtccgtcctgcggaaaattaaggaggaatttgagaaaacaaaggggagcatggtgtgcgacgtgtgtaagtacgagtgcgaaacgtataaagagcttaaggcgcatggagtctcttgccctcagtcccaatgtccctactgcttcacccactgtgaaccgacagaggctgcctttcaggcccattatcgcgtgtgccaggttacccacagattccgggatgacctgaaaaagacagtgacccctcagaacttcacgcccggctgttaccgcaccctcaatctgtttagatacaaaagccggtgctatatcttcacaatgtgggtctttctgctcgtgctggaatctattctttgggctgccagcgcttccgaggttcctctgagccccgtgtggaacgataatgcccacggggtcggatctatccctatgcataccgacctcgagctggatttctccctgacaagctcctctaagtacacctatagacgcaaacttacgaaccccctcgaagagacacaagcgatcaatctgcacattgaaatcgaggagcagaccattggcgtggacgttcatgccctggggcactggtttgatggccggctcaacctgaagacatccttccactgttacggagcttgcaccaagtatgaatacccgtggcataccgccaaatgtcactatgagagagactaccagtacgaaacatcctggggctgcaatcctgctgactgtcccggggtgggaacgggctgcaccgcctgcgggctttatctggatcagctcaagcccgtcggatctgcgtacaaaatcattacaatccgctatagccggaaggtgtgtgtgcaatttggcgaggaaaacctgtgcaagatcattgacatgaatgattgtttcgtctccagacatgttaaagtgtgcatcattgggaccgtgtctaagtttagccagggcgacacactgcttttctttggacctctcgagggcgggggactgatcttcaaacactggtgtacctccacgtgccagtttggcgatccgggggacattatgagcccccgcgataagggattcctgtgtcctgagttccccggctcttttcggaaaaagtgcaacttcgccacaacccctctctgtgaatacgacgggaatatggtctccggctataaaaaggtgatggctaccatcgatagctttcagtctttcaacacatccaccatgcattttacagacgagagaatcgaatggaaggatcccgacggaatgctgcgcgatcacattaatatccttgttacgaaagacattgacttcgataacctgggcgagaacccttgcaagatcgggctccaaaccagcgccattgaaggagcttggggctctggggtgggatttacactgacctgtctggtctcccttacagagtgccccaccttcctcacgagcatcaaagcctgcgacaaggccatttgttacggcgctgagtccgtgaccctgacacgggggcagaataccgttaaagtgagcggcaagggaggccactctgggagcctgtttaagtgctgtcatggagaagagtgctcccagatcggcctccacgcggccgctccgcatctggataaagtcgacgggatctctgaaattgagaacaataaggtgtatgatgacggagcccctcaatgtggcgttaaatgctggttcgtgaagtctggcgaatggatctccgggatttttagcggaaactggatcgtccttattgtgctgtgtgtgttcctcctgttcagcctggtccttctctccgttctgtgccccgtgagaaaacacaagaagtcttga

SEQ ID NO: 13375 - RNA, 3408 nt, synthetic construct
  misc_feature 1..3408: note = derived and/or modified CDS sequence (opt5) from HTNV__AB030232.1__GP
  source 1..3408: mol_type = other RNA
atgggcctgtggaagtggctcatcatggccgtgctggtctggccctgcttcgctcttagaaacgtttacgacatgaaaattgagtgtcctcacaccgtgaattttggggaaaacagcgtggtcggatatgtggagctgccgcccatgcctatcgccgatattacacagatgatgcccgaatcctcttgcagcatggacaatcatcaatccctcaacacgatcaccaagtacacacaggtttcttggcggaaaaaggcggatcgcgctcagagctcccagacctctttcgagacagtgagctccgaagtcgactttaaaggcacctgtgtgctgaagcacaagatggttgaggatagctatagatctcggaaatccattatctgctacgaccttagctgtaattctacattctgcaagcctaccctgtatctcatcgtgcccgtccatgcctgtaacatgatgaaatcctgcctgattgccctggggccttaccgcgtgcaagatgtgtatgagagaacgtactgtatgagcggagtcctcctggaaggcaagtgctttgttccggaccggtctgtggtgtccatcattaaacacgggatcttcgatattgctagcgtccatatcgtgtgctttttcgttgccattaagggatccacctacaagatccttgaacaggtgaaaaagtcttttgagctgacatgtaatgacaccgataacaaaatccagggctattacatttgcctcgtcggcgggaatagcgctcccatctatgtgcctacactggacgatttccgctccatggaggcctttgcgggaattttcaagagcccccacggcgaggaccacgaccttgccggggaagaggttgcttcttactccatcgtgggacctgccaacgctaaagtcccccatagcgcctctgcggataccctgagcctcgtggccttttccggcattccgtcttatagctccttcagcgtcctgacggggtctacagacgctagacacgtgttctcccctggatttttcccccagctgaatcaaacccggtgtgataagacagccatccctctcacctggaccggcatgatcgacctgcccggctactatgaagctgttcatccctgcacagtgttttgtgtccttagcgggcctggagcctcttgcgaggccttctccgaaggcgggatttttaacatcacgagcccgatgtgtctggtgtccgagcagaatcgcttcagatctagcgagcagcaggttaactttgtgtgccaacgggtcgatatggacattgtggtgtactgtaatggacagaaaaaggttatcctcaccaagacactggtcattggccagtgcatctacaccatcacatcccttttctctctgctccccggggtggctcacagcattgcggtggaactgtgtgtccctggatttcacggctgggccaccgctgccctgctcgtgacgttctgctttggctgggttctgatccccgccgtgacacttgtcattctgaccatcctcaaattcattgctaacatctttcatacctccaaccaagagaatcgcctgaagtccgtgcttaaaaagattaaagaagagttcgaaaagacaaaggggtctatggtttgtgatgtgtgcaaatatgagtgcgagacctacaaggaactgaaagcccacggagtctcctgtcctcagagccagtgcccctattgtttcacacattgcgagccgacggaagcggcttttcaggcccactacaaggtgtgtcaagttacccatagattccgggacgatctcaaaaagacagtgacccctcagaactttacacccggctgctatcgcaccctgaatctgttcagatacaagtctcggtgttatatctttacgatgtgggtcttcctcctgatccttgagtccattctgtgggccgctagcgcctctgaaacccctagcacacccatctggaacgacaatgctcacggggtgggatccattcctatgcacaccgatctcgagctggactttagcctgacatcttccagcaaatacacctacagacgcaaacttacgaaccccctcgagaaaacacaggccgtggacctgcatatcgaactggcggtccagaccattggcgttgatgtgcacgccctcgggcattggttcgacggccggctgaatcttaagacatcctttcactgctatggagcttgtaccaaatacgagtatccgtggcacaccgccaagtgccattacgaaagagattatcaatacgagacatcttggggctgtaaccctgctgactgccccggggtgggaacgggctgcaccgcctgtgggctgtatctcgatcagctgaagcccgtcggaagcgcgtacaaaatcatcacaattaagtactcccgccgggtgtgcgttcagttcggcgaggaaaatctgtgtaaagtgatcgacatgaacgattgctttgtctctagacacgtgaagatttgtatcattgggaccgttagcaaattctcccagggcgacacacttctctttttcggacctctggagggcgggggactgatcttcaagcattggtgcacctctacgtgtcaatttggcgatccgggggacatcatgagcccccgcgataaaggattcctctgccctgaatttcccggctccttccggaagaagtgtaattttgccacaacccctgtgtgcgagtatgacgggaacatggtcagcggctacaaaaaggtgatggctaccattgattctttccagtcctttaatacaagcatgatgcacttcaccgacgaaagaatcgagtggaaagaccccgatggaatgctgcgcgaccatattaacatccttgttacaaaggatattgactttgataatctgggcgacaacccttgtaaagtggggctccagacgtctgccatcgagggagcttggggctccggggtcggattcaccctgacatgccaggtgagcctgaccgaatgccccacatttcttacctctatcaaggcctgtgataaggccatttgctatggcgctgagtccatcacgctcacccgggggcaaaacacagtgaaagtcagcggcaagggaggccactccgggagcaccttcaaatgttgccacggagaagagtgttctcagattggcctgcatgcggccgctccgcacctggacaaggttaatgggatcagcgaaatggagaactccaaagtgtacgatgacggagcccctgagtgcggcattaagtgttggttcgtgaagtctggcgaatggatcagcgggatttttaatggaaactggatcgtcctcatcgtgctgtgcgccttccttatttttagcctggttctcctgtctctgctttgtcccgtgagaaaacataagaaggcttga

SEQ ID NO: 13376 - RNA, 3408 nt, synthetic construct
  misc_feature 1..3408: note = derived and/or modified CDS sequence (opt5) from HTNV__AB620032.1__GP
  source 1..3408: mol_type = other RNA
atgggcatgtggaagtggctggtgatcgccagcctcgtctggcccgttctggctcttagaaacgtgtacgacatgaaaattgagtgccctcacaccgtgtccttcggggaaaattctgtcatcggatttgtggagctgccgcccatgcctctcgccgatacagcgcagatggttcccgaaagctcctgttctatggacaaccatcaaagcattaatacgatcaccaagtatacacaggtgacctggcggggcaaagctgatcctgggcagtcctctcagaacagcttcgagacagtctccaccgaagtggacctgaagggaacatgcgttcttaaacacaagatggtggaggagagctaccgctctagaaagtccattacctgttatgatctgagctgcaattctacgtactgtaaacccaccctctatatgatcgtccctatccatgcctgcaacatgatgaagtcctgtctgattgccctgggcccgtaccgggtgcaagtggtctatgaacgcacatactgcatgaccggggttctcatcgagggaaaatgttttgtgcccgaccagagcgtggtctctattatcaagcacggcattttcgatatcgcttccgtgcatattgtttgctttttcgtggccatcaaaggcaatacatacaagctgtttgaacaggtcaagaaatctttcgagtccacctgtaacgacacggagaataaggtgcaggggtattacatctgcattgttggaggcaactctgctcctatctatgtgcccacacttgatgactttagaagcatggaagccttcaccgggatttttaaatcccctcacggagaggatcacgacctggcgggcgaagagatcgccagctactctattgtcgggcccgctaatgccaaggtgccgcattccgctagctctgatacactcagcctgatcgcctattccggaatcccttcttacagctcccttagcattctgacctcttccaccgacgcgaaacacgtcttcagccccggcctctttcctaagctgaaccatacaaattgcgacaaatctgccatccccctgacgtggaccggcatgattgatctccccgggtattacgaagctatccacccttgtacagtgttctgcgttctgtccggaccgggcgccagctgtgaggctttctccgaagggggaatttttaacatcacctctcccatgtgccttgtgagcaagcaaaatcggttccgcctgacagagcagcaggtcaactttgtgtgtcagagagttgacatggatatcgtggtctactgcaacggccaacggaaggtgattctcaccaaaacgctggtgatcgggcagtgtatttatacaatcacctcccttttctctctgctccctggagttgcccacagcattgccgtcgagctgtgcgtgcccggctttcatggctgggctaccgcggccctgctcgtgacattctgttttgggtgggtcctgatccctgctgtgaccttcgttattcttacaatcctgaagtttgtggccaatatcttccacacgtccaaccaggaaaatcgcctcaaaagcgtcctgagaaagattaaagaggaatttgagaagaccaagggatctatggtgtgcgacgtttgtaaatacgagtgcgaaacatataaggagcttaaagcccatggcgtgtcctgcccccaaagccagtgtccgtactgcttcacccactgtgaacctacagaggctgcctttcaggcgcattataaggtctgccaggtgacccaccggttccgcgatgacctgaaaaagacggttacaccccaaaacttcacccctgggtgttacagaaccctcaatctgtttcggtataagtctcgctgctacatcttcacaatgtgggtgtttctgctcattctggaatccgtcctttgggctgccagcgcctctgagacgcccctggctcctgtgtggaacgataatgcccacggagtgggcagcgtccccatgcataccgacctcgagctggatttctccctgacaagcagctccaaatacacctatagacggaaacttacaaacccgctcgaagaggctcagagcatcgacctgcacattgaaatcgaggagcagaccatcggggttgatgtgcatgccctgggccactggtttgacggaagactcaatctgaagacctccttccactgttacggcgcgtgcacaaagtatgaatacccttggcatacggccaaatgtcactatgagcgcgactaccagtatgaaacctcttgggggtgcaaccccagcgattgtcccggagtgggcacagggtgcaccgcttgcggactttacctggaccaactcaagcctgtcggctccgcctacaagattatcacaattcggtattctagacgcgtgtgtgttcagtttggggaggaaaatctgtgcaaaatcattgatatgaacgactgtttcgtgagccggcatgtcaaggtgtgcatcatcggcaccgtttccaaattttctcagggagatacgctgcttttctttggcccgctcgaagggggaggcctgattttcaagcactggtgtacaagcacatgccagtttggggaccccggagatatcatgtcccctagagacaaaggcttcctgtgtcccgagttccctgggagctttcgcaagaaatgcaatttcgctaccacccccatttgtgagtacgatggcaacaccgtgtctggatataagaaggtcatggccacaatcgactcctttcagagcttcaatacgtctaccatgcattttacagatgagcggattgaatggaaagaccctgatggcatgctcagagaccacatcaacatcctggtgaccaaggacattgatttcgacaaccttggggagaatccctgcaaaatcggactgcaaacatccagcattgaaggcgcgtgggggtctggagttggctttaccctcacgtgtctggtgtccctgaccgagtgcccgacattccttaccagcatcaaggcctgcgataaagctatttgttacggggccgagtccgtcacactcacccgcggccagaacacagtgaaggtgagcggaaagggcgggcactctggaagcacctttaaatgctgtcatggcgaagactgctcccagatcgggctgcacgctgccgcccctcatctggataaggtcaatggaatttctgagatcgaaaacagcaaagtttatgacgatggcgctccccaatgtggcatcaagtgctggttcgtgaaatccggggagtggatttctggaatctttagcggcaattggattgtgctcatcgtcctgtgtgtgttccttctgttctccctcgttctgctgtctattctttgccctgtgcggaagcacaagaaaagctga

SEQ ID NO: 13377 - RNA, 3408 nt, synthetic construct
  misc_feature 1..3408: note = derived and/or modified CDS sequence (opt5) from HTNV__D25532.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcgggggaaattctgtcatcggctatgtggaactgccgcccgttcctctcgctgatacggcccagatggtgcccgagagctcctgttctatggacaaccatcaaagcctgaataccattacaaagtacacccaggtctcctggcgggggaaagcggatcagtctcagagctcccaaaacagctttgaaacagtgtctaccgaggttgaccttaagggaacatgcgtgctgaaacacaagatggtcgaagagtcctatcgcagcagaaagtctgtgacctgttacgatctctcctgcaatagcacgtattgtaaacctaccctgtacatgatcgtgcccattcatgcttgcaacatgatgaagtcttgtctgatcgccctcggcccttatcgggtccaggttgtgtacgagcgcacatactgcatgaccggggtgctgatcgaaggaaaatgtttcgtcccggaccagtccgtggttagcattatcaagcacggcatttttgatatcgcctccgtgcatattgtctgcttctttgtggctgttaaaggcaatacatataagatcttcgaacaggtgaagaaatcttttgaaagcacctgtaacgacacggagaataaggtccaagggtactatatttgcatcgtgggaggcaactccgcccccatctacgtccctacacttgatgacttcagaagcatggaggcttttaccgggattttccggtctccccacggagaagatcacgacctggccggcgaggaaatcgcgtcctatagcattgtggggcctgccaatgctaaagttccccattctgccagctccgatacactccgcctgatcgcttactctgggattccgagctattccagcctttctatcctgacctccagcaccgaggccaagcacgtgttttctcctggcctcttccccaaactgaaccatacaaattgcgacaagtccgcgatccctctgatttggacgggcatgatcgacctccccgggtactacgaagccgtccacccctgtaccgtgttttgcgttctgagcggacctggcgcttcctgtgaggccttctctgagggaggaattttcaacatcacaagctccatgtgccttgtgtctaaacagaatagatttcggctgaccgaacagcaggtcaacttcgtgtgtcaacgcgtggatatggacattgttgtctattgcaacggccagagaaaggtgatcctcacaaagaccctggtgatcgggcagtgtatttacacgatcacaagcctgttttcccttctcccgggagtcgctcacagcattgccgtggagctgtgcgttcccggcttccatggctgggccaccgctgcgctgctcgtgaccttttgtttcgggtgggtcctgatccctgccattacatttatcattcttaccgtgctgaaattcatcgctaatatctttcacacatctaaccaagaaaatcggctcaagtccgttctgcgcaaaattaaggaggagttcgagaaaacgaagggaagcatggtgtgcgatgtctgtaagtatgagtgcgaaacctacaaagagcttaaggcccatggcgtgtcttgcccccagtcccagtgtccttattgctttacacactgtgaacccaccgaggccgctttccaggcccattacaaagtttgccaagtgacacacagatttcgggacgatctgaagaaaaccgtcacgccgcagaacttcacccctgggtgttatcgcacactcaatctgttcagatacaagagccggtgctacatctttaccatgtggattttcctgctcgtgctggaatctatcctttgggcggctagcgcctccgagacacccctgacccctgtgtggaacgacaatgcccacggagtcggcagcgttcccatgcatacggatctcgagctggacttttctctgacatccagctccaagtatacctacagacgcaaacttacaaaccctctcgaagaggctcagtctattgatctgcacatcgaaatcgaggagcagaccattggggtggacgtgcatgccctgggccactggttcgatggacggctcaatctgaagaccagctttcactgttatggcgcttgcacaaaatacgaatatccctggcatacggccaagtgtcactacgagagagactatcaatacgaaacctcctgggggtgcaacccgtctgactgtcctggagtcggcacagggtgcaccgcgtgcggactttacctggatcagctcaaacccgtgggcagcgcctataagatcattacaatccgctactcccggagagtttgtgtgcagttcggggaggaaaatctgtgcaagattatcgacatgaacgattgttttgtctctcgccatgtgaaagtttgcatcattggcaccgtgagcaagttctcccagggagacacgctgctctttttcggcccccttgaagggggaggcctgatctttaaacactggtgtacatctacctgccaattcggggatcctggagacattatgagcccgcgggataagggctttctgtgtcccgagttccctgggtccttcagaaagaagtgcaattttgctaccacacccatctgtgagtatgacggcaacatggtcagcggatacaaaaaggtgatggccaccattgattctttccagtcctttaatacaagcacgatgcatttcaccgacgagcgcatcgaatggaaggatcctgacggcatgctccgggatcacatcaacattctggttacaaaagacatcgactttgataaccttggggagaatccctgcaagattggactgcagacctcttccatcgaaggcgcttgggggagcggagtgggcttcacactcacctgtctggtctccctgacggagtgccctacctttcttacaagcattaaagcctgcgacaaggcgatctgttatggggccgagtctgtgaccctcacaagaggccagaacaccgtgaaagtcagcggaaagggcgggcactccggatctacattcaagtgctgtcatggcgaagattgcagccaaattgggctgcacgctgccgctccccatctggacaaagttaatggaatctccgagatcgaaaactctaaggtgtacgatgacggcgccccgcagtgtggcattaaatgctggtttgtgaaaagcggggagtggatctccggaattttctctggcaattggatcgtcctcattgtgctgtgtgtttttcttctgttcagcctcgtgctgctggggatcctttgccctgtccgcaaacacaagaagtcctga

SEQ ID NO: 13378 - RNA, 3408 nt, synthetic construct
  misc_feature 1..3408: note = derived and/or modified CDS sequence (opt5) from HTNV__L08753.1__GP
  source 1..3408: mol_type = other RNA
atgggcatctggaagtggctggtgatggccagcctcgtctggcccgcttacaccctgagaaacgtttatgacatgaaaattgagtgccctcacacagtgtccttcggggaaaattctgtgatcggatacgtcgagcttccgcccattcctctggccgatacgacccagatggtgcccgaaagctcctgttctatggacaaccatcaaagcctcaatacagttaccaagtatacacaggtgtcctggcggggcaaagcggatcaggctcaggcctctcaaaacagctttgaggccgtctccgctgaagtggacctgaaggggacctgcgttcttaaacacaagatgctggaggagagctaccgctctagaaagtccatcgcctgttatgatctcagctgcaattctacatactgtaaacctaccctgtatatgattgtgcccatccatgcttgcaacatgatgaagtcctgtctgatcgccctcggacctcaccgggtccaggtggtgtacgaacgcacgtactgcatgaccggcgtcctgattgaggggaaatgtttcgttccggaccagagcgtggtgtctatcattaagcatggaatctttgatattgcgtccgtccacatcgtgtgcttctttgttgccgtgaaaggcaatacatataagattttcgaacagatcaagaaatcctttgagtccacctacaacgacacaaagaataaagtcgagggctattacatctgtattgttgggggaaactctgctcccatctatgtgcctacccttgatgacttcagaagcatggaagccttttccggcattttccggagcccccacggggaggatcatgacctggctggagaagagatcgcctcttactccattgtgggccctgcgaatgtcaaggtgccccacagcgcctctagcgatacgctctccctgacagcttattctgggatcccgagctactccagcctttctatcctggccggatccgctgaagccaaacatgtctttagccctggcttctttccccaactcaaccacaccaagtgcgacaaaacagccattcctctgatgtggaccggcatgatcgacctgcccgggtactatgaggctattcacccctgcaccgtgttctgtgttctctctggacctggcgcgtcctgcgaggccttcagcgaagggggaatctttaatattacatccccgatgtgtctggtgtctaagcagaaccgcttcagacttacggagcagcaggtcaattttgtgtgccaacgggttgatatggacatcatcgtgtactgtaacggccagcgcaaggtcattctgaccaaaacactcgtgatcgggcagtgcatttataccatcacaagcctgttctcccttctgcccggagtggctcattctattgccgttgaactctgtgtccctggctttcacggctgggccaccgctgccctgctggtgacgttctgctttgggtgggtgctcatccccgcgatgacattcattgtcctgaccatccttaagtttatcgctaacattttccataccagcaatcaagagaacaaactgaagtccgtgctcagaaaaatcaaggaagagtttgagaagacaaaaggaagcatggtttgtgatgtgtgcaagtacgaatgtgagacctataaagaactgaaggcccacggcgtctcttgccctcagtcccagtgcccctactgtttcacacattgcgagccgacggaagccgcttttcaggcccactatcgggtgtgtcaagttacccaccgcttcagagacgatcttaaaaagacagtgacccctcagaatttcacacccgggtgctaccggaccctgaacctctttcgctacaagagcagatgttatattttcacgatgtgggtctttctgctggtgctcgagtctatcctgtgggctgcctccgcgagcgagattcctctttaccccgtttggaatgacaacgcccatggagtgggctctgtccctatgcacaccgatctggaactcgacttcagcctgacatccagctctaaatatacctaccggagaaagctgacaaatccccttgaggaatcccaggctatcaacctccatatcgagattgaggaacagaccatcggggtggatgtgcacgccctgggccactggtttgacggacgcctgaatctcaaaacgagcttccattgctatggcgcttgtacaaagtacgagtatccgtggcacaccgccaaatgccattacgatcgggactaccaatatgaaacatcctgggggtgtaacccttctgactgccccggagtcggcaccgggtgtaccgcgtgcggactgtaccttgatcagctgaagcccgttggcagcgcctataagattatcacaattagatactcccgccgggtgtgcgtgcagtttggggaggaaaatctctgtaaaatcatcgacatgaacgattgcttcgtctctagacacgtgaaggtttgtattatcggcacggtgagcaaattttcccagggagacaccctgctgttctttggccctcttgaagggggaggcctcattttcaagcattggtgcacatctacctgtcaatttggggatccgggagacatcatgagcccccgcgataaaggcttcctgtgccctgagttccccgggtcctttcggaagaaatgtaatttcgctacaacccctctgtgcgagtatgacggcaacatggtcagcggatacaagaaggtgatggccacgattgattcttttcagtccttcaatacaagcaccatgcactttaccgacgagagaatcgaatggaaagatcccgacggcatgctccgcgatcacatcaacattctggttacaaaggacatcgacttcgagaaccttggggaaaatccttgtaaaattggactgcagacctcttccatcgagggcgcttgggggagcggagtgggctttacactcacgtgcctggtctctctgaccgagtgtcccacattccttacctccattaaggcctgcgataaagccatctgctatggggctgaaagcgtgacactcacccggggccagaacacggttaaggtgtccggaaagggcgggtacagcggatctacctttaaatgttgccatggcgaggaatgtagccaaattgggctgcacgcggccgctccgcatctggacaaggtcaatggaatctccgagatcgaaaacaataaagtgtacgatgacggcgcccctcagtgcggcattaagtgttggttcgtgaaatctggggagtggatcagcggaatttttagcggcaactggatcgtcctcattgttctgtgcgtgttccttctgttctctctcatcctgctgagcatcctttgtcccgccagaaagcacaagaaatcctga

SEQ ID NO: 13379 - RNA, 3408 nt, synthetic construct
  misc_feature 1..3408: note = derived and/or modified CDS sequence (opt5) from HTNV__M14627.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccgttcctctcgctgatacggcccagatggtgcccgaaagctcctgtaacatggacaatcatcaatctctgaacaccattacaaagtacacccaggtcagctggcggggcaaagcggatcagtcccagtctagccaaaattcctttgagacagtgagcaccgaagttgaccttaaggggacatgcgtgctgaaacacaagatggtcgaggagtcttatcgctccagaaagagcgtgacctgttacgatctctcttgcaactccacgtattgtaaacctaccctgtacatgatcgtgcccattcatgcttgcaatatgatgaagtcctgtctgatcgccctcggaccttatcgggtccaggttgtgtacgaacgctcttactgcatgacaggcgtgctgatcgaggggaaatgtttcgtcccggaccagtccgtggttagcattatcaagcacggaatttttgatatcgcctccgtgcatattgtctgcttctttgtggctgttaaaggcaacacctataagatcttcgaacaggtgaagaaatcttttgagagcacatgtaatgacaccgagaacaaggtccaaggctactatatttgcatcgtcgggggaaattccgcccccatctacgtgcctacgcttgatgacttcagaagcatggaggcttttacaggcattttccggtctccccacggggaggatcacgacctggccggagaagagatcgcgtcctatagcattgtgggccctgccaacgctaaagttccccattctgccagctccgataccctctctctgatcgcttacagcgggattccgtcctatagctctctttccatcctgacaagctctaccgaagccaagcacgtgttttcccctggactcttccccaaactgaatcataccaactgcgacaagagcgcgatccctctgatttggacaggcatgatcgacctccccggctactacgaggccgtccacccctgtacggtgttttgcgttctgtccgggcctggagcttcttgtgaggccttcagcgaaggcgggattttcaatatcacctccccgatgtgccttgtgtctaaacagaaccgctttagactgacagagcagcaggtcaacttcgtgtgtcaacgggtggatatggacattgttgtctattgcaatggacagcgcaaggtgatcctcaccaagacactggtgatcggccagtgtatttacaccatcacgagcctttttagcctgctccccggggtcgctcacagcattgccgtggaactgtgcgttcctggattccatggctgggccacagctgcgctgctcgtgaccttttgtttcggctgggtcctgatccccgccattacctttatcattcttacagtgctgaaattcatcgctaacatctttcacacctctaatcaagagaacagactcaagtccgttctgcggaaaattaaggaagagttcgagaaaacaaaggggagcatggtgtgcgatgtctgtaagtatgaatgcgagacgtacaaagaacttaaggcccatggagtgtcttgccctcagtcccagtgtccctattgctttacccactgtgagccgacagaagccgctttccaggcccattacaaagtttgccaagtgacccaccgctttagagacgatctgaagaaaacagtcacccctcagaatttcacgcccggctgttatcggaccctcaacctgttccgctacaagagcagatgctacatctttacaatgtggattttcctgctcgtgctggagtctatcctttgggcggctagcgcctccgagacccctctgacacccgtgtggaatgacaacgcccacggggtcggaagcgttcctatgcataccgatctcgaactggacttttctctgacgtccagctccaagtatacataccggagaaaacttaccaatcccctcgaggaagctcagtctattgatctgcacatcgagatcgaggaacagacaattggcgtggacgtgcatgccctggggcactggttcgatggccgcctcaacctgaagaccagctttcactgttatggagcttgcaccaaatacgagtatccgtggcatacagccaagtgtcactacgaacgggactatcaatacgagacgtcctggggctgcaatccttctgactgtcccggggtcggaaccggctgcacagcgtgcgggctttacctggatcagctcaaacccgtgggaagcgcctataagatcattaccatcagatactcccgccgggtttgtgtgcagttcggcgaagagaacctgtgcaagattatcgacatgaatgattgttttgtctctagacatgtgaaagtttgcatcattgggacagtgagcaagttctcccagggcgacaccctgcttttcttcggacctctcgagggcgggggactgatctttaaacactggtgtacgagcacatgccaattcggcgatccgggggacattatgtctccccgcgataagggatttctgtgtcctgaatttcccggctccttccggaaaaagtgcaactttgctaccacccctatctgtgagtatgacgggaatatggtcagcggctacaaaaaggtgatggccacaattgattctttccagtcctttaacaccagcacaatgcatttcacggacgaaagaatcgagtggaaggatcccgacggaatgctccgcgatcacatcaacattctggttaccaaagacatcgactttgataatcttggcgaaaacccttgcaagattgggctgcagacatcttccatcgagggagcttggggcagcggggtgggattcaccctcacatgtctggtctccctgaccgagtgccccacgtttcttaccagcattaaagcctgcgacaaggcgatctgttatggcgccgaatctgtgacactcacccgggggcagaatacagtgaaagtcagcggcaagggaggccactccgggtctaccttcagatgctgtcatggagaggattgcagccaaattggcctgcacgctgccgctccgcatctggacaaggttaacgggatctccgaaatcgaaaattctaaagtgtacgatgacggagcccctcagtgtggcattaagtgctggtttgtgaaaagcggcgaatggatctccgggattttctctggaaactggatcgtcctcattgtgctgtgtgtttttcttctgttcagcctcgtgctgctgtccatcctttgccccgtccgcaagcacaaaaagagctga

SEQ ID NO: 13380 - RNA, 3408 nt, synthetic construct
  misc_feature 1..3408: note = derived and/or modified CDS sequence (opt5) from HTNV__EU074672.1__GP
  source 1..3408: mol_type = other RNA
atgggcatctggaagtggctggtgatggccagcctcgtctggcccgctttcgccctgagaaacgtttacgacatgaaaattgagtgccctcacaccgtgtcctttggggaaaattctgtgatcggatatgtcgagcttccgcccatgcctctggcggatacaacgcagatggtgcccgaaagctcctgttctatggacaaccatcaaagcctcaataccattacaaagtacacccagatcatttggcggggcaaagctgatcagtcccagtctagccaaaactccttcgagacagttagcaccgaagtggacctgaaggggacatgcgtccttaaacacaagatgatcgaggagtcttatcgctccagaaagagcatcacctgttacgatctgtcttgcaattccacgtattgtaaacctaccctctacatgattgtgcccatccatgcctgcaacatgatgaagtcctgtctgattgccctgggaccttatcgggttcaggtggtctacgaacgcacatactgcatgaccggcgtgctcatcgaggggaaatgttttgtgccggaccagtctgtcgtttccattatcaagcacggaattttcgatatcgctagcgtgcatatcgtgtgctttttcgtcgccgtgaaaggcaatacatataagatttttgaacaggttaagaaatccttcgagtctaactgtaatgacaccgagaacaaggtgcaaggctactatatctgcattatcgggggaaatagctcccccgtctacgtgcctacgctggatgactttagaagcatggaggctttctctggcatttttcggagcccccacggggaggatcacgaccttgccggagaagaggttgcgagctattctatcgtgggccctgccaacgctaaagtcccccatagcgcctcctctgatacactggggctcatcgcttacagcggcattccgtcctatagctctctgtccatccttaccagctctacagaagccaagcacgtgttctcccctggactgtttccccagctcaatcataccaaatgcgacaagaccgcgattcctctgacatggacgggcatgatcgacctgcccgggtactacgaggccattcacccctgtaccgtcttctgcgtgctcagcggacctggcgcttcctgtgaggccttctctgaagggggaatctttaacatcacaagcccgatgtgcctggtttccaaacagaatcgcttcagacttaccgagcagcaagtgaactttgtctgtcagcgggtggatgttgacattatcgtgtattgcaacggccagcgcaaggtcattctgacaaagaccctcgtgatcgggcaatgtatttacacgatcacatctctgttcagccttctgcccggagtggctcactccattgccgttgaactctgcgtccctggctttcatggctgggccaccgctgcgctgctggtgaccttctgttttgggtgggtgctcatccccgccatcacattcattatcctgaccattcttaaatttatcgctaatattttccacacaagcaaccaggagaatagactgaagtctgtcctccggaaaatcaaggaagagtttgagcgcacgaaaggatccatggtgtgcgatatctgtaagtatgaatgcgagacctacagagaactgaaggcccatggcgttagctgccctcagtctcagtgtccctattgcttcacacactgtgagccgaccgaagccgcttttcaagcccattacaaagtgtgccaggtcacacaccggttccgcgacgatcttaagaaaaccgtgacgcctcagaacttcacccccgggtgttatagaacactgaatctctttcggtacaagtccagatgctacattttcaccatgtgggtttttctgctggtgctcgagagcatcctgtgggcggcttctgccagcgagattcctcttaaccccgtctggaatgacaacgcccacggagtgggctccatccctatgcatacagatctggaactcgacttcagcctgacctcttccagcaaatatacgtaccgccggaagctgacaaatccccttgaggaatcccaggctattgatctccacgttgagatcgaggaacaaaccatcggggtggacgtccatgccctgggccactggtttgatggaagactgaacctcaagacatctttccactgttatggcgcttgcaccaaatacgagtatccgtggcataccgccaagtgtcactacgaacgcgactatcagtacgagacaagctgggggtgcaatccttccgactgtcccggagtgggcacggggtgcaccgcgtgcggactgtaccttgatcagctgaaacccgtgggctctgcctataagattatcacaattcggtacagcagacgcgtctgtgttcagtttggggaagagaacctctgcaaaatcattgacatgaatgattgtttcgtgtcccggcatgtgaaggtctgcatcatcggcaccgtgtctaagtttagccaaggagacacactgctgttctttggccctcttgaagggggaggcctcattttcaaacactggtgtacctccacgtgccagtttggggatccgggagacatcatgagccccagagataagggcttcctgtgtcctgaatttcccgggtcttttcgcaaaaagtgcaacttcgctacaacccctgtttgtgagtatgacggcaatatggtgtccggatacaaaaaggtcatggccaccattgatagctttcagtctttcaacacatccaccatgcattttacagacgaacggatcgagtggaaagatcccgacggcatgctgagagatcacattaacatcctcgtgacgaaggacattgacttcgataatctgggggaaaacccttgcaagatcggacttcagaccagctctatcgagggcgcttgggggtccggagttggctttacactgacctgtctcattagcctgacagagtgctccaccttcctgacgagcatcaaagcctgcgacaaggcgatttgttatggggccgaatctgtgacccttacacgcggccaaaataccgtcaaagtgagcggaaagggcgggcactccggatctagctttaaatgctgtcatggcgaggaatgctcccagatcgggctccacgctgccgctccccatctggataaggttaacggaatttctgagatggaaaatagcaaggtgttcgacgatggcgccccgcagtgtggcatcaaatgctggtttgtcaagtccggggagtggatctctggaattttcagcggcaactggatcgtgctgattgtgctctgtgtcttcctgcttttctccctggttctcctgagcatcctgtgccctgtgcggaaacacaagaaatcttga

SEQ ID NO: 13381 - RNA, 3408 nt, synthetic construct
  misc_feature 1..3408: note = derived and/or modified CDS sequence (opt5) from HTNV__GQ120966.1__GP
  source 1..3408: mol_type = other RNA
atggagatctggaagtggctggtgatggccagcctcgtctggcccgccttcaccctgagaaacgtttacgacatgaaaattgaatgccctcacacagtgtcctttggcgaaaattctgtgatcgggtatgtcgaacttccgcccatgcctctggccgatacggcgcagatggtgcccgagagctcctgtaacatggacaatcatcaatctatgaacaccattacaaagtacacccaggttagctggcggggaaaagctgatcaggcccaggcctcccaaaattctttcgaagctgtgagcgccgaggtcgacctcaagggcacatgcgtgctgaaacacaagatgcttgaggaatcctatcgcagcagaaagtctatcacctgttacgatctgtcctgcaacagcacatattgtaaacctaccctctacatgattgttcccatccatgcttgcaatatgatgaagtcttgtctgatcgccctggggccttatcgggtgcaggtcgtgtacgagcgcacgtactgcatgaccggagtgctcattgaaggcaaatgttttgtcccggaccagtccgttgtgagcatcattaagcacgggatcttcgatattgcgtctgtgcatatcgtctgctttttcgtggccgttaaaggaaacacatataagctgtttgaacaggtgaagaaatccttccaaagcacctgtaatggcacagagaacaaggtccagggctactatatttgcatcgttgggggaaattccgctcccatctacgtgcctacccttgacgattttagatctatggaggccttcagcggcatttttcggagcccccacggggaggaccacgatctggctggagaagagatcgcctcctattctattgtgggccctgcgaacgccaaagtcccccattccgctagctctgacacgctcagcctgatcgcctactccgggattccgtcttatagctcccttagcatcctggcttcttccacagaagccaagcacgtgttcagccctggatttttcccccagctcaatcataccaaatgcgataagacagccatccctctgacctggaccggcatgattgacctgcccggctactacgaggctatccacccctgtacagtcttctgcgtgctctctgggcctggagcgtcctgtgaggcctttagcgaaggcgggattttcaacatcacgtccccgatgtgcctggtttctaaacagaatcgctttagacttaccgagcaacaggtgaacttcgtctgtcagcgggtggacatggatattatcgtttattgcaacggacaacgcaaggtgatcctgacaaagaccctcgtcattggccagtgtatctacacaattaccagcctgttttcccttctgcccggggtggctcactctatcgccgtggaactctgcgttcctggattccatggctgggccacggctgccctgctggtcacattttgtttcggctgggtgctcattcccgcgctgacccttatcattctgaccatcctcaaatttatcgctaatattttccacacaagcaaccaggagaatagactgaagtccgtgcttcggaaaatcaaggaagagtttgagaaaaccaaggggagcatggtctgcgacgtgtgtaagtatgaatgcgagacatacaaagaactgaaggcccatggagtttcttgccctcagtcccaatgtccctattgcttcacgcactgtgagccgaccgaagccgcttttcaggcccattaccgcgtgtgccaggtcacacacagattccgggatgacctcaaaaagaccgtgacacctcagaacttcacccccggctgttatcgcacgctgaatctgtttagatacaaaagccggtgctacattttcaccatgtgggtttgtctcctggtgcttgagtctatcctgtgggctgcctccgcgagcgaggtccctctcaaccccgtgtggaatgataacgcccacggggttggatctgtgcctatgcatacagacctggaactggattttccccttaccagctccagcaagtatacatacagacgccggctcaccaatccgctggaggaaacgcaatctattaacctgcacatcgagatcgaggaacagacaattggcgtcgacgtgcatgctctcgggcactggttcgatggcagactgaatcttaagacctcctttcactgctatggagcctgtacaaaatacgagtatccttggcataccgctaagtgccactacgaacgcgactatcagtacgagaccagctggggctgtaaccccgccgattgccccggggtgggaacaggctgcacggcgtgtgggctgtacctcgaccagctgaaacctgtcggatccgcctataagatcattaccatccggtactctagaaaagtttgcgtgcaattcggcgaagagaatctgtgtaaggtgattgacatgaacgattgctttgtcacacgccatgtgaaggtttgtatcatcgggaccgtgagcaaattctcccagggcgacacacttctctttttcggaccgctggagggcgggggactgatttttaagcactggtgcacctctacgtgtcagttcggcgatcccggggacatcatgagccctcgggataaaggatttctctgccccgagttccctggctccttcagaaagaaatgtaattttgctacaacacccctgtgcgagtatgacgggaacatggtctctggctacaagaaagtgatggccaccattgatagcttccagtcctttaacaccagcaccatgcatttcacagacgaacgcatcgagtggaaggatcctgacggaatgcttcgggatcacattaatatcctggttacgaaggacatcgattttgacaacctcggcgaaaatccctgtaaaattgggctgcaaacctcttccatcgagggagcttggggcagcggggtgggattcacactgacctgccttatttctctcacagagtgcccgacctttctgacgtccatcaaggcctgtgacaaagccatttgctatggcgctgaaagcgtcaccctgacaagagggcagaacaccgtgaaggtttctggcaaaggaggccactccgggagcacattcaagtgttgccatggagaggaatgttcccagatcggcctccacgcggccgctcctcatctggataaggtgaatgggattagcgagatcgaaaacaataaagtctacgacgatggagctccccaatgcggcgtgaagtgttggtttgtgaaatctggcgagtggatcagcgggattttctccggaaactggatcgtccttattgttctgtgcgtgtttctcctgttctctctggtgcttctcagcgtcctgtgtcctgtgcgcaagcacaaaaagtcctga

SEQ ID NO: 13382 - RNA, 3408 nt, synthetic construct
  misc_feature 1..3408: note = derived and/or modified CDS sequence (opt5) from HTNV(CGAa1011)__EF990927.1__GP
  source 1..3408: mol_type = other RNA
atggagatctggaagtggctggtgatggccagcctcgtctggcccgctctggcccttagaaacgttcacgacatgaagattgaatgccctcataccgtgtccttcggcaagaatagcgtgatcgggtacgtcgagctgccgcccatgcctctcgcggatacaattcagatggtgcccgaaagctcctgttctatggacaaccaccaaagcctgtccacggttaccaaatatacacaggtgtcttggcggggaaaggctgatcaggcccagagcaatcaaacctcctttgagacagtcagcgtggaagttgaccttaaagggacctgcgtgctgaagcataagctcgtcgaggagtcttaccgctccagaaaaagcctgacatgttatgatctgtcttgcaactccacctactgtaagcctacgctctatatgatcgtgcccattcacgcctgcaatatgatgaaaagctgtatcatcgctctggggcctcatcgggtgcaggtcgtttacgaacgcacctattgcatgacaggagtgcttctggagggcaagtgtttcgtgccggaccagtctgtcgtggggattgttaaacacggaatctttgatattgcctccgtgcacatcgcttgcttctttgtcgccattaccggcaacacatacaaactcttcgaacaggtgaagaagtcttttggcaccacgtgtaatgacacagagaacaaggttcaagggtactatatctgcattctgggaggcaattctccccctatctacgtgcccacccttgatgacttcagatctatggaggcgtttagcgggatcttcaaatcccctcatggagaagatcacgacctggccggcgaggaaattgctagctattctatcgtcgggcccgccaacgctaaggtgccgcattccgccagctctgatacactcagcctgattgcgttttccggaatcccttcttacagctccctgagcattctcacctcttccaccgaggccaaacacgtcttcagccccggcctgtttcctcagcttaatcacacaaagtgcgacaaaacggctatccccctgacctggacaggcatcattgacctccccgggtattacgaagccgtgcatccttgtaccgttttctgcgtgctgtctggaccgggcgcttcctgtgaggccttcagcgagggcggaatctttaacattacatcccccatgtgccttgtctctaagcagaatcggttccgcctgaccgaacagcaagtgaactttgtttgtcagagagtggatatggacatcgtcgtgtattgcaatggccagcggaaggtgattctcacgaaaacactggttatcgggcaatgtatctacaccattaccagcctgttctccctcctgcctggagtcgcccactctatcgctgtggagctttgcgtgcccggctttcatggctgggcgacagccgctctgctcattaccttctgttttgggtgggtcctgatccctgcccttacattcattgtgctgacggttctcaagtttatcgccaacattttccacaccagcaaccaggaaaatcgcctgaaaatggtgctgaagaaaatcaaggaggaatttgagagaacaaagggatccatggtctgcgatatctgtaaatacgagtgcgaaacctataaggagctcaaagctcatggcgtgagctgcccccagtctcagtgtccgtactgcttcacacactgtgaacctaccgagtccgcctttcaagcgcactatcgggtttgccaggtgacgcatcgcttcagagacgatctgaagaaaaccgtcacaccccagaacttcacccctgggtgttaccggacacttaatctgtttcgctataagagcagatgctacattttcaccatgtggatctgtctcctggtgctggaatctattctttgggctgcctccgccagcgagatccccctctctcctacgtggaacgacaatgctcacggagttggcagcattcccatgcatacagatctggagctggacttttccctcaccagctcctccaagtatacataccggagaaaactgaccaacccgcttgaagagagccaggccgtgaatttccacgtcgaaatcgaggagcaagctatcggggtggatgtgcacgccctgggccattggtttgacggacgcctcaacctgaagacctccttccactgctacggcgcgtgtacaaaatatgaatacccttggcatacggccaagtgccactatgagcgggattaccagtatgaaacctcttgggggtgtaatcccagcgactgccccggagtcggcacagggtgcaccgcttgtggactgtaccttgaccagctcaaacctgttggctccgcctataagattatcacaattagatactctcgccgggtgtgcgtgcagtttggggaggaaaacctgtgtaaggtcatcgatatgaatgactgcttcgtgagcagacatgttaaagtgtgtattatcggcaccgtctccaagttttctcaaggagatacgctcctcttctttggcccgctggaagggggaggccttatcttcaaacactggtgcacaagcacctgtcagtttggggaccccggagatattatgtcccctcgcgacaagggcttcctgtgccccgagttccctgggagctttcggaaaaagtgtaacttcgctaccacacccgtgtgcgagtacgatggcaatatggtttctggatataaaaaggtgatggccaccatcgactcctttcagagctctaacacatccacgatgcacttcaccgatgagagaattgaatggaaggaccctgatggcatgctccgcgaccatatcaatattctggtcacaaaagatatcgactttgacaacctgggggagaacccctgtaagatcggacttcagaccagctctattgaaggcgcgtgggggtccggagtgggcttcacactgacctgcctgatcagcctgacggagtgcccgacctttctcacatccattaaagcctgtgataaggctatctgctacggggccgagagcgttaccctgacacggggccaaaataccgtgaaagtctctggaaagggcgggcacagcggatccacattcaagtgttgccatggcgaagactgttctcagagcgggcttcacgctgccgcccctcatctggataaagtgaacggaatttccgagatcgaaaattctaaggtgtatgacgatggcgctccccagtgcggcgtcaaatgttggtttgttaagagcggggagtggatttccggaatcttctctggcaactggatcgtgctcattgtgctgtgcgtctttctgcttttcagcctcgtgctgctgtccatcctctgtcctgttagaaaacacaaaaagagctga

SEQ ID NO: 13383 - RNA, 3408 nt, synthetic construct
  misc_feature 1..3408: note = derived and/or modified CDS sequence (opt5) from HTNV(CGAa2)__EU092223.1__GP
  source 1..3408: mol_type = other RNA
atggagatctggaagtggctggtgatggccagcctcgtctggcccgctctggcccttagaaacgttcacgacatgaaaattgaatgccctcataccgtgtccttcggcaaaaattctgtgatcgggtacgtcgagctgccgcccatgcctctcgcggatacaattcagatggtgcccgaaagctcctgttctatggacaaccaccaaagcctgtccacggttaccaagtatacacaggtgtcttggcggggaaaggctgatcaggcccagcctagccaaacctcctttgagacagtcagcgtggaagttgaccttaaagggacctgcgtgctgaagcataagctcgtcgaggagtcttaccgctccagaaaaagcctgacatgttatgatctgtcttgcaattccacctactgtaagcccacgctctatatgatcgtgcctattcacgcctgcaacatgatgaaaagctgtatcatcgctctgggcccgcatcgggtgcaggtcgtttacgaacgcacctattgcatgacaggagtgcttctggagggcaagtgtttcgtgcccgaccagtctgtcgtgtccattgttagacacgggatctttgatattgccagcgtgcacatcgcttgcttctttgtcgccattaccggaaatacatacaaactcttcgaacaggtgaagaagtcctttggcaccacgtgtaacgacacagagaataaagttcaaggctactatatctgcattctcgggggaaactctcctcccatctacgtgcctacccttgatgacttccggagcatggaggcgttttccggcatcttcaagagcccccatggggaagatcacgacctggccggagaggaaattgcttcttattccatcgtcggcccggccaatgctaaagtgcctcatagcgcctctagcgatacactctccctgattgcgttttctgggatccccagctactccagcctgtctattctcacctccagcaccgaggccaagcacgtcttctctcctggactgtttccccagcttaaccacacaaaatgcgacaagacggctatccccctgacctggacaggcatcattgacctccctggctattacgaagccgtgcatccgtgtaccgttttctgcgtgctgtccgggcccggagctagctgtgaggccttctccgagggcgggatctttaatattacatctcctatgtgccttgtcagcaaacagaaccgcttcagactgaccgaacagcaagtgaattttgtttgtcagcgggtggatatggacatcgtcgtgtattgcaacggacagcgcaaggtgattctcacgaagacactggttatcggccaatgtatctacaccattacctccctgttctctctcctgcccggggtcgcccacagcatcgctgtggagctttgcgtgcctggatttcatggctgggcgacagccgctctgctcattaccttctgttttggctgggtcctgatccccgcccttacattcattgtgctgacggttctcaaatttatcgccaatattttccacacctccaaccaggaaaacagactgaagatggtgctgaaaaagatcaaagaggaatttgagcggacaaaggggagcatggtctgcgatatctgtaagtacgagtgcgaaacctataaagagctcaaggctcatggagtgtcttgcccgcagtcccagtgtccttactgcttcacacactgtgaacccaccgagagcgcctttcaagcgcactatcgcgtttgccaggtgacgcatagattccgggacgatctgaaaaagaccgtcacacctcagaatttcacccccggctgttaccgcacacttaacctgtttagatataaatctcggtgctacattttcaccatgtggatctgtctcctggtgctggaatccattctttgggctgccagcgcctctgagatccctctcagccccacgtggaatgacaacgctcacggggttggatccattccgatgcatacagatctggagctggactttagcctcacctcttccagcaagtatacatacagacgcaagctgaccaatcctcttgaagagtcccaggccgtgaacttccacgtcgaaatcgaggagcaagctatcggcgtggatgtgcacgccctggggcattggtctgacggccggctcaatctgaaaaccagctttcactgctacggagcgtgtacaaagtatgaatacccctggcatacggccaaatgccactatgagagagattaccagtatgaaacctcctggggctgtaacccctctgactgccctggggtcggaacaggctgcaccgcttgtgggctgtaccttgaccagctcaagccggttggaagcgcctataaaattatcacaattcgctactcccggagagtgtgcgtgcagttcggcgaggaaaatctgtgtaaggtcatcgatatgaacgactgctttgtgtctcgccatgttaaggtgtgtattatcgggaccgtcagcaaattctcccaaggcgatacgctgctctttttcggacccctggagggcgggggacttatctttaagcactggtgcacaagcacctgtcagttcggcgaccctggggatattatgtctccccgggacaaaggatttctgtgccctgagttccccggctccttcagaaagaaatgtaattttgctaccacacctgtgtgcgaatacgatgggaacatggttagcggctataagaaagtgatggccaccatcgactctttccagtccagcaatacatctacgatgcactttaccgatgagcgcattgaatggaaggaccccgatggaatgctccgggaccatatcaacattctggtcacaaaggatatcgacttcgacaatctgggcgagaacccgtgtaaaatcgggcttcagacctccagcattgaaggagcgtggggctccggggtgggatttacactgacctgcctgatcagcctgacggagtgccctaccttcctcacatctattaaggcctgtgataaagctatctgctacggcgccgagagcgttaccctgacaagagggcaaaacaccgtgaaggtctccggcaaaggaggccactctgggagcacatttaagtgttgccatggagaagactgttcccagtctggccttcacgctgccgctccccatctggataaggtgaatgggattagcgagatcgaaaactccaaagtgtatgacgatggagcccctcagtgcggcgtcaagtgttggttcgttaaatctggcgagtggattagcgggatcttttccggaaattggatcgtgctcattgtgctgtgcgtcttcctgctttttagcctcgtgctgctgtctatcctctgtcccgttcgcaagcacaaaaagtcctga

SEQ ID NO: 13384 - RNA, 3408 nt, synthetic construct
  misc_feature 1..3408: note = derived and/or modified CDS sequence (opt5) from HTNV(CGAa31MP7)__EF990925.1__GP
  source 1..3408: mol_type = other RNA
atgggcatctggaagtggctggtgatggccagcctcgtctggcccgctttcgccctgagaaacgtttacgacatgaaaattgagtgccctcacaccgtgtcctttggggaaaattctgtgatcggatatgtcgagcttccgcccatgcctctggcggatacaacgcagatggtgcccgaaagctcctgttctatggacaaccatcaaagcctcaataccattacaaagtacacccagatcatttggcggggcaaagctgatcagtcccagtctagccaaaactccttcgagacagttagcaccggggtggacctgaagggaacatgcgtccttaaacacaagatgatcgaagagtcttatcgctccagaaagagcatcacctgttacgatctgtcttgcaattccacgtattgtaaacctaccctctacatgattgtgcccatccatgcctgcaacatgatgaagtcctgtctgattgccctgggcccttatcgggttcaggtggtctacgagcgcacatactgcatgaccggggtgctcatcgaaggaaaatgttttgtgccggaccagtctgtcgtttccattatcaagcacggcattttcgatatcgctagcgtgcatatcgtgtgctttttcgtcgccgtgaaaggcaatacatataagatttttgagcaggttaagaaatccttcgaatctaactgtaatgacaccgagaacaaggtgcaagggtactatatctgcattatcggaggcaatagctcccccgtctacgtgcctacgctggatgactttagaagcatggaggctttctctgggatttttcggagcccccacggagaagatcacgaccttgccggcgaggaagttgcgagctattctatcgtggggcctgccaacgctaaagtcccccatagcgcctcctctgatacactgggactcatcgcttacagcggcattccgtcctatagctctctgtccatccttaccagctctacagaggccaagcacgtgttctcccctggcctgtttccccagctcaatcataccaaatgcgacaagaccgcgattcctctgacatggacggggatgatcgacctgcccggatactacgaagccattcacccctgtaccgtcttctgcgtgctcagcggccctggggcttcctgtgaggccttctctgagggaggcatctttaacatcacaagcccgatgtgcctggtttccaaacagaatcgcttcagacttaccgaacagcaagtgaactttgtctgtcagcgggtggatgttgacattatcgtgtattgcaacgggcagcgcaaggtcattctgacaaagaccctcgtgatcggacaatgtatttacacgatcacatctctgttcagccttctgcccggcgtggctcactccattgccgttgagctctgcgtccctggctttcatgggtgggccaccgctgcgctgctggtgaccttctgttttggatgggtgctcatccccgccatcacattcattatcctgaccattcttaaatttatcgctaatattttccacacaagcaaccaggaaaatagactgaagtctgtcctccggaaaatcaaggaggaatttgagcgcacgaaaggctccatggtgtgcgatatctgtaagtatgagtgcgaaacctacaaggagctgaaagcccatggggttagctgccctcagtctcagtgtccctattgcttcacacactgtgaaccgaccgaggccgcttttcaagcccattacagagtgtgccaggtcacacaccggttccgcgacgatcttaagaaaaccgtgacgcctcagaacttcacccccggatgttatagaacactgaatctctttcggtacaagtccagatgctacattttcaccatgtggatctgtctgctggttctcgaaagcattctgtgggcggcttctgccagcgagatccctcttaaccccgtgtggaatgacaacgcccacggcgtcgggtccattcctatgcatacagatctggagctcgactttagcctgacctcttccagcaaacacacgtatcgccggaagctgacaaatccccttgaagagtcccaggctatcgatctccatgtggaaatcgaggagcaaaccattggcgttgacgtgcacgccctgggacactggttcgatggcagactgaacctcaagacatcttttcattgctacggggcttgtaccaaatatgaatacccgtggcacaccgccaagtgccattatgagcgcgactaccagtatgaaacaagctggggatgtaatccttccgactgccccggcgtcgggacgggatgcaccgcgtgtggcctgtaccttgatcagctgaaacccgtggggtctgcctacaagatcattacaatccggtatagcagacgcgtgtgcgtccagttcggcgaggaaaacctctgtaaagttattgacatgaatgattgctttgtgtcccggcacgtgaaggtctgtatcatcggaaccgtgtctaagttcagccaaggcgacacactgctgtttttcgggcctcttgagggaggcgggctcatttttaaacattggtgcacctccacgtgtcagttcggagatccgggcgacatcatgagccccagagataaggggtttctgtgccctgagttccccggctctttccgcaaaaagtgtaactttgctacaacccctgtttgcggatacgacggcaatatggtgtccgggtataaaaaggtcatggccaccattgatagcttccagtcttttaacacatccaccatgcacttcacagacgaacggatcgagtggaaagatcccgacggaatgctgagagatcacattaacatcctcgtgacgaaggacattgactttgataatctgggcgaaaacccttgtaagatcgggcttcagaccagctctatcgagggagcttggggctccggggttggcttcacactgacctgcctcattagcctgacagaatgccccacctttctgacgtccatcaaagcctgtgacaaggcgatttgctacggagccgagagcgtgacccttacacgcggccaaaataccgtcaaagtgtctgggaagggaggccatagcgggtccacattcaaatgttgccacggagaggattgttctcagagcggcctccatgctgccgctccgcacctggacaaggttaacggcatctccgaaattgaaaattctaaggtgtatgatgacggggcccctcagtgcggaatcaaatgttggtttgtcaagagcggcgagtggatctccgggattttctctggaaactggatcgtgctgattgtgctctgcgtctttctgcttttcagcctggttctcctgtccatcctgtgtcccgtgcggaaacataagaaaagctga

SEQ ID NO: 13385 - RNA, 3408 nt, synthetic construct
  misc_feature 1..3408: note = derived and/or modified CDS sequence (opt5) from HTNV(CGAa4MP9)__EF990929.1__GP
  source 1..3408: mol_type = other RNA
atggagatctggaagtggctggtgatggccagcctcgtctggcccgctctggcccttagaaacgtttacgacatgaaaattgaatgccctcacaccgtgtccttcggcgaaaattctgtgctggggtatgtcgaactcccgcccatgcctctggcggatacaatccagatggtgcccgagagctcctgttctatggacaaccatcaaagcatgtccacggctaccaagtacacacaggtttcttggcggggaaaagccgatcaggcccagagctcccaaaccagctttgaaacagtgtctgtcgaggtggaccttaaggggacctgcgttctgaaacacaagatggtggagaagtcctatcgcagcagaaaatctctcacatgttacgatctgtcctgcaatagcacctattgtaagcctacgctgtacatgattgtccccatccatgcttgcaacatgatgaaatcttgtattatcgccctcgggccttatcgggtccaggtggtgtacgaacgcacctactgcatgacaggagttctgcttgagggcaagtgtttcgtgccggaccagtccgtggtcagcatcgtgaaacactccatttttgatatcgcttctgttcatattgcctgcttctttgtggcgatcaccgggaatacatataagctgattgaacaggtcaagaccagcttcggaacgacatgtaacgacaccgaggataaagtgcaaggctactatatctgcattctcggcgggaatagccctcccatctacgttcccacactggacgattttagaagcatggaggccttctctggaatctttcggtcccctcacggcgaagaccacgatcttgctggggaggaaattgccagctattctatcgtgggacccgctaacgccaagattccgcatagcgcgtcctctgacaccctgagcctcatcgccttctccggcattcctagctactcttccctgagcatcctgacctcttccacagaggctaaacacgtctttagccccggcctcttccctcagctgaatcatacgaagtgcgacaaaaccgccatcccccttacatggaccggaattatcgatctgcccggctattacgaagctgtgcacccttgtacagtcttttgcgtgctctccggcccgggggcctcttgtgaggccttcagcgagggaggcattttcaacatcacctcccccatgtgcctggtttctaagcagaatcgctttagacttacggaacagcaagtgaacttcgtctgtcagcgggtggacatggatattgttgtgtactgcaatgggcagcgcaaagtcatcctgacaaagaccctcgtgatcggacaatgtatttataccatcacaagcctgttttccctgctccctggcgtggctcacagcattgcggttgagctgtgcgtccccgggttccatggatgggccaccgctgcccttctggtgacattttgtttcggctgggtgctcatccctgccattacgtttgtcgtgctgaccgttcttaagttcatcgctaacatttttcacacatctaatcaggaaaacagactgaaaatggtgctcaagaaaatcaaggaggagttcgagaaaaccaagggctccatggtctgcgacatctgtaagtacgagtgcgaaacatataaagagctgaaggcccatggggtgagctgcccccagtctcagtgtccgtactgctttacccactgtgaacctacggagtccgcgttccaagctcattatcgggtttgccaggtgacccaccgctttagagaagatctgaaaaagacagtcacaccccagaacttcacccctggatgttaccggaccctcaatctgttccgctataaaagcagatgctacatttttacgatgtggatcttccttctggtgctcgagtctattctgtgggccgccagcgcttccgagacacccctgagccctacctggaacgacaatgcccacggcgttgggtctatccccatgcatacagatcttgaactcgacttttccctgaccagctcctctaagtacacctatcggagaaagctgacaaacccgctcgaggaagctcaggccgtgagcttccacgtcgagattgaggaacaaacgatcggagtggatgtgcatgcgctgggccactggtttgacgggcgccttaatctgaaaacctccttccactgttacggcgcctgcacaaagtatgagtacccttggcataccgctaaatgtcactatgaacgggattaccagtatgagacatcttggggatgcaaccccagcgactgtcccggcgtcgggaccggatgcacggcctgcggcctctacctggaccagctgaagcctgttgggtccgcttacaaaatcattacaatcagatattctcgccgggtgtgtgtgcagtttggagaagagaatctttgcaaggtcattgatatggacgattgtttcgtgagcagacatgttaaggtgtgcatcattggcaccgtctccaaatttagccaaggggacaccctcctgttctttggcccgctggagggaggcgggctcatctacaagcactggtgtacatctacctgccagttcggagatcccggcgacatcatgtcccctcgcgataaagggctgctttgtcccgaatttcctggatccttccggaagaaatgcaacttcgccacaacgcccgtgtgtgagtatgacggcaatatggtttctgggtacaagaaagtgatggcgaccattgattcctttcagagcatcaacacatctaccatgcatttcacagacgaaagaattgagtggaaggatcctgacggcatgctgcgcgatcacatcaatattctcgtcaccaaggacatcgactttgataacctgggagaaaatccctgcaaaatcggcctgcagacgtccagcattgagggggcctggggatccggcgtggggttcacccttacatgtctcatcagcctgaccgagtgcccgacatttctgacctctattaaggcttgcgacaaagccatctgttatggagctgaaagcgttacactcacccggggccaaaacacggtgaaggtctccgggaaaggcggacactctggcagcacattcaagtgctgtcatggggaggattgctcccagtctggactgcacgccgccgctcctcatcttgacaaggtgaatggcattagcgaaatggagaactccaaagtgtacgatgacggggcgccccagtgtggaatcaagtgctggtttgtcaaatctggcgaatggattagcggcatcttctccgggaactggatcgttctgattgtgctctgtgtgtttctgctgttcagccttgtcctcctgtctatcctgtgccctgtgagaaagcacaaaaagtcctga

SEQ ID NO: 13386 - RNA, 3408 nt, synthetic construct
  misc_feature 1..3408: note = derived and/or modified CDS sequence (opt5) from HTNV(CGAa4P15)__EF990928.1__GP
  source 1..3408: mol_type = other RNA
atggagatctggaagtggctggtgatggccagcctcgtctggcccgctctggcccttagaaacgtttacgacatgaaaattgaatgccctcacaccgtgtccttcggcgaaaattctgtgctggggtatgtcgagctcccgcccatgcctctggcggatacaatccagatggtgcccgagagctcctgttctatggacaaccatcaaagcatgtccacggctaccaagtacacacaggtttcttggcggggaaaagccgatcaggcccagagctcccaaaccagctttgaaacagtgtctgtcgaggtggaccttaaggggacctgcgttctgaaacacaagatggtggagaagtcctatcgcagcagaaaatctctcacatgttacgatctgtcctgcaatagcacctattgtaagcctacgctgtacatgattgtccccatccatgcttgcaacatgatgaaatcttgtattatcgccctcgggccttatcgggtccaggtggtgtacgaacgcacctactgcatgacaggagttctgcttgagggcaagtgtttcgtgccggaccagtccgtggtcagcatcgtgaaacactccatttttgatatcgcttctgttcatattgcctgcttctttgtggcgatcaccgggaatacatataagctgttcgaacaggtcaagaccagctttggaacgacatgtaacgacaccgaggataaagtgcaaggctactatatttgcatcctcggcggcaattcccctcccatttacgttcccacactggacgatttcagaagcatggaggccttttctggaatcttccggtcccctcacggcgaagaccacgatcttgctggggaggaaatcgccagctattctattgtgggacccgctaacgccaagatcccgcatagcgcgtcctctgacaccctgagcctcattgccttttccggcatccctagctactcttccctgagcattctgacctcttccacagaggctaaacacgtcttcagccccgggctctttcctcagctgaatcatacgaagtgcgacaaaaccgccatcccccttacatggaccggaatcattgatctgcccggctattacgaagctgtgcacccttgtacagtcttctgcgtgctctccggcccgggggcctcttgtgaggccttcagcgagggaggcatctttaacattacctcccccatgtgcctggtttctaagcagaatcgcttcagacttacggaacagcaagtgaactttgtctgtcagcgggtggacatggatatcgttgtgtactgcaatgggcagcgcaaagtcattctgacaaagaccctcgtgatcggacaatgtatctataccattacaagcctgttctccctgctccctggcgtggctcacagcatcgcggttgagctgtgcgtccccgggtttcatggatgggccaccgctgcccttctggtgacattctgttttggctgggtgctcattcctgccatcacgttcgtcgtgctgaccgttcttaagtttattgctaacatcttccacacatctaatcaggaaaacagactgaaaatggtgctcaagaaaattaaggaggaatttgagaaaaccaagggctccatggtctgcgacatctgtaagtacgagtgcgaaacatataaagagctgaaggcccatggggtgagctgcccccagtctcagtgtccgtactgcttcacccactgtgaacctacggagtccgcgtttcaagctcattatcgggtttgccaggtgacccaccgcttcagagaagatctgaaaaagacagtcacaccccagaacttcacccctggatgttaccggaccctcaatctgtttcgctataaaagcagatgctacatcttcacgatgtggatttttcttctggtgctcgagtctatcctgtgggccgccagcgcttccgagacacccctgagccctacctggaacgacaatgcccacggcgttgggtctattcccatgcatacagatcttgaactcgacttctccctgaccagctcctctaagtacacctatcggagaaagctgacaaacccgctcgaggaagctcaggccgtgagctttcacgtcgagatcgaggaacaaacgattggagtggatgtgcatgcgctgggccactggttcgacgggcgccttaatctgaaaacctcctttcactgttacggcgcctgcacaaagtatgagtacccttggcataccgctaaatgtcactatgaacgggattaccagtatgagacatcttggggatgcaaccccagcgactgtcccggcgtcgggaccggatgcacggcctgcggcctctacctggaccagctgaagcctgttgggtccgcttacaaaatcatcacaattagatattctcgccgggtgtgtgtgcagttcggagaagagaatctttgcaaggtcatcgatatggacgattgttttgtgagcagacatgttaaggtgtgcattatcggcaccgtctccaaattcagccaaggggacaccctcctgtttttcggcccgctggagggaggcgggctcatttttaagcactggtgtacatctacctgccagttcggagatcccggcgacatcatgtcccctcgcgataaagggttcctgtgtcccgaatttcctggatccttccggaagaaatgcaactttgccacaacgcccgtgtgtgagtacgacggcaatatggtttctgggtataagaaagtgatggcgaccatcgattccttccagagcattaacacatctaccatgcattttacagacgaaagaatcgagtggaaggatcctgacggcatgcttcgcgatcacattaatatcctggtcaccaaggacattgacttcgataacctcggagaaaatccctgcaaaatcggcctgcagacgtccagcatcgagggggcctggggatccggcgtggggtttaccctgacatgtcttattagcctcaccgagtgcccgacattcctgacctctatcaaggcttgcgacaaagccatttgttacggagctgaaagcgttacactgacccggggccaaaacacggtgaaggtctccgggaaaggcggacactctggcagcacatttaagtgctgtcatggggaggattgctcccagtctggactccacgccgccgctcctcatctggacaaggtgaatggcatcagcgaaatggagaactccaaagtgtatgatgacggggcgccccagtgtggaattaagtgctggttcgtcaaatctggcgaatggatcagcggcatttttagcgggaactggatcgttcttatcgtgctgtgtgtgttcctcctgttcagcctggtccttctctctattctgtgccctgtgagaaagcacaaaaagtcctga

SEQ ID NO: 13387 - RNA, 3408 nt, synthetic construct
  misc_feature 1..3408: note = derived and/or modified CDS sequence (opt5) from HTNV(CGAa75)__EU092224.1__GP
  source 1..3408: mol_type = other RNA
atggagatctggaagtggctggtgatggccagcctcgtctggcccgctctggcccttagaaacgttcacgacatgaaaattgaatgccctcataccgtgtccttcggcaaaaattctgtgatcgggtacgtcgagctgccgcccatgcctctcgcggatacaattcagatggtgcccgaaagctcctgttctatggacaaccaccaaagcctgtccacggttaccaaacatacacaggtgtcttggcggggaaaggctgatcaggcccagagctcccaaaccagctttgagacagtctctgtggaagttgaccttaaagggacctgcgtgctgaagcacaagctcgtcgaggagtcctatcgcagcagaaaatctctgacatgttacgatctgtcctgcaatagcacctattgtaagcctacgctctacatgatcgtgcccattcatgcctgcaacatgatgaaatcttgtatcatcgctctggggcctcaccgggtgcaggtcgtttatgaacgcacctactgcatgacaggagtgcttctggagggcaagtgtttcgtgccggaccagtccgtcgtgagcattgttagacacgggatctttgatattgcctccgtgcatatcgcttgcttctttgtcgccattaccggaaatacatataaactcttcgaacaggtgaagaagtcttttggcaccacgtgtaacgacacagagaataaagttcaaggctactacatctgcattctgggcggaaacagccctcccatctatgtgcccacccttgatgacttccggtccatggaggcgtttagcggcatcttcaagtctcctcacggggaagatcatgacctggccggagaggaaattgcttcctacagcatcgtcggccccgccaatgctaaagtgccgcactctgccagctccgatacactctctctgattgcgtttagcgggatcccttcctatagctctctgtccattctcaccagctctaccgaggccaagcacgtcttctcccccggactgtttcctcagcttaaccatacaaaatgcgacaagacggctatccccctgacctggacaggcatcattgacctccccggctactatgaagccgtgcacccttgtaccgttttctgcgtgctgagcgggccgggagcttcctgtgaggccttctctgagggcgggatctttaatattacaagccccatgtgccttgtctccaaacagaaccgcttcagactgaccgaacagcaagtgaattttgtttgtcagcgggtggatatggacatcgtcgtgtactgcaacggacagcgcaaggtgattctcacgaagacactggttatcggccaatgtatctataccattacctctctgttcagcctcctgcctggggtcgcccattccatcgctgtggagctttgcgtgcccggatttcacggctgggcgacagccgctctgctcattaccttctgttttggctgggtcctgatccctgcccttacattcattgtgctgacggttctcaaatttatcgccaatattttccataccagcaaccaggaaaacagactgaagatggtgctgaaaaagatcaaagaggaatttgagcggacaaaggggtctatggtctgcgatatctgtaagtacgagtgcgaaaccaataaagagctcaaggctcacggagtgtcctgcccccagagccagtgtccgtactgcttcacacactgtgaacctaccgagtctgcctcccaagcgcattatcgcgtttgccaggtgacgcacagatttcgggacgatctgaaaaagaccgtcacaccccagaacttcacccctggctgttaccgcacacttaatctgttcagatataaaagccggtgctacatttttaccatgtggatctgtctcctggtgctggaatctattctttgggctgccagcgcctccgagatccccctcagccctacgtggaacgacaatgctcatggggttggatctattcccatgcacacagatctggagctggacttctccctcaccagctcctctaagtatacatacagacgcaagctgaccaacccgcttgaagagagccaggccgtgaattttcacgtcgaaatcgaggagcaagctatcggcgtggatgtgcatgccctggggcactggttcgacggccggctcaacctgaaaacctcctttcattgctatggagcgtgtacaaagtacgaatacccttggcacacggccaaatgccattatgagagagattaccagtatgaaacctcttggggctgtaatcccagcgactgccccggggtcggaacaggctgcaccgcttgtgggctgtaccttgaccagctcaagcctgttggatccgcctataaaattatcacaattcgctactctcggagagtgtgcgtgcagttcggcgaggaaaacctgtgtatcgtcattgatatgaatgactgctttgtgagccgccacgttaaggtgtgtatcatcgggaccgtctccaagttcagccaaggcgatacgctgctctttttcggaccgctggagggcgggggacttattctgaaacactggtgcacatctacctgtcagtttggcgaccccggggatatcatgtcccctcgggacaagggattcctctgccccgagtttcctggcagcttcagaaagaagtgtaacttcgctaccacacccgtgtgcgaatatgggggcaatatggtttctggatacaaaaaggtgatggccaccattgattcctttcagagcttcaacacatctacgatgcattttaccgacgagcgcatcgaatggaaagatcctgacggcatgctgcgggatcacattaatatcctggtcacaaaggacatcgatttcgacaaccttggggagaacccctgtaagattggactccagacctccagcatcgaaggcgcgtgggggtccggagtgggctttacactgacctgcctgattagcctcacggagtgcccgaccttcctgacatctatcaaagcctgtgacaaggctatttgctacggggccgagagcgttacccttacaagaggccaaaataccgtgaaagtctccggaaagggcgggcattctggaagcacatttaaatgttgccacggcgaagattgttcccagtctgggctgcatgctgccgcccctcacctcgacaaggtgaacggaatcagcgagattgaaaattccaaggtgtatgatgacggcgctccccagtgcggcatcaaatgttggttcgtcaagtctggggagtggatcagcggaatcttttccggcaactggattgttctgattgtgctgtgcgtgttccttctctttagcctggtcctgctctctatcctgtgtcctgtgcgcaaacacaaggaatcctga

SEQ ID NO: 13388 - RNA, 3408 nt, synthetic construct
  misc_feature 1..3408: note = derived and/or modified CDS sequence (opt5) from HTNV(CGHu2)__EU363819.1__GP
  source 1..3408: mol_type = other RNA
atgggcatctggaagtggctggtgatggccagcctcgtctggcccgctttcgccctgagaaacgtttacgacatgaaaattgagtgccctcacaccgtgtcctttggggaaaattctgtgatcggatatgtcgagcttccgcccatgcctctggcggatacaacgcagatggtgcccgaaagctcctgttctatggacaaccatcaaagcctcaataccattacaaagtacacccagatcatttggcggggcaaagctgatcagtcccagtctagccaaaactccttcgagacagttagcaccggggtggacctgaagggaacatgcgtccttaaacacaagatgatcgaagagtcttatcgctccagaaagagcatcacctgttacgatctgtcttgcaattccacgtattgtaaacctaccctctacatgattgtgcccatccatgcctgcaacatgatgaagtcctgtctgattgccctgggcccttatcgggttcaggtggtctacgagcgcacatactgcatgaccggggtgctcatcgaaggaaaatgttttgtgccggaccagtctgtcgtttccattatcaagcacggcattttcgatatcgctagcgtgcatatcgtgtgcttttatgtcgccgtgaaaggcaatacatacaagattttcgagcaggttaagaaatcctttgaatctaactgtaatgacaccgagaacaaggtgcaagggtattacatctgcattatcggaggcaatagctcccccgtctatgtgcctacgctggatgacttcagaagcatggaggctttttctgggattatccggagcccccacggagaagatcacgaccttgccggcgaggaagttgcgagctactctatcgtggggcctgccaacgctaaagtcccccatagcgcctcctctgatacactgggactcattgcttatagcggcatcccgtcctacagctctctgtccattcttaccagctctacagaggccaagcacgtgttctcccctggcctgtttccccagctcaatcataccaaatgcgacaagaccgcgatccctctgacatggacggggatgattgacctgcccggatactatgaagccatccacccctgtaccgtcatctgcgtgctcagcggccctggggcttcctgtgaggccctgtctgagggaggcattttcaacatcacaagcccgatgtgccttgtttccaaacagaatcgctttagactgaccgaacagcaagtgaacttcgtctgtcagcgggtggatgttgacattatcgtgtactgcaacgggcagcgcaaggtcattctcacaaagaccctggtgatcggacaatgtatttatacgatcacatctcttttcagcctgctccccggcgtggctcactccatcgccgttgagctgtgcgtccctggctttcatgggtgggccaccgctgcgctgctcgtgaccttctgttttggatgggtgctgattcccgccatcacattcattatccttaccattctgaaatttatcgctaatatcttccacacaagcaaccaggaaaatagactcaagtctgtcctgcggaaaattaaggaggaatttgagcgcacgaaaggctccatggtgtgcgatatctgtaagtacgagtgcgaaacctataaggagcttaaagcccatggggttagctgccctcagtctcagtgtccctactgcttcacacactgtgaaccgaccgaggccgcttttcaagcccattatagagtgtgccaggtcacacaccggttccgcgacgatctgaagaaaaccgtgacgcctcagaactttacccccggatgttacagaacactcaatctgttccggtacaagtccagatgctatatttttaccatgtggatctgtctgctcgttctggaaagcattctttgggcggcttctgccagcgagatccctctgaaccccgtgtggaatgacaacgcccacggcgtcgggtccatccctatgcatacagatctcgagctggacttcagcctgacctcttccagcaaacacacgtaccgccggaaacttacaaatcccctcgaagagtcccaggctattgatctgcatgtggaaatcgaggagcaaaccattggcgttgacgtgcacgccctgggacactggttcgatggcagactcaacctgaagacatcttttcattgctatggggcttgtaccaagtacgaatatccgtggcacaccgccaagtgccattacgagcgcgactatcagtacgaaacaagctggggatgtaatccttccgactgccccggcgtcgggacgggatgcaccgcgtgtggcctttacctggatcagctcaaacccgtggggtctgcctataagatcattacaatccggtacagcagacgcgtgtgcgtccagttcggcgaggaaaacctgtgtaaagttatcgacatgaatgattgctttgtgtcccggcacgtgaaggtctgtattatcggaaccgtgtctaagttcagccaaggcgacacactgctctttttcgggcctctcgagggaggcgggctgatttttaaacattggtgcacctccacgtgtcagttcggagatccgggcgacatcatgagccccagagataaggggtttctgtgccctgagttccccggctcttttcgcaaaaagtgtaacttcgctacaacccctgtttgcggatatgacggcaatatggtgtccgggtacaaaaaggtcatggccaccattgatagctttcagtctttcaacacatccaccatgcacttcacagacgaacggatcgagtggaaagatcccgacggaatgctcagagatcacattaacatcctggtgacgaaggacatcgactttgataatcttggcgaaaacccttgtaagattgggctgcagaccagctctatcgagggagcttggggctccggggttggcttcacacttacctgcctgattagcctgacagaatgccccacctttcttacgtccatcaaagcctgtgacaaggcgatttgctatggagccgagagcgtgaccctcacacgcggccaaaataccgtcaaagtgtctgggaagggaggccatagcgggtccacattcaaatgttgccacggagaggattgttctcagagcggcctgcatgctgccgctccgcacctggacaaggttaacggcatctccgaaatcgaaaattctaaggtgtacgatgacggggcccctcagtgcggaattaaatgttggtttgtcaagagcggcgagtggatctccgggattttctctggaaactggatcgtgctcattgtgctgtgcgtctttcttctgttcagcctcgttctgctgtccatcctttgtcccgtgcggaaacataagaaaagctga

SEQ ID NO: 13389 - RNA, 3408 nt, synthetic construct
  misc_feature 1..3408: note = derived and/or modified CDS sequence (opt5) from HTNV(CGHu3)__EU363818.1__GP
  source 1..3408: mol_type = other RNA
atggagatctggaagtggctggtgatggccagcctcgtctggcccgctctggcccttagaaacgttcacgacatgaaaattgaatgccctcataccgtgtccttcggcaagaatagcgtgatcgggtacgtcgagctgccgcccatgcctctcgcggatacaattcagatggtgcccgaaagctcctgttctatggacaaccaccaaagcctgtccacggctaccaaatatacacaggtttcttggcggggaaaggccgatcaggcccagagctcccaaaccagctttgagacagtgtctgtcgaagtggaccttaaagggacctgcgttctgaagcataagctcgtggaggagtcctaccgcagcagaaaatctctgacatgttatgatctgtcctgcaatagcacctactgtaagcctacgctctatatgatcgtccccattcacgcttgcaacatgatgaaatcttgtatcatcgccctggggcctcatcgggtccaggtggtgtacgaacgcacctattgcatgacaggagttcttctggagggcaagtgtttcgtgccggaccagtccgtggtcagcattgtgagacacgggatctttgatattgcttccgttcacatcgcctgcttctttgtggcgattaccggaaatacatacaaactcttcgaacaggtcaagaagtcttttggcaccacgtgtaacgacacagagaataaagtgcaaggctactatatctgcattctgggcggaaactctccccctatctacgttcccacccttgatgacttccggtccatggaggcctttagcggcatcttcaagtctcctcatggggaagatcacgacctggctggagaggaaattgcctcctatagcatcgtgggccccgctaatgccaaagtcccgcattctgcgagctccgatacactctctctgattgcctttagcgggatcccttcctacagctctctgtccattctcaccagctctaccgaggctaagcacgtgttctcccccggactgtttcctcagcttaaccacacaaaatgcgacaagacggccatccccctgacctggacaggcatcattgacctccccggctattacgaagctgtccatccttgtaccgtgttctgcgttctgagcgggccgggagcctcctgtgaggccttctctgagggcgggatctttaatattacaagccccatgtgccttgtgtccaaacagaaccgcttcagactgaccgaacagcaagtcaattttgtgtgtcagcgggttgatatggacatcgtggtctattgcaacggacagcgcaaggtgattctcacgaagacactggtgatcggccaatgtatctacaccctgacctctctcttcagcctgcttcctggggttgctcactccattgcggtcgagctgtgcgtgcccggatttcatggctgggccacagctgccctcctgatcaccttctgttttggctgggtgcttattcctgccctgacattcatcgtcctcacggtgctgaaatttattgctaatatcttccacaccagcaaccaggaaaacagactgaagatggttctcaaaaagattaaagaggaatttgagcggacaaaggggtctatggtgtgcgatatctgtaagtacgagtgcgaaacctataaagagctgaaggcccatggagtctcctgcccccagagccagtgtccgtactgcttcacacactgtgaacctaccgagtctgcgtttcaagctcactatcgcgtgtgccaggttacgcatagattccgggacgatcttaaaaagaccgtgacaccccagaatttcacccctggctgttaccgcacactgaacctctttagatataaatcccggtgctacatcttcaccatgtggatttgtctgctggtccttgaaagcatcctctgggccgcctctgctagcgagattcccctgtcccctacgtggaatgacaacgcccacggggtgggaagcatccccatgcatacagatctggagctcgacttttctctgacctccagctccaagtatacatacagacgcaaacttaccaatccgctggaagagtctcaggctgttaacttccacgtggaaattgaggagcaagccatcggcgtcgatgtgcacgcgctcgggcattggtttgacggccggctgaatctgaagaccagcttccactgctacggagcctgtacaaagtatgaatacccttggcatacggctaaatgccactatgagagagattaccagtatgaaacctcctggggctgtaacccctctgactgccccggggtgggaacaggctgcaccgcctgtgggctttacctcgaccagctgaagcctgtcggaagcgcttataaaatcattacaatccgctactcccggagagtttgcgtgcagtttggcgaggaaaatctgtgtaaggtgattgatatgaacgactgcttcgtctctcgccatgtgaaggtttgtatcattgggaccgtgagcaaattttcccaaggcgatacgctcctgttctttggaccgcttgagggcgggggactgatcttcaagcactggtgcacaagcacctgtcagtttggcgaccccggggatatcatgtctcctcgggacaaaggattcctctgccccgagttccctggctcctttagaaagaaatgtaatttcgccaccacacccgtctgcgaatacgatgggaacatggtgagcggctataagaaagttatggcgaccattgactcttttcagtccttcaatacaagcacgatgcactttaccgatgagcgcatcgaatggaaggaccctgatggaatgctgcgggaccatattaacatcctggtgacaaaggatattgacttcgacaatcttggcgagaacccctgtaaagtcgggctcagaacctcttccatcgaaggagcctggggcagcggggtgggatttacactgacctgcctgatctccctcacggagtgcccgaccttcctgacaagcattaaggcttgtgataaagccatctgctacggcgctgagtctgttacccttacacgcgggcagaacaccgtgaaggtcagcggcaaaggaggccactccgggtctacatttaagtgttgccatggagaagactgtagccaatccggcctgcacgccgccgctcctcatctcgataaggtgaatgggatttctgagatcgaaaacagcaaagtgtatgacgatggagcgccccagtgcggcattaagtgttggttcgtcaaatccggcgagtggatctctgggatttttagcggaaattggatcgttctgatcgtgctgtgcgtgttccttctcttctccctggtcctgctcagcattctgtgtcctgtgcggaagcacaaaaagtcttga

SEQ ID NO: 13390 - RNA, 3408 nt, synthetic construct
  misc_feature 1..3408: note = derived and/or modified CDS sequence (opt5) from HTNV(CGHu3612)__EF990923.1__GP
  source 1..3408: mol_type = other RNA
atgggcatctggaagtggctggtgatggccagcctcgtctggcccgctttcgccctgagaaacctttacgacatgaaaattgagtgccctcacaccgtttcctttggggaaaattctgtgacaggatatgtggagctgccgcccatgcctctcgcggatacgacccagatggtccccgaaagctcctgttctatggacaaccatcaaagcctgaatacaatcaccaagtacacacagattatctggcggggcaaagctgatcagtcccagtctagccaaaactccttcgagaccgtgagcacagaagttgaccttaaggggacctgcgtgctgaaacacaagatgattgaggagtcttatcgctccagaaagagcatcacgtgttacgatctctcttgcaattccacctattgtaaacctacactgtacatgatcgtccccattcatgcctgcaacatgatgaaaagctgtctgatcgccctcggaccttatcgggtgcaggttgtgtacgaacgcacctactgcatgacaggcgtcctgattgaggggaagtgttttgtgccggaccagtctgtggtctccatcattaagcacggaatcttcgatattgctagcgttcatatcgtgtgctttatcgtggccgtcaaaggcaatacctataagattttcgaacaggtgaagaaaacgtttgagtccaactgtaatgacacagagaacaaggttcaaggctactatatctgcattatcgggggaaattctagccccgtgtacgtccctacccttgatgacttcagatccatggaagcctttagcggcattatccggtctccccacggggaggatcacgacctggccggagaagaggtggcgtcctatagcatcgttggccctgccaacgctaaagtgccccattctgccagctccgatacactcgggctgattgcttactctagcatcccgtcctatagctctctttccattctgaccagctctaccgaagccaagcacgtcttctcccctggactctttcgccagctgaatcatacaaaatgcgacaagacggcgatccccctgacctggacaggcatgattgacctccctggctactacgaggccatccacccctgtaccgtgttctgcgtcctgagcgggcccggagcttcctgtgaggccttttctgaaggcgggatcttcaacattgctagccctatgtgccttgtgtccaaacagaatagattccggctgacagagcagcaagttaactttgtgtgtcagcgcgtcgatgtggacatcattgtttattgcaacggacagagaaaggtgatcctcaccaagacgctggtcattggccaatgtatctacacaattacctctcttttcagcctgctcccgggggtggcccactccatcgccgtggaactgtgcgttcccggatttcatggctgggctaccgcggccctgctcgtcacattctgttttggctgggtgctgatccctgctattaccttcatcattcttacaatcctgaaatttattgccaatatcttccacacgagcaaccaggagaatcggctcaagtctgtgctgcgcaaaatcaaggaagagtttgagagaaccaaagggtccatggtctgcgatatttgtaagtatgaatgcgagacatacaaggaacttaaagcccatggagtgagctgcccccagtctcagtgtccttattgcttcacccactgtgagcccacagaagctgcctttcaagcgcattacaaggtttgccaggtgacccaccggttccgcgacgatctgaaaaagacggtcaccccgcagaactttacacctggctgttatagaaccctcaatctgttccggtacaaatccagatgctacatcttcacaatgtgggtgtttctgctcgttctggagagcattctttgggctgcctctgccagcgagatccccctgaaccctgtgtggaatgacaacgctcacggggtcggatccattcccatgcataccgatctcgaactggacttcagcctgacgtcttccagcaagtatacataccgccggaaacttaccaatcctctcgaggaatcccaggccatcgatctgcacgtggagatcgaggaacaaacaattggcgttgacgtgcatgctctggggcactggtttgatggcagactcaacctgaagacctctttccactgttatggagcctgcaccaagtacgagtatccctggcatacagcgaaatgtcactacgaacgcgactatcagtacgagacgagctggggctgcaatccgtccgactgtcctggggtcggaaccggctgcacagcctgcgggctttacctggatcagctcaagcccgtgggatctgcttataaaatcattaccatccggtacagcagacgcgtgtgtgtccagtttggcgaagagaacctgtgcaagattatcgacatgaatgattgtttcgtttcccggcatgtgaaggtgtgcatcattgggacagtctctaaatttagccaaggcgacaccctgcttttctttggacccctcgagggcgggggactgatcttcaagcactggtgtacgtccacatgccagtttggcgatcctggggacattatgagcccgagagataaaggattcctgtgtcccgaatttcctggctctttccgcaagaaatgcaacttcgccaccacccccgtgtgtgagtatgacgggaatatggtttccggctacaagaaagtgatggctacaatcgatagcattcagtcttttaacacctccacaatgcatttcacggacgaacggatcgagtggaaggatcctgacggaatgctcagagatcacattaacatcctggtcaccaaggacatcgactttgataatcttggcgaaaacccctgcaaaattgggctgcagacaagctctatcgagggagcctggggctccggggtgggattcaccctcacatgtctgattagcctgaccgagtgctccacgtttcttaccagcatcaaggcgtgcgacaaagccatttgttatggcgctgaatctgttacactcacccgcgggcaaaatacagtgaaggtcagcggcaaaggaggccactccgggtctagcttcaagtgctgtcatggagaggaatgctcccagatcggcctgcacgccgctgcccctcatctggataaggtgaacgggatctctgagatggaaaatagcaaagtttttgacgatggagctccccagtgtggcattaagtgctggttcgtgaaatccggcgagtggatctctgggatttttagcggaaactggatcgtcctcattgtgctgtgtgtgttccttctgttttccctcgtcctgctgagcatcctttgcccggttcggaagcacaaaaagtcttga

SEQ ID NO: 13391 - RNA, 3408 nt, synthetic construct
  misc_feature 1..3408: note = derived and/or modified CDS sequence (opt5) from HTNV(CGHu3614)__EF990922.1__GP
  source 1..3408: mol_type = other RNA
atgggcatctggaagtggctggtgatggccagcctcgtctggcccgctttcgccctgagaaacctttacgacatgaaaattgagtgccctcacaccgtttcctttggggaaaattctgtgacaggatatgtggagctgccgcccatgcctctcgcggatacgacccagatggtccccgaaagctcctgttctatggacaaccatcaaagcctgaatacaatcaccaagtacacacagattatctggcggggcaaagctgatcagtcccagtctagccaaaactccttcgagaccgtgagcacagaagttgaccttaaggggacctgcgtgctgaaacacaagatgattgaggagtcttatcgctccagaaagagcatcacgtgttacgatctctcttgcaattccacctattgtaaacctacactgtacatgatcgtccccattcatgcctgcaacatgatgaaaagctgtctgatcgccctcggaccttatcgggtgcaggttgtgtacgaacgcacctactgcatgacaggcgtcctgattgaggggaagtgttttgtgccggaccagtctgtggtctccatcattaagcacggaatcttcgatattgctagcgttcatatcgtgtgctttttcgtggccgtcaaaggcaatacctataagatctttgaacaggtgaagaaaacgttcgagtccaactgtaatgacacagagaacaaggttcaaggctactatatttgcatcattgggggaaattctagccccgtgtacgtccctacccttgatgactttagatccatggaagccttcagcggcatctttcggtctccccacggggaggatcacgacctggccggagaagaggtggcgtcctatagcattgttggccctgccaacgctaaagtgccccattctgccagctccgatacactcgggctgatcgcttactctagcatcccgtcctatagctctctttccattctgaccagctctaccgaagccaagcacgtcttctcccctggactctttccccagctgaatcatacaaaatgcgacaagacggcgatccctctgacctggacaggcatgattgacctccccggctactacgaggccatccacccctgtaccgtgttctgcgtcctgagcgggcctggagcttcctgtgaggccttctctgaaggcgggatttttaacatcgctagcccgatgtgccttgtgtccaaacagaatcgcttcagactgacagagcagcaagttaactttgtgtgtcagcgggtcgatgtggacatcattgtttattgcaacggacagcgcaaggtgatcctcaccaagacgctggtcattggccaatgtatctacacaattacctctcttttcagcctgctccccggggtggcccactccatcgccgtggaactgtgcgttcctggatttcatggctgggctaccgcggccctgctcgtcacattctgttttggctgggtgctgattcccgctatcaccttcatcattcttacaatcctgaaatttattgccaatatcttccacacgagcaaccaggagaatagactcaagtctgtgctgcggaaaattaaggaagagtttgagcgcaccaaagggtccatggtctgcgatatctgtaagtatgaatgcgagacatacaaggaacttaaagcccatggagtgagctgccctcagtctcagtgtccctattgcttcacccactgtgagccgacagaagctgcctttcaagcgcattacaaggtttgccaggtgacccacagattccgggacgatctgaaaaagacggtcacccctcagaacttcacacccggctgttatcgcaccctcaatctgtttagatacaaatcccggtgctacatcttcacaatgtgggtgtttctgctcgttctggagagcattctttgggctgcctctgccagcgagatccctctgaaccccgtgtggaatgacaacgctcacggggtcggatccattcctatgcataccgatctcgaactggacttcagcctgacgtcttccagcaagtatacatacagacgcaaacttaccaatcccctcgaggaatcccaggccatcgatctgcacgtggagattgaggaacaaacaatcggcgttgacgtgcatgctctggggcactggtttgatggccggctcaacctgaagacctctttccactgttatggagcctgcaccaagtacgagtatccgtggcatacagcgaaatgtcactacgaaagagactatcagtacgagacgagctggggctgcaatccttccgactgtcccggggtcggaaccggctgcacagcctgcgggctttacctggatcagctcaagcccgtgggatctgcttataaaatcattaccatccgctacagccggagagtgtgtgtccagtttggcgaagagaacctgtgcaagattatcgacatgaatgattgtttcgtttcccgccatgtgaaggtgtgcattatcgggacagtctctaaatttagccaaggcgacaccctgcttttctttggacctctcgagggcgggggactgatcttcaagcactggtgtacgtccacatgccagtttggcgatccgggggacattatgagcccccgggataaaggattcctgtgtcctgagttccccggctcttttagaaagaaatgcaacttcgccaccacccctgtgtgtgaatatgacgggaatatggtttccggctacaagaaagtgatggctacaatcgatagctttcagtctttcaacacctccacaatgcattttacggacgaacgcattgagtggaaggatcccgacggaatgctccgggatcacatcaacattctggtcaccaaggacatcgacttcgataatcttggcgaaaacccttgcaaaattgggctgcagacaagctctatcgagggagcctggggctccggggtgggatttaccctcacatgtctgatcagcctgaccgagtgctccacgttccttaccagcattaaggcgtgcgacaaagccatctgttatggcgctgaatctgttacactcaccagagggcaaaatacagtgaaggtcagcggcaaaggaggccactccgggtctagctttaagtgctgtcatggagaggaatgctcccagattggcctgcacgccgctgctccccatctggataaggtgaacgggatctctgagatggaaaatagcaaagttttcgacgatggagccccgcagtgtggcattaagtgctggtttgtgaaatccggcgagtggatctctgggatcttcagcggaaactggattgtcctcatcgtgctgtgtgtgttccttctgttttccctcgtcctgctgagcattctttgccctgttcgcaagcacaaaaagtcttga

SEQ ID NO: 13392 - RNA, 3408 nt, synthetic construct
  misc_feature 1..3408: note = derived and/or modified CDS sequence (opt5) from HTNV(CGRn15)__EU363814.1__GP
  source 1..3408: mol_type = other RNA
atggagatctggaagtggctggtgatggccagcctcgtctggcccgctctggcccttagaaacgttcacgacatgaaaattgaatgccctcataccgtgtccttcggcaaaaattctgtgatcgggtacgtcgagctgccgcccatgcctctcgcggatacaattcagatggtgcccgaaagctcctgttctatggacaaccaccaaagcctgtccacggttaccaagtatacacaggtgtcttggcggggaaaggctgatcaggcccagagctcccaaaccagctctgagacagtctccgtggaagttgaccttaaagggacctgcgtgctgaagcataagctcgtcgaggagagctaccgctctagaaaatccctgacatgttatgatctgagctgcaattctacctactgtaagcctacgctctatatgatcgtgcccattcacgcctgcaacatgatgaaatcctgtatcatcgctctgggccctcatcgggtgcaggtcgtttacgaacgcacctattgcatgacaggagtgcttctggagggcaagtgttttgtgccggaccagagcgtcgtgtccattgttagacacgggatcttcgatattgcctctgtgcacatcgcttgctttttcgtcgccattaccggaaatacatacaaactctttgaacaggtgaaaaagagcttcggcaccacgtgtaacgacacagagaataaggttcaaggctactatatctgcattcttgggggaaactcccctcccatctacgtgcccacccttgatgactttcggagcatggaggcgttctctggcatctttaagtcccctcatggggaagatcacgacctggccggagaggaaattgctagctattctatcgtcggccccgccaatgctaaagtgccgcatagcgcctcctctgatacactcagcctgattgcgttctccgggatccctagctactcttccctgagcattctcacctcttccaccgaggccaagcacgtctttagccccggactgttccctcagcttaaccacacaaaatgcgacaagacggctatccccctgacctggacaggcatcattgacctccccggctattacgaagccgtgcatccttgtaccgttttctgcgtgctgtccgggccgggagcttcttgtgaggccttcagcgagggcgggatcttcaatattacatcccccatgtgccttgtctctaaacagaaccgctttagactgaccgaacagcaagtgaatttcgtttgtcagcgggtggatatggacatcgtcgtgtattgcaacggacagcgcaaggtgattctcacgaagacactggttatcggccaatgtatctacaccattaccagcctgttttccctcctgcctggggtcgcccacagcatcgctgtggagctttgcgtgcccggattccatggctgggcgacagccgctctgctcattaccttttgtttcggctgggtcctgatccctgcccttacatttattgtgctgacggttctcaaattcatcgccaatatttttcacacctctaaccaggaaaacagactgaagatggtgctgaaaaagatcaaagaggaatttgagcggacaaaggggtccatggtctgcgatatctgtaagtacgagtgcgaaacctataaagagctcaaggctcatggagtgagctgcccccagtctcagtgtccgtactgctttacacactgtgaacctaccgagtccgccttccaagcgcactatcgcgtttgccaggtgacgcatagatttcgggacgatctgaaaaagaccgtcacaccccagaatttcacccctggctgttaccgcacacttaacctgttcagatataaaagccggtgctacatttttaccatgtggatctgtctcctggtgctggaatctattctttgggctgccagcgcctccgagatccccctcagccctacgtggaatgacaacgctcacggggttggatctattcccatgcatacagatctggagctggacttctccctcaccagctcctctaagtatacatacagacgcaagctgaccaatccgcttgaagagagccaggccgtgaactttcacgtcgaaatcgaggagcaagctatcggcgtggatgtgcacgccctggggcattggttcgacggccggctcaatctgaaaacctcctttcactgctacggagcgtgtacaaagtatgaatacccttggcatacggccaaatgccactatgagagagattaccagtatgaaacctcttggggcagcaacccctccgactgtcccggggtcggaacaggctgcaccgcttgcgggctgtaccttgaccagctcaagcctgttggatctgcctataaaattatcacaattcgctacagccggagagtgtgtgtgcagttcggcgaggaaaatctgtgcaaggtcatcgatatgaacgactgttttgtgtcccgccatgttaaggtgtgcattatcgggaccgtcagcaaattctctcaaggcgatacgctgctctttttcggaccgctggagggcgggggacttatctttaagcactggtgtacatccacatgccagttcggcgaccccggggatattatgagccctcgggacaaaggatttctgtgtcccgagttccctggctctttcagaaagaaatgcaattttgctaccacccccgtgtgtgaatacgatgggaacatggtttccggctataagaaagtgatggccaccatcgacagcttccagtcttccaatacaagcacgatgcactttaccgatgagcgcattgaatggaaggaccctgatggaatgctccgggaccatatcaacattctggtcacaaaggatatcgacttcgacaatctgggcgagaacccctgcaaaatcgggcttcagacctccagcattgaaggagcgtggggctctggggtgggatttacactcacctgtctgatcagcctgacggagtgcccgaccttcctcacatccattaaggcctgcgataaagctatctgttacggcgccgagtctgttaccctgacaagagggcaaaacaccgtgaaggtcagcggcaaaggaggccactccgggtctacatttaagtgctgtcatggagaagactgcagccagtccggccttcacgctgccgcccctcatctggataaggtgaatgggatttctgagatcgaaaacagcaaagtgtatgacgatggagctccccagtgtggcgtcaagtgctggttcgttaaatccggcgagtggattagcgggatcttttctggaaattggatcgtgctcattgtgctgtgtgtcttcctgctgttttccctcgtgctgctgagcatcctctgccctgttcgcaagcacaaaaagtcttga

SEQ ID NO: 13393 - RNA, 3408 nt, synthetic construct
  misc_feature 1..3408: note = derived and/or modified CDS sequence (opt5) from HTNV(CGRn2616)__EU363816.1__GP
  source 1..3408: mol_type = other RNA
atggagatctggaagtggctggtgatggccagcctcgtctggcccgctctggcccttagaaacgttcacgacatgaaaattgaatgccctcataccgtgtccttcggcaaaaattctgtgatcgggtacgtcgagctgccgcccatgcctctcgcggatacaattcagatggtgcccgaaagctcctgttctatggacaaccaccaaagcctgtccacggttaccaaacatacacaggtgtcttggcggggaaaggctgatcaggcccagagctcccaaaccagctttgagacagtctctgtggaagttgaccttaaagggacctgcgtgctgaagcacaagctcgtcgaggagtcctatcgcagcagaaaatctctgacatgttacgatctgtcctgcaatagcacctattgtaagcctacgctctacatgatcgtgcccattcatgcctgcaacatgatgaaatcttgtatcatcgctctggggcctcaccgggtgcaggtcgtttatgaacgcacctactgcatgacaggagtgcttctggagggcaagtgtttcgtgccggaccagtccgtcgtgagcattgttagacacgggatctttgatattgcctccgtgcatatcgcttgcttctttgtcgccattaccggaaatacatataaactcttcgaacaggtgaagaagtcttttggcaccacgtgtaacgacacagagaataaagttcaaggctactacatctgcattctgggcggaaacagccctcccatctatgtgcccacccttgatgacttccggtccatggaggcgtttagcggcatcttcaagtctcctcacggggaagatcatgacctggccggagaggaaattgcttcctacagcatcgtcggccccgccaatgctaaagtgccgcactctgccagctccgatacactctctctgattgcgtttagcgggatcccttcctatagctctctgtccattctcaccagctctaccgaggccaagcacgtcttctcccccggactgtttcctcagcttaaccatacaaaatgcgacaagacggctatccccctgacctggacaggcatcattgacctccccggctactatgaagccgtgcacccttgtaccgttttctgcgtgctgagcgggccgggagcttcctgtgaggccttctctgagggcgggatctttaatattacaagccccatgtgccttgtctccaaacagaaccgcttcagactgaccgaacagcaagtgaattttgtttgtcagcgggtggatatggacatcgtcgtgtactgcaacggacagcgcaaggtgattctcacgaagacactggttatcggccaatgtatctataccattacctctctgttcagcctcctgcctggggtcgcccattccatcgctgtggagctttgcgtgcccggatttcacggctgggcgacagccgctctgctcattaccttctgttttggctgggtcctgatccctgcccttacattcattgtgctgacggttctcaaatttatcgccaatattttccataccagcaaccaggaaaacagactgaagatggtgctgaaaaagatcaaagaggaatttgagcggacaaaggggtctatggtctgcgatatctgtaagtacgagtgcgaaaccaataaagagctcaaggctcacggagtgtcctgcccccagagccagtgtccgtactgcttcacacactgtgaacctaccgagtctgcctttcaagcgcattatcgcgtttgccaggtgacgcacagattccgggacgatctgaaaaagaccgtcacaccccagaacttcacccctggctgttaccgcacacttaatctgtttagatataaatcccggtgctacattttcaccatgtggatctgtctcctggtgctggaaagcattctttgggctgcctctgccagcgagatccccctctcccctacgtggaacgacaatgctcatggggttggaagcattcccatgcacacagatctggagctggacttttctctcacctccagctccaagtatacatacagacgcaagctgaccaacccgcttgaagagtctcaggccgtgaatttccacgtcgaaatcgaggagcaagctatcggcgtggatgtgcatgccctggggcactggtttgacggccggctcaacctgaaaaccagcttccattgctatggagcgtgtacaaagtacgaatacccttggcacacggccaaatgccattatgagagagattaccagtatgaaacctcctggggctgtaatccctctgactgccccggggtcggaacaggctgcaccgcttgtgggctgtaccttgaccagctcaagcctgttggaagcgcctataaaattatcacaattcgctactcccggagagtgtgcgtgcagtttggcgaggaaaacctgtgtatcgtcattgatatgaatgactgcttcgtgtctcgccacgttaaggtgtgtatcatcgggaccgtcagcaagttttcccaaggcgatacgctcctcttctttggaccgctggagggcgggggacttattttcaaacactggtgcacaagcacctgtcagtttggcgaccccggggatatcatgtctcctcgggacaagggattcctgtgccccgagttccctggctcctttagaaagaagtgtaacttcgctaccacacccgtgtgcgaatatgggggcaatatggttagcggatacaaaaaggtgatggccaccattgattcttttcagtccttcaacacaagcacgatgcattttaccgacgagcgcatcgaatggaaagatcctgacggcatgctccgggatcacattaatatcctggtcacaaaggacatcgatttcgacaacctgggggagaacccctgtaagattggacttcagacctcttccatcgaaggcgcgtgggggagcggagtgggctttacactgacctgcctgatttccctgacggagtgcccgaccttcctcacaagcatcaaagcctgtgacaaggctatttgctacggggccgagtctgttaccctgacaagaggccaaaataccgtgaaagtcagcggaaagggcgggcattccggatctacatttaaatgttgccacggcgaagattgtagccagtccgggcttcatgctgccgcccctcacctggacaaggtgaacggaatctctgagattgaaaatagcaaggtgtatgatgacggcgctccccagtgcggcatcaaatgttggttcgtcaagtccggggagtggatctctggaatttttagcggcaactggatcgttctcattgtgctgtgcgtgttcctgcttttctccctcgtcctgctgagcatcctctgtcctgtgcgcaaacacaagaaatcttga

SEQ ID NO: 13394 - RNA, 3408 nt, synthetic construct
  misc_feature 1..3408: note = derived and/or modified CDS sequence (opt5) from HTNV(CGRn2618)__EU363817.1__GP
  source 1..3408: mol_type = other RNA
atggagatctggaagtggctggtgatggccagcctcgtctggcccgctctggcccttagaaacgttcacgacatgaaaattgaatgccctcataccgtgtccttcggcaaaaattctgtgatcgggtacgtcgagctgccgcccatgcctctcgcggatacaattcagatggtgcccgaaagctcctgttctatggacaaccaccaaagcctgtccacggttaccaagtatacacaggtgtcttggcggggaaaggctgatcaggcccagagctcccaaaccccttttgagacagtcagcgtggaagttgaccttaaaagaacctgcgtgctgaagcataagctcgtcgaggagtcttaccgctcccggaaaagcctgacatgttatgatctgtcttgcaattccacctactgtaagcccacgctctatatgatcgtgcctattcacgcctgcaacatgatgaaaagctgtatcatcgctctgggcccgcatcgcgtgcaggtcgtttacgaaagaacctattgcatgacaggggtgcttctggagggaaagtgtttcgtgcccgaccagtctgtcgtgtccattgttcggcacggcatctttgatattgccagcgtgcacatcgcttgcttctttgtcgccattaccgggaatacatacaaactcttcgaacaggtgaagaagtcctttggaaccacgtgtaacgacacagagaataaagttcaaggctactatatctgcattctgggcgggaactctcctcccatctacgtgcctacccttgatgacttccgcagcatggaggcgttttccggaatcttcaagagcccccatggcgaagatcacgacctggccggggaggaaattgcttcttattccatcgtcggaccggccaatgctaaagtgcctcatagcgcctctagcgatacactctccctgattgcgttttctggcatccccagctactccagcctgtctattctcacctccagcaccgaggccaagcacgtcttctctcctgggctgtttccccagcttaaccacacaaaatgcgacaagacggctatccccctgacctggacaggaatcattgacctccctggctattacgaagccgtgcatccgtgtaccgttttctgcgtgctgtccggccccggggctagctgtgaggccttctccgagggaggcatctttaatattacatctcctatgtgccttgtcagcaaacagaacagattccggctgaccgaacagcaagtgaattttgtttgtcagcgcgtggatatggacatcgtcgtgtattgcaacgggcagagaaaggtgattctcacgaagacactggttatcggacaatgtatctacaccattacctccctgttctctctcctgcccggcgtcgcccacagcatcgctgtggagctttgcgtgcctgggtttcatggatgggcgacagccgctctgctcattaccttctgttttggctgggtcctgatccccgcccttacattcattgtgctgacggttctcaaatttatcgccaatattttccacacctccaaccaggaaaaccggctgaagatggtgctgaaaaagatcaaagaggaatttgagcgcacaaagggcagcatggtctgcgatatctgtaagtacgagtgcgaaacctataaagagctcaaggctcatggggtgtcttgcccgcagtcccagtgtccttactgcttcacacactgtgaacccaccgagagcgcctttcaagcgcactatagagtttgccaggtgacgcatcggttccgcgacgatctgaaaaagaccgtcacacctcagaatttcacccccggatgttacagaacacttaacctgtttcggtataaatctagatgctacattctcaccatgtggaatctgctgcttatccctggctatcgcctctgggctgcctccgccagcgaaattcccctgtctccgacgtggaacgacaatgctcacggggtgggaagcatccctatgcatacagatctggagctcgacttctccctgaccagcagctccaagtacacataccggagaaaacttaccaaccccctggaggaaagccaggccgttaattttcacgtggagattgaggagcaagctatcggcgtcgatgtgcacgccctcgggcattggttcgacggccgcctgaacctgaagacctcctttcactgttatggagcgtgcacaaagtacgagtatccctggcatacggccaaatgtcactacgaacgggattatcagtacgagacctcttggggctgcaatcctagcgactgtccgggggtgggaacaggctgcaccgcttgcgggctttatctcgaccagctgaagcccgtcggatccgcctacaaaatcattacaatcagatactctcgccgggtttgtgtgcagttcggcgaagagaacctgtgcattgtgatcgatatgaatgactgttttgtcagcagacatgtgaaggtttgcattatcgggaccgtgtccaagttctctcaaggcgatacgctcctgtttttcggacctcttgaaggcgggggactgatctttaaacactggtgtacatctacctgccagttcggcgaccccggggatattatgtcccctcgcgacaagggatttctctgtcccgagttccctggcagcttccggaaaaagtgcaactttgctaccacacccgtctgtgagtatgggggcaatatggtgtctggatacaaaaaggttatggccaccatcgattccttccagagctttaacacatctacgatgcacttcaccgacgaaagaattgagtggaaagatccggacggcatgctgcgcgatcatatcaatattctggtgacaaaggacatcgattttgacaaccttggggaaaacccttgcaagatcggactccagacctccagcattgagggcgcgtgggggtctggagtcggcttcacactgacctgtctgatctccctcacggaatgccccacctttctgacaagcattaaagcctgcgacaaggctatctgttatggggccgagtccgtgacccttacacggggccaaaataccgttaaagtgagcggaaagggcgggcactctggaagcacattcaaatgctgtcatggcgaggattgctcccagtctgggctgcacgctgccgcccctcatctcgacaaggtcaacggaattagcgaaatcgaaaattccaaggtgtacgatgacggcgctccccagtgtggcattaaatgctggtttgtgaagtctggggaatggatcagcggaatcttctccggcaactggattgtcctgatcgttctgtgtgtgtttcttctcttctctctggtgctgctcagcattctgtgcccggtcagaaaacacaagaaatcctga

SEQ ID NO: 13395 - RNA, 3408 nt, synthetic construct
  misc_feature 1..3408: note = derived and/or modified CDS sequence (opt5) from HTNV(CGRn45)__EU092225.1__GP
  source 1..3408: mol_type = other RNA
atggagatctggaagtggctggtgatggccagcctcgtctggcccgctctggcccttagaaacgttcacgacatgaaaattgaatgccctcataccgtgtccttcggcaagaatagcgtgatcgggtacgtcgagctgccgcccatgcctctcgcggatacaattcagatggtgcccgaaagctcctgttctatggacaaccaccaaagcctgtccacggttaccaaatatacacaggtgtcttggcggggaaaggctgatcaggcccagagctcccaaaccagctttgaggccgtctctgtggaagttgaccttaaaggcacatgcgtgctgaagcataagctcgtcgaggagtcctaccgcagcagaaaatctctgacctgttatgatctgtcctgcaatagcacatactgtaagcctaccctctatatgatcgtgcccattcacgcttgcaacatgatgaaatcttgtatcatcgccctggggcctcatcgggtgcaggtcgtttacgaacgcacgtattgcatgaccggagtgcttctggagggcaagtgtttcgtgccggaccagtccgtcgtgagcattgttagacacgggatctttgatattgcttccgtgcacatcgcctgcttctttgtcgcgattacaggaaatacctacaaactcttcgaacaggtgaagaagtcttttggcacaacctgtaacgacacggagaataaagttcaaggctactatatctgcattctcgggggaaactctccccctatctacgtgcccacacttgatgacttccggtccatggaggcctttagcggcatcttcaagtctcctcatggggaagatcacgacctggctggagaggaaattgcctcctatagcatcgtcggccccgctaatgccaaagtgccgcattctgcgagctccgataccctctctctgattgcctttagcgggatcccttcctacagctctctgtccattctcacaagctctaccgaggctaagcacgtcttctcccccggactgtttcctcagcttaaccacaccaaatgcgacaagacagccatccccctgacgtggaccggcatcattgacctccccggctattacgaagctgtgcatccttgtacagttttctgcgtgctgagcgggccgggagcctcctgtgaggccttctctgagggcgggatctttaatattaccagccccatgtgccttgtctccaaacagaaccgcttcagactgacagaacagcaagtgaattttgtttgtcagcgggtggatatggacatcgtcgtgtattgcaacggacagcgcaaggtgattctcaccaagacgctggttatcggccaatgtatctacacaattacctctctgttcagcctcctgcctggggtcgctcactccatcgcggtggagctttgcgtgcccggatttcatggctgggccaccgctgccctgctcattacattctgttttggctgggtcctgatccctgcccttaccttcattgtgctgacagttctcaaatttatcgctaatattttccacacgagcaaccaggaaaacagactgaagatggtgctgaaaaagatcaaagaggaatttgagcggaccaaggggtctatggtctgcgatatctgtaagtacgagtgcgaaacatataaagagctcaaggcccatggagtgtcctgcccccagagccagtgtccgtactgcttcacccactgtgaacctacagagtctgcgtttcaagctcactatcgcgtttgccaggtgacccatagattccgggacgatctgaaaaagacggtcacaccccagaatttcacccctggctgttaccgcacccttaacctgtttagatataaatcccggtgctacattttcacaatgtggatctgtctcctggtgctggaaagcattctttgggccgcctctgctagcgagatccccctctcccctacctggaatgacaacgcccacggggttggaagcattcccatgcatacggatctggagctggacttttctctcacatccagctccaagtatacctacagacgcaagctgacaaatccgcttgaagagtctcaggctgtgaacttccacgtcgaaatcgaggagcaagccatcggcgtggatgtgcacgcgctggggcattggtttgacggccggctcaatctgaaaaccagcttccactgctacggagcctgtaccaagtatgaatacccttggcatacagctaaatgccactatgagagagatcatcagtacgaaacgtcctggggctgtaacccctctgactgccccggggtcggaaccggctgcacagcctgtgggctgtatcttgaccagctcaagcctgttggaagcgcttacaaaattatcaccattcgctattcccggagagtgtgcgtgcagtttggcgaggaaaatctgtgtaaggtcatcgatcgcaacgactgcttcgtgtctcggcacgttaaggtgtgtattatcgggacagtcagcaaattttcccaaggcgataccctgctgttctttggaccgctggagggcgggggacttatcttcaagcactggtgcacgagcacatgtcagtttggcgaccccggggatattatgtctcctagagacaaaggattcctgtgccccgagttccctggctcctttcgcaagaaatgtaatttcgccaccacccccgtgtgcgaatacgatgggaacatggttagcggctacaagaaagtgatggcgacaatcgactcttttcagtccttcaataccagcacaatgcattttacggatgagcggattgaatggaaggaccctgatggaatgctcagagaccacatcaacattctggtcaccaaggatatcgacttcgacaatctgggcgagaacccctgtaaaatcgggcttcagacatcttccattgaaggagcctggggcagcggggtgggatttaccctcacatgcctgatctccctgaccgagtgcccgacgttcctcaccagcattaaggcttgtgataaagccatctgctatggcgctgagtctgttacactgacccgcgggcaaaacacagtgaaggtcagcggcaaaggaggccattccgggtctacctttaagtgttgccacggagaagactgtagccagtccggccttcatgccgccgctcctcacctggataaggtgaatgggatttctgagatcgaaaacagcaaagtgtacgacgatggagcgccccagtgcggcattaagtgttggttcgtcaaatccggcgagtggatctctgggatctttagcggaaattggattgttctcatcgtgctgtgcgtgttcctgcttttctccctcgtcctgctgagcattctctgtcctgtgcggaagcacaaaaagtcttga

SEQ ID NO: 13396 - RNA, 3408 nt, synthetic construct
  misc_feature 1..3408: note = derived and/or modified CDS sequence (opt5) from HTNV(CGRn53)__EF990921.1__GP
  source 1..3408: mol_type = other RNA
atgggcatctggaagtggctggtgatggccagcctcgtctggcccgcttacaccctgagaaacgtttatgacatgaaaattgagtgccctcacacagtgtccttcggggaaaattctgtgatcggatacgtcgagcttccgcccattcctctggccgatacgacccagatggtgcccgaaagctcctgttctatggacaaccatcaaagcctcaatacaatcaccaagtatacacaggtttcctggcggggcaaagcggggcaggctcaggcctctcaaaacagctttgaggccgtgtccgctgaagtcgatctgaagggaacctgcgtgcttaaacacaagatgctggaggagagctaccgctctagaaagtccattgcctgttatgacctcagctgcaattctacatactgtaaacctaccctgtatatgatcgttcccatccatgcttgcaacatgatgaagtcctgtctgattgccctcggccctcaccgggtgcaggtcgtgtacgaacgcacgtactgcatgaccggggtgctgatcgagggaaaatgtttcgtcccggatcagagcgttgtgtctattatcaagcatggcatttttgacatcgcgtccgtgcacattgtctgcttctttgtggccgttaaaggcaatacatataagatcttcgaacagatcaagaaatcctttgagagcacctgtaacgatacaaagaataaagtgcaagggtactatatttgcatcgtcggaggcaactctgctcccatttacgtgcctacccttgacgatttcagaagcatggaggccttttccgggatcttccggagcccccacggagaagaccatgatctggctggcgaggaaattgcctcttattccatcgttgggcctgcgaatgccaaggtgccccacagcgcttctagcgacacgctctccctgacagcctactctggaatcccgagctattccagcctttctattctggctggctccgccgaggccaaacatgtctttagccctggcttctttccccagctcaaccacaccaagtgcgataaaacagctatccctctgatgtggaccgggatgattgacctgcccggatactacgaagcgatccacccctgtaccgtgttctgcgtcctctctggccctggggcctcctgtgaggctttcagcgagggaggcatttttaatatcacatccccgatgtgcctggtgtctaagcagaaccgcttcagacttacggaacagcaagttaattttgtgtgtcagcgggtcgacatggatatcattgtgtattgcaacgggcagcgcaaggttatcctgaccaaaacactcgtgattggacaatgtatctacaccattacaagcctgttctcccttctgcccggcgtcgcccattctatcgccgtggagctctgcgtgcctggctttcacgggtgggctaccgccgcgctgctggttacgttctgttttggatgggtcctcattcccgctatgacattcatcgtgctgaccatccttaagtttattgccaacatcttccataccagcaatcaggaaaacaaactgaagtccgtgctcagaaaaattaaggaggaatttgagaagacaaaaggcagcatggtctgcgacgtgtgtaagtatgagtgcgaaacctacaaagagctgaaggcccacggggtttcttgccctcagtcccagtgtccctattgcttcacacattgtgaaccgacggaggctgcctttcaagctcactaccgggtgtgccaggtcacccaccgcttcagagatgaccttaaaaagacagtgacccctcagaatttcacacccggatgttatcggaccctgaacctctttcgctacaagagcagatgctacatcctgacgatgtggaatctgctcctggttcctggctatcgggcctgggcggcctctgcttccgaaattccccttaaccctgtgtggaatgataacgcccatggggtcggcagcgtgcccatgcacaccgacctggagctcgatttctctctgacaagctccagcaaatacacctatagacgcaagctgacaaatccgcttgaggaatctcaggctatcaacctccatatcgagattgaggaacaaaccatcggagttgacgtgcacgccctgggccactggtttgtcgggcggctgaatctcaaaacgtccttccattgttacggagcgtgcacaaagtatgagtacccttggcacaccgccaaatgtcattatgaaagagattaccagtacgagacaagctggggctgcaacccctccgactgtcccggggtgggaaccggctgcaccgcttgcgggctgtatcttgatcagctgaagcctgtgggctctgcctacaagattatcacaattcgctatagccggagagtctgtgttcagtttggagaagagaatctctgcaaaatcatcgacatgaacgactgtttcgtgtcccgccacgtgaaggtctgcattatcggcacggtgtctaaatttagccaaggggataccctgctgttctttggaccgcttgaaggcgggggactcattttcaagcattggtgtacatccacatgccagtttggcgaccccggggatatcatgtctcctcgggacaaaggcttcctgtgtcccgagtttcctggcagcttcagaaagaaatgcaatttcgctaccacgcccctgtgtgagtacgatggaaacatggtttccgggtataagaaggtgatggccaccattgacagctttcagtctttcaacacatccaccatgcactttaccgatgaacgcatcgagtggaaagaccctgatggaatgctccgggaccacatcaatattctggtcacaaaggatatcgacttcgaaaaccttggcgagaatccctgcaaaattgggctgcagaccagctctatcgaaggagcctggggctccggggtgggctttacactcacgtgtctggttagcctgaccgagtgcccgacattccttacctctattaaggcttgcgataaagcgatctgttacggagccgagtccgtgacactcaccagaggccaaaacacggtcaaggtgagcgggaagggaggccattccgggagcacctttaaatgctgtcacggagaagagtgctctcagattggcctgcatgctgccgcccctcacctggacaaggttaatggcatcagcgaaatcgagaacaataaagtgtatgacgatggggctccccagtgtggaattaagtgctggttcgtcaaatccggcgaatggatctctgggatttttagcggaaactggatcgtgctcattgtgctgtgtgtcttccttctgttttccctcatcctgctgtctatcctttgccctgttcgcaagcataagaaaagctga

SEQ ID NO: 13397 - RNA, 3408 nt, synthetic construct
  misc_feature 1..3408: note = derived and/or modified CDS sequence (opt5) from HTNV(CGRn93MP8)__EF990919.1__GP
  source 1..3408: mol_type = other RNA
atgggcatctggaagtggctggtgaaagccagcctcgtctggcccgcttacaccctgagaaacgtttatgacatgaagattgagtgccctcacacagtgtccttcggggaaaattctgtgatcggatacgtcgagcttccgcccattcctctggccgatacgacccatatggtgcccgaaagctcctgttctatggacaaccaccagagcctcaatacaatcaccaaatatacacaagtttcctggcggggcaaggcggatcaggctcaggcctctcagaacagctttgaggccgtgtccgctgaagtcgacctgaaagggacctgcgtgcttaagcataagatgctggaggagagctaccgctctagaaaatccattgcctgttatgatctcagctgcaattctacatactgtaagcctaccctgtatatgatcgttcccatccacgcttgcaacatgatgaaatcctgtctgattgccctcggacctcatcgggtgcaagtcgtgtacgaacgcacgtactgcatgaccggcttcctgatcgaggggaagtgttttgtgccggacagaagcgtcgtttctattatcaaacacggaattttcgatatcgcgtccgtgcacattgtgtgctttttcgtcgccgtgaagggcaatacatataagatctttgaacagatcaaaaagagcttcgagtccacctgtaacgacaccaaaaataaggttcagggctactatatttgcatcgtcgggggaaactctgctcccatttacgtgcctacacttgatgactttcggagcatggaggccttctccggcatctttcgcagcccccatggggaagatcacgacctggctggagaggaaattgcctcttattccatcgtgggccctgcgaatgccaaagttccccatagcgcttctagcgatacgctctccctgacagcctactctgggatcccgagctattccagcctttctattctggctggatccgccgaggccaagcacgtgttcagccctggctttctcccccagctgaaccacaccaaatgcgacaagacagctatccctctgatgtggaccggcatgattgacctccccgggtactacgaagcgatccatccctgtaccgtcttctgcgtgctgtctggacctggcgcctcctgtgaggctttcagcgaagggggaatttttaatatcacatccccgatgtgccttgtctctaagcaaaacagattccggctgacggagcaacaggtgaattttgtttgtcagcgcgtggatatggacatcattgtctattgcaacggccagagaaaagtgatcctcaccaagacactggttattgggcagtgtatctacaccattacaagccttttctccctgctccccggagtggcccactctatcgccgtcgagctgtgcgtgcctggctttcatggctgggctaccgccgcgctgctcgtgacgttctgttttgggtgggttctgattcccgctatgacattcatcgtccttaccatcctgaaatttattgccaacatcttccacaccagcaatcaggaaaacaagctcaaatccgtgctgcggaagattaaggaggaatttgagaaaacaaagggaagcatggtgtgcgatgtctgtaaatatgagtgcgaaacctacaaggagcttaaagcccatggcgtgtcttgccctcaatcccagtgtccctattgcttcacacactgtgaaccgacggaggctgcctttcaggctcactaccgcgtttgccaggtgacccatagattccgggacgatctgaagaagacagtcacccctcaaaatttcacacccgggtgttatcgcaccctcaacctgtttagatacaaaagccggtgctacatcttcacgatgtgggtgtttctgctcgttctggaatctattctttgggccgcgtccgccagcgagatccctctgaatcccgtgtggaacgacaatgctcacggagtcggctctgtgcctatgcataccgatctcgagctggacttcagcctgacatccagctctaagtatacctacagacgcaaacttacaaaccccctcgaagagtcccaggccatcaatctgcacattgaaatcgaggagcagaccattggggttgatgtgcacgctctgggccattggtttgacggacggctcaacctgaagacgagcttccactgttatggcgcctgcacaaaatacgaatatccgtggcataccgcgaagtgtcactacgagagagattatcagtacgaaacatcctgggggtgcaatccttctgactgtcccggagtcggcaccgggtgcaccgcctgcggactttacctggaccaactcaagcccgtgggcagcgcttataaaatcattacaatccgctactcccggagagtgtgtgtccagtttggggaggaaaacctgtgcaagatcattgatatgaatgactgtttcgtttctcgccatgtgaaagtgtgcatcattggcacggtcagcaagttttcccagggagataccctgcttttctttggccctctcgaagggggaggcctgatcttcaaacactggtgtacatctacctgccagtttggggacccgggagatattatgagcccccgggacaagggcttcctgtgtcctgagttccccgggtcctttcgcaaaaagtgcaacttcgccacaacccctctctgtgagtatgatggcaatatggtgagcggatacaagaaagttatggctacgatcgactcttttcaatccttcaacacaagcaccatgcactttaccgatgagagaatcgaatggaaggaccccgatggcatgctgcgggaccatattaacatccttgtgacaaaagatattgacttcgagaatctgggggaaaacccttgcaagatcggactccagacctcttccattgagggcgcctgggggagcggagtcggctttacactgacgtgtctggtgtctcttaccgagtgccccacattcctcacctccatcaaagcctgcgacaaggctatttgttatggggcggaaagcgttacactgaccagaggccagaatacggtgaaggtctccggaaaaggcgggcacagcggatctacctttaagtgctgtcatggcgaggaatgcagccagatcgggctgcacgccgctgccccgcatctcgataaagtgaacggaatctccgagattgaaaataacaaggtttacgacgatggcgcccctcaatgtggcatcaaatgctggttcgtgaagtctggggagtggattagcggaatcttttccggcaattggattgtcctgatcgtgctttgtgtgttcctcctgttctctctgatcctgcttagcattctctgccccgtccgcaagcacgagaaatcctga

SEQ ID NO: 13398 - RNA, 3408 nt, synthetic construct
  misc_feature 1..3408: note = derived and/or modified CDS sequence (opt5) from HTNV(CGRn93P8)__EF990918.1__GP
  source 1..3408: mol_type = other RNA
atgggcatctggaagtggctggtgatggccagcctcgtctggcccgcttacaccctgagaaacgtttatgacatgaaaattgagtgccctcacacagtgtccttcggggaaaattctgtgatcggatacgtcgagcttccgcccattcctctggccgatacgacccagatggtgcccgaaagctcctgttctatggacaaccatcaaagcctcaatacaatcaccaagtatacacaggtttcctggcggggcaaagcggatcaggctcaggcctctcaaaacagctttgaggccgtgtccgctgaagtcgacctgaaggggacctgcgtgcttaaacacaagatgctggaggagagctaccgctctagaaagtccattgcctgttatgatctcagctgcaattctacatactgtaaacctaccctgtatatgatcgttcccatccatgcttgcaacatgatgaagtcctgtctgattgccctcggacctcaccgggtgcaggtcgtgtacgaacgcacgtactgcatgaccggcgtgctgatcgaggggaaatgtttcgtcccggacagaagcgttgtgtctattatcaagcatggaatttttgatatcgcgtccgtgcacattgtctgcttctttgtggccgttaaaggcaataactataagatcttcgaacagatcaagaaatcctttgagagcacatgtaatgacaccaagaacaaagtgcagggctactatatttgcatcgtcgggggaaattctgctcccatttacgtgcctacacttgatgacttccggagcatggaggccttttccggcatcttccgcagcccccacggggaagatcatgacctggctggagaggaaattgcctcttattccatcgttggccctgcgaacgccaaggtgccccacagcgcttctagcgataccctctccctgacggcctactctgggatcccgagctattccagcctttctattctggctggatccgccgaggccaaacatgtctttagccctggcttctttccccaactcaatcacacaaagtgcgacaaaaccgctatccctctgatgtggacaggcatgattgacctgcccgggtactacgaagcgatccacccctgtaccgtgttctgcgtcctctctggacctggcgcctcctgtgaggctttcagcgaagggggaatttttaacatcacctccccgatgtgcctggtgtctaagcagaatagattccggcttacagagcagcaggttaactttgtgtgtcaacgcgtcgatatggacatcattgtgtattgcaacggccagagaaaggttatcctgacgaaaaccctcgtgattgggcagtgtatctacacaattaccagcctgttctcccttctgcccggagtcgcccattctatcgccgtggagctctgcgtgcctggctttcacggctgggctacagccgcgctgctggttaccttctgttttgggtgggtcctcattcccgctatgacgttcatcgtgctgacaatccttaagtttattgccaatatcttccataccagcaaccaagaaaataaactgaagtccgtgctccggaaaattaaggaggaatttgagaagaccaaaggaagcatggtctgcgatgtgtgtaagtatgagtgcgaaacatacaaagagctgaaggcccacggcgtttcttgccctcagtcccagtgtccctattgcttcacccattgtgaaccgacagaggctgcctttcaggctcactaccgcgtgtgccaagtcacgcacagattccgggacgatcttaaaaagaccgtgacacctcagaacttcacccccgtttgttatcgcacactgaatctctttagatacaagagccggtgctacatcttcaccatgtgggtgtttctgctggtcctcgaatctattctgtgggccgcgtccgccagcgagatccctcttaaccccgtgtggaatgacaacgctcatggggttggatctgtgcctatgcacacggatctggagctcgacttcagcctgacctccagctctaaatatacatacagacgcaagctgaccaatccccttgaagagtcccaggccatcaacctccatattgaaatcgaggagcagacaattggcgtcgatgtgcacgctctggggcactggtttgacggccggctgaatctcaaaaccagcttccattgttatggagcctgcacgaagtacgaatatccgtggcacacagcgaaatgtcattacgagagagattatcaatacgaaacctcctggggctgcaacccttctgactgtcccggggtgggaacaggctgcaccatctgcgggctgtaccttgaccagctgaagcccgtcggaagcgcctataagattatcaccatccgctactcccggagagtttgtgtgcagtttggcgaggaaaatctctgcaaagtgattgatatgaacgactgtttcgtctctcgccacgtgaaggtttgcatcattgggacagtgagcaaattttcccagggcgatacgctgctgttctttggacctcttgagggcgggggactcatcttcaagcattggtgtacctctacatgccaatttggcgacccgggggatattatgagcccccgggacaaaggattcctgtgtcctgagttccccggctcctttagaaagaaatgcaatttcgctaccacacctgtctgtgaatatgatgggaacatggtgagcggctacaagaaggttatggccaccatcgactcttttcagtccttcaacacgagcacaatgcactttaccgatgagcgcatcgaatggaaagaccccgatggaatgctgcgggaccacattaatatcctcgtgaccaaggatattgacttcgacaacctgggcgagaatccttgcaaaatcgggcttcagacatcttccattgaaggagcttggggcagcggggtcggatttaccctgacatgtctcatctctctgacggagtgccccaccttcctgacatccattaaggcctgcgataaagccatctgttatggcgctgagagcgtgacccttacaagagggcagaacaccgttaaggtgtccggcaagggaggccatagcgggtctacgtttaaatgctgtcacggagaagactgcagccaatccggcctccatgcggccgctccgcacctggataaggtcaatgggatctctgagattgaaaacagcaaagtgtacgacgatggagcccctcagtgtggcatcaagtgctggttcgtgaaatccggcgagtggatttctgggatctttagcggaaattggattgtcctgatcgttctctgtgtgttcctgcttttctccctggtgctcctgtctatcctgtgccccgtccgcaagcataagaaaagctga

SEQ ID NO: 13399 - RNA, 3408 nt, synthetic construct
  misc_feature 1..3408: note = derived and/or modified CDS sequence (opt5) from HTNV(CGRni1)__EU363815.1__GP
  source 1..3408: mol_type = other RNA
atgggcatctggaagtggctggtgatggccagcctcgtctggcccgctttcgccctgagaaacctttacgacatgaaaattgagtgccctcacaccgtttcctttggggaaaattctgtgacaggatatgtggagctgccgcccatgcctctcgcggatacgacccagatggtccccgaaagctcctgttctatggacaaccatcaaagcctgaatacaatcaccaagtacacacagattatctggcggggcaaagctgatcagtcccagtctagccaaaactccttcgagaccgtgagcacagaagttgaccttaaggggacctgcgtgctgaaacacaagatgattgaggagtcttatcgctccagaaagagcatcacgtgttacgatctctcttgcaattccacctattgtaaacctacactgtacatgatcgtccccattcatgcctgcaacatgatgaaaagctgtctgatcgccctcggaccttatcgggtgcaggttgtgtacgaacgcacctactgcatgacaggcgtcctgattgaggggaagtgttttgtgccggaccagtctgtggtctccatcattaagcacggaatcttcgatattgctagcgttcatatcgtgtgcttttatgtggccgtcaaaggcaatacctacaagatcttcgaacaggtgaagaaaacgtttgagtccaactgtaatgacacagagaacaaggttcaaggctattacatttgcatcattgggggaaattctagccccgtgtatgtccctacccttgatgacttcagatccatggaagcctttagcggcatcattcggtctccccacggggaggatcacgacctggccggagaagaggtggcgtcctacagcatcgttggccctgccaacgctaaagtgccccattctgccagctccgatacactcgggctgatcgcttattctagcattccgtcctacagctctctttccatcctgaccagctctaccgaagccaagcacgtcttctcccctggactctttccccagctgaatcatacaaaatgcgacaagacggcgattcctctgacctggacaggcatgatcgacctccccggctactatgaggccattcacccctgtaccgtgttctgcgtcctgagcgggcctggagcttcctgtgaggccttttctgaaggcgggatcttcaacatcgctagcccgatgtgccttgtgtccaaacagaatcgcttcagactgacagagcagcaagttaactttgtgtgtcagcgggtcgatgtggacattatcgtttactgcaacggacagcgcaaggtgattctcaccaagacgctggtcatcggccaatgtatttatacaatcacctctcttttcagcctgctccccggggtggcccactccattgccgtggaactgtgcgttcctggatttcatggctgggctaccgcggccctgctcgtcacattctgttttggctgggtgctgatccccgctatcaccttcattatccttacaattctgaaatttatcgccaatattttccacacgagcaaccaggagaatagactcaagtctgtgctgcggaaaatcaaggaagagtttgagcgcaccatggggtccatggtctgcgatatctgtaaatacgaatgcgagacatataaggaacttaaggcccatggagtgagctgccctcagtctcagtgtccctactgcttcacccactgtgagccgacagaagctgcctttcaagcgcattataaagtttgccaggtgacccacagattccgggacgatctgaagaaaacggtcacccgccagaactttacacctggctgttacagaaccctcaatctgttccggtacaagtccagatgctatattttcacaatgtgggtgtttctgatcgttctcgagagcattctgtgggctgcctctgccagcgagatcccccttaaccctgtgtggaatgacaacgctcacggggtcggatccattcccatgcataccgatctggaactcgacttcagcctgacgtcttccagcaaatacacatatcgccggaagctgaccaatcctcttgaggaatcccaggccatcgatctccacgtggagatcgaggaacaaacaattggcgttgacgtgcatgctctggggcactggtttgatggcagactgaacctcaagacctctttccactgttacggagcctgcaccaaatatgagtacccctggcatacagcgaagtgtcactatgaacgcgactaccagtacgagacgagctggggctgcaatccgtccgactgtcctggggtcggaaccggctgcacagcctgcgggctgtatcttgatcagctgaaacccgtgggatctgcttacaagatcattaccatccggtatagcagacgcgtgtgtgtccagtttggcgaagagaacctctgcaaaattatcgacatgaatgattgtttcgtttcccggcatgtgaaggtgtgcatcattgggacagtctctaagtttagccaaggcgacaccctgctgttctttggaccccttgagggcgggggactcatcttcaaacactggtgtacgtccacatgccagtttggcgatcctggggacattatgagcccgagagataagggattcctgtgtcccgaatttcctggctctttccgcaaaaagtgcaacttcgccaccacccccgtgtgtgagtacgacgggaatatggtttccggctataaaaaggtgatggctacaatcgatagctttcagtctttcaacacctccacaatgcattttacggacgaacggattgagtggaaagatcctgacggaatgctgagagatcacatcaacattctcgtcaccaaggacatcgacttcgataatctgggcgaaaacccctgcaagatcgggcttcagacaagctctattgagggagcctggggctccggggtgggatttaccctgacatgtctcatcagcctgaccgagtgctccacgttcctgaccagcattaaagcgtgcgacaaggccatctgttacggcgctgaatctgttacacttacccgcgggcaaaatacagtgaaagtcagcggcaagggaggccactccgggtctagctttaaatgctgtcatggagaggaatgctcccagattggcctccacgccgctgcccctcatctggataaggtgaacgggatctctgagatggaaaatagcaaggttttcgacgatggagctccccagtgtggcatcaaatgctggtttgtgaagtccggcgagtggatttctgggatcttcagcggaaactggattgtcctgatcgtgctctgtgtgtttctgcttttctccctggtcctcctgagcattctgtgcccggttcggaaacacaagaaatcttga

SEQ ID NO: 13400 - RNA, 3408 nt, synthetic construct
  misc_feature 1..3408: note = derived and/or modified CDS sequence (opt5) from HTNV(Aa10-434)__KU207160.1__GP
  source 1..3408: mol_type = other RNA
atgggcatctggaagtggctggtgatggccagcctcgtctggcccgttctgacccttagaaacgtgtacgacatgaagattgagtgccctcacacagtgtccttcgggggaaattctgtcatcggctatgtggaactgccgcccatgcctctcgctgatacggcccagctggttcccgagagctcctgttctatggacaaccatcaaagccttaataccattacaaagtacacccaggtgtcctggcgggggaaagcggatcagtctcagagctcccaaatcagctttgaaacagtctctaccgaggtggacctgaagggaacatgcgttctcaaacacaagatggtggaagagtcctatcgcagcagaaagtctattacctgttacgatctgtcctgcaacagcacgtattgtaaacctaccctgtacatgatcgtccccatccatgcttgcaatatgatgaagtcttgtctcattgccctgggcccttatcgggtccaggtggtgtacgagcgcacatactgcatgaccggggttcttatcgaaggaaaatgtttcgtgccggaccagtccgtggtcagcattatcaagcacggcatttttgatatcgcctccgtgcatattgtttgcttctttgtggctgtcaaaggcaacacatataagatcttcgaacaggtgaagaaatcttttgagagcacctgtaatgacacggagaacaaggttcaagggtactatatctgcattgtgggaggcaattccgcccccatctacgtccctacactggatgacttcagaagcatggaggcttttaccgggattttccggtctccccacggagaagatcacgacctcgccggcgaggaaacagcgacctattccatcgtggggcctgccaacgctaaagtcccccatagcgcctctagcgataccctgtcccttattgctttttctggaatcccgagctactccagcctgtctatcctcacatccagcacggaggccaagcacgtgttctctcctggcctgtttcccaaactgaatcataccaactgcgacaagggcgcgattcctctcatgtggacagggatgatcgacctgcccggatattacgaagccattcacccctgtaccgttttctgcgtgctttccggccctggggctagctgtgaggccttctccgagggaggcatctttaatattacatctccgatgtgcctggtcagcaaacagaaccgcttcagactcaccgaacaacaggtgaattttgtttgtcaacgggtggatgtcgacatcgtggtgtactgcaacgggcagcgcaaggttatcctgacgaagacacttgtcattggacagtgtatctataccattacctccctgttctctctcctgcccggcgtggctcacagcatcgccgtggagctgtgcgtccctggctttcatgggtgggccacagctgcgctcctggtgaccttctgttttggatgggttcttattcccgccatcacattcattatcctgacgatcctcaaatttattgctaacatcttccacacctccaatcaagaaaacagactcaagagcgtgcttcggaaaattaaggaggaatttgagaaaacaaagggctctatggtctgcgatatctgtaagtacgagtgcgaaacctataaagagctgaaggcccatggggtgtcctgccctcagagccagtgtccctactgcttcacacactgtgaaccgaccgaggccgcttttcaggcccattataaagtttgccaagtgacgcaccgcttcagagacgatctcaagaaaaccgtcacacctcagaatttcacccccggatgttaccggacactgaacctgtttcgctataagtctagatgctacattttcaccatgtggatctttctcctggtgcttgaatccatcctgtgggcggctagcgcctctgagacgcctctcacacccgtttggaatgacaacgcccacggcgtggggagcgtccctatgcataccgatctggagctggacttctcccttacatcctcttccaagtacacctatcggagaaaactcaccaatcccctggaagaggctcagagcattgatctgcacatcgaaattgaggagcagacaatcggcgtggacgtgcatgccctcggacactggtttgatggccgcctgaaccttaagacgtccttccactgttacggggcttgcaccaaatatgaatacccgtggcatacagccaagtgtcactatgagcgggactaccaatatgaaacctcttggggatgcaatcctagcgactgtcccggcgtcgggacaggatgcaccgcgtgcggcctgtacctcgatagactgaaacccgttgggtccgcctacaagattatcacgatccgctattctcggagagtgtgtgtgcagtttggcgaggaaaacctgtgcaagattatcgacatgaatgattgtttcgtcagccgccatgtgaaagtttgcattatcggaacaatttccaagttttctcagggcgacacccttctcttctttgggcctctggagggaggcgggctgatcttcaaacactggtgtaccagcacatgccagtttggagatccgggcgacatcatgagcccccgggataaggggttcctctgtcctgagttccccggcagctttagaaagaagtgcaacttcgctaccacacctatttgtgaatacgacggaaatatggtgtctggctataaaaaggtcatggccacgatcgattcctttcagagcttcaacacctctacaatgcattttaccgacgagcgcattgaatggaaggatcccgacgggatgctgcgggatcacatcaatattcttgtgacaaaagacatcgacttcgataacctgggagagaacccttgcaagattggcctccaggcttccagcatcgaaggggcctggggatctggcgttgggtttaccctgacgtgtctggtgtcccttaccgagtgccccacattcctcaccagcatcaaagcgtgcgacaaggccatttgttacggcgctgagtccgtcacactgaccagaggacagaatacagtgaaagttagcggcaaagggggacactctggcagcacctttaagtgctgtcatggggaagattgctcccagatcggactgcacgccgctgccccgcatctcgacaaagtgaacggcatttctgagatggaaaatagcaaggtctatgatgacggcgcccctcaatgtgggatcaaatgctggttcgtgaagtccggagagtggatttctggcatctttagcgggaactggatcgtgctgattgtcctttgtgttttcctgctgttctccctggtgctgctttctatcctctgccccgtgcgcaaacacaaaaagagctga

SEQ ID NO: 13401 - RNA, 3408 nt, synthetic construct
  misc_feature 1..3408: note = derived and/or modified CDS sequence (opt5) from HTNV(Aa10-518)__KU207161.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacgaagaataaagttcaaggctactatatctgcatcgtcgggggaaactccgcccccatttacgtgcctacactggatgacttcagaagcatggaggcttttaccggcatcttccggtctccccacggggaagatcacgacctcgccggagaggaaacagcgacctattccattgtgggccctgccaatgctaaggtcccccatagcgcctctagcgataccctgtcccttatcgctttttctgggattccgagctactccagcctgtctatcctcacatccagcacggaggccaaacacgtgttctctcctggactgtttcccaagctgaaccataccaattgcgacaaaggcgcgatccctctcatgtggacaggcatgattgacctgcccgggtattacgaagccatccacccctgtaccgttttctgcgtgctttccggacctggcgctagctgtgaggccttctccgaagggggaatttttaacatcacatctccgatgtgcctggtcagcaagcagaatcgcttcagactcaccgagcaacaggtgaactttgtttgtcaacgggtggatgtcgacattgtggtgtactgcaacggccagcgcaaggttatcctgacgaaaacacttgtcatcgggcagtgtatttataccatcacctccctgttctctctcctgcccggagtggctcacagcattgccgtggagctgtgcgtccctggctttcatggctgggccacagctgcgctcctggtgaccttctgttttgggtgggttcttatccccgccattacattcatcattctgacgatcctcaagtttatcgctaatattttccacacctccaaccaagaaaatagactgaaaagcgtgcttcggaagatcaaagaggaatttgagaagacaaagggatctatggtctgcgatatttgtaaatacgagtgcgaaacctataaggagctgaaagcccatggcgtgtcctgccctcagagccagtgtccctactgcttcacacactgtgaaccgaccgaggccgcttttcaggcccattataaggtttgccaagtgacgcaccgcttcagagacgatctcaaaaagaccgtcacacctcagaacttcacccccgggtgttaccggacactgaatctgtttcgctataagtctagatgctacatcttcaccatgtggatttttctcctggtgcttgaatccatcctgtgggcggctagcgcctctgagacgcctctcacacccgtttggaacgacaatgcccacggagtgggcagcgtccctatgcataccgatctggagctggacttctcccttacatcctcttccaaatacacctatcggagaaagctcaccaaccccctggaagaggctcagagcatcgatctgcacattgaaatcgaggagcagacaattggggtggacgtgcatgccctcggccactggtttgatggacgcctgaatcttaaaacgtccttccactgttacggcgcttgcaccaagtatgaatacccgtggcatacagccaaatgtcactatgagcgggactaccaatatgaaacctcttgggggtgcaaccctagcgactgtcccggagtcggcacagggtgcaccgcgtgcggactgtacctcgatagactgaagcccgttggctccgcctacaagatcattacgatccgctattctcggagagtgtgtgtgcagtttggggaggaaaatctgtgcaaaatcgtcgacatgaacgattgtttcgtgagccgccatgttaaggtgtgcattatcggcacagtctccaaattttctcagggagacacccttctcttctttggccctctggaagggggaggcctgattttcaagcactggtgtaccagcacatgccagtttggggatccgggagacatcatgagcccccgggataaaggcttcctctgtcctgagttccccgggagctttagaaagaaatgcaatttcgctaccacacctatttgtgagtacgacggcaacatggtgtctggatataagaaggttatggccacgatcgattcctttcagagcttcaatacctctacaatgcattttaccgacgagcgcatcgaatggaaagatcccgacggcatgctgcgggatcacattaacatccttgtgacaaaggacattgacttcgataacctgggggagaatccttgcaaaatcggactccagacctccagcattgaaggcgcttgggggtctggagtcggctttacgctgacctgtctggtgtcccttacagagtgccccaccttcctcacaagcatcaaggcctgcgacaaagcgatttgttacggggccgagtccgttaccctgacaagaggccagaacaccgtgaaggtcagcggaaagggcgggcactctggaagcacgtttaaatgctgtcatggcgaagattgctcccagatcgggctgcacgctgccgctccgcatctcgacaaggtgaatggaatctctgagatggaaaacagcaaagtgtatgatgacggcgcccctcaatgtggcattaagtgctggttcgtcaaatccggggagtggatctctggaatttttagcggcaattggatcgttctgattgtgctttgtgtgttcctcctgttctccctggtcctgctttctatcctctgccccgtgcgcaagcacaagaaaagctga

SEQ ID NO: 13402 - RNA, 3408 nt, synthetic construct
  misc_feature 1..3408: note = derived and/or modified CDS sequence (opt5) from HTNV(Aa13_3)__KX687227.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgttgatacggtgcagctggtccccgaaagctcctgttctatggacaaccatcaaagccttaataccattacaaagtacacccaggtgtcctggcggggcaaagctgatcagtctcagagctcccaaaacagctttgagacagtttctaccgaagtggacctgaaggggacatgcgtcctcaaacacaagatggtggaggagtcctatcgcagcagaaagtctatcacctgttacgatctgtcctgcaatagcacgtattgtaaacctaccctgtacatgattgtgcccatccatgcctgcaacatgatgaagtcttgtctcatcgcgctgggaccttatcgggtccaggttgtgtacgaacgcacatactgcatgaccggcgtgcttattgaggggaaatgtttcgtcccggaccagtccgtggttagcatcattaagcacggaatctttgatattgcttccgtgcatatcgtctgcttctttgtggccgttaaaggcaatacatataagattttcgaacaggtgaagaaatcttttgagagcacctgtaacgacacggagaataaggtccaaggctactatatctgcatcgtcgggggaaactccgcccccatttacgtgcctacactggatgacttcagaagcatggaggcttttaccggcatcttccggtctccccacggggaggatcacgacctcgccggagaagagacagctacctattccattgtgggccctgccaatgcgaaagttccccatagcgcctctagcgataccctgtcccttatcgctttttctgggattccgagctactccagcctgtctatcctcacatccagcacggaagccaagcacgtgttctctcctggactgtttcccaaactgaaccataccaattgcgacaagggcgctatccctctcatgtggacaggcatgattgacctgcccgggtattacgaggccatccacccctgtaccgtcttctgcgtgctttccggacctggcgcgagctgtgaggccttctccgaagggggaatttttaacatcacatctccgatgtgcctggttagcaaacagaatcgcttcagactcaccgagcaacaggtgaactttgtctgtcaacgggtggatgtggacattgttgtctactgcaacggccagcgcaaggtgatcctgacgaagacacttgtgatcgggcagtgtatttataccatcacctccctgttctctctcctgcccggagtcgctcacagcattgccgtggaactgtgcgttcctggctttcatggctgggctacagccgccctcctggtgaccttctgttttgggtgggtccttatccccgctattacattcatcattctgacgatcctcaaatttatcgcgaatattttccacacctccaaccaagagaatagacttaagagcgtgctgcggaaaatcaaggaagagtttgagaaaacaaagggatctatggtttgcgatatttgtaagtacgaatgcgagacctataaagaactgaaggcccatggcgtgtcctgccctcagagccagtgtccctactgcttcacacactgtgagccgaccgaagctgcctttcaggcccattataaagtctgccaagtgacgcaccgcttcagagacgatctcaagaaaaccgttacacctcagaacttcacccccgggtgttaccggacactgaatctgtttcgctataagtctagatgctacatcttcaccatgtggatttttctcctggtgcttgagtccatcctgtgggctgccagcgcgtctgagacgcctctcacacccgtctggaacgacaatgctcacggagtgggcagcgtgcctatgcataccgatctggaactggacttctcccttacatcctcttccaagtacacctatcggagaaaactcaccaaccccctggaggaagcccagagcatcgatctgcacattgagatcgaggaacagacaattggggtcgacgttcatgccctcggccactggtttgatggacgcctgaatcttaagacgtccttccactgttacggcgcttgcaccaaatatgagtacccgtggcatacagccaagtgtcactatgaacgggactaccaatatgagacctcttgggggtgcaaccctagcgactgtcccggagtgggcacagggtgcaccgcttgcggactgtacctcgatagactgaaacccgtgggctccgcctacaagatcattacgatccgctattctcggagagtctgtgtgcagtttggggaagagaatctgtgcaagatcattgacatgaacgattgtttcgttagccgccatgtgaaagtctgcatcattggcacagtgtccaagttttctcagggagacacccttctcttctttggccctctggaagggggaggcctgatcttcaaacactggtgtaccagcacatgccagtttggggatccgggagacattatgagcccccgggataagggcttcctctgtcctgagttccccgggagctttagaaagaagtgcaatttcgcgaccacacctatctgtgaatacgacggcaacatggtttctggatataaaaaggtgatggccacgatcgattcctttcagagcttcaatacctctacaatgcattttaccgacgaacgcattgagtggaaggatcccgacggcatgctgcgggatcacatcaacattcttgtcacaaaagacatcgacttcgataacctgggggaaaatccttgcaagattggactccagacctccagcatcgagggcgcttgggggtctggagtgggctttacgctgacctgtctggtttcccttacagagtgccccaccttcctcacaagcattaaagcctgcgacaaggctatctgttacggggccgaatccgtgaccctgacaagaggccagaacaccgtcaaagtgagcggaaagggcgggcactctggaagcacgtttaagtgctgtcatggcgaggattgctcccagatcgggctgcacgcggccgctccgcatctcgacaaagtgaatggaatttctgaaatggagaacagcaaggtctatgatgacggcgcccctcaatgtggcatcaaatgctggttcgttaagtccggggaatggatttctggaatctttagcggcaattggattgtgctgatcgtgctttgtgtcttcctcctgttctccctggtgctgctttctatcctctgccccgttcgcaaacacaaaaagagctga

SEQ ID NO: 13403 - RNA, 3408 nt, synthetic construct
  misc_feature 1..3408: note = derived and/or modified CDS sequence (opt5) from HTNV(Aa14_186)__KX687228.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatgatcgaggagtcctatcgcagcagaaagtctattacctgttacgatctgtcctgcaataacacgtattgtaaacctaccctgtacatgatcgtgcccatccatgcttgcaatatgatgaaaagctgtctcattgccctgggaccttatcgggtccaggtggtgtacgaacgcacatactgcatgaccggcgtccttatcgaggggaaatgtttcgttccggaccagtctgtggtgtccattatcaagcacggaatttttgatatcgccagcgtccatattgtgtgcttctttgttgctgtgaaaggcaacacatataagatcttcgaacaggtcaagaaatcctttgagtctacctgtaatgacacggagaacaaggtgcaaggctactatatctgcattgttgggggaaatagcgcccccatctacgtgcctacactggatgacttcagatccatggaggcttttaccggcattttccggagcccccacggggaggatcacgacctcgccggagaagagacagcgacctattctatcgtcggccctgccaacgctaaagtgccccattccgccagctctgataccctgagccttattgctttttccgggatcccgtcttacagctccctgagcatcctcacatcttccacggaagccaagcacgtcttcagccctggactgtttcccaaactgaatcataccaactgcgacaagggcgcgattcctctcatgtggacaggcatgatcgacctgcccgggtattacgaggccattcacccctgtaccgtgttctgcgttctttctggacctggcgcttcctgtgaggccttcagcgaagggggaatctttaatattacatccccgatgtgcctggtgtctaaacagaaccgcttcagactcaccgagcagcaggtcaactttgtgtgtcaacgggttgatgtggacatcgtcgtgtactgcaatggccagcgcaaggtgatcctgacgaagacacttgttattgggcagtgtatctataccattaccagcctgttctccctcctgcccggagtcgctcactctatcgccgtggaactgtgcgtgcctggctttcatggctgggccacagctgcgctcctggtcaccttctgttttgggtgggtgcttattcccgccatcacattcattatcctgacgatcctcaaatttattgctaacatcttccacaccagcaatcaagagaacagactgaagtccgttcttcggaaaattaaggaagagtttgagaaaacaaagggaagcatggtgtgcgatatctgtaagtacgaatgcgagacctataaagaactgaaggcccatggcgtctcttgccctcagtcccagtgtccctactgcttcacacactgtgagccgaccgaagccgcttttcaggcccattataaagtgtgccaagttacgcaccgcttcagagacgatctcaagaaaaccgtgacacctcagaatttcacccccgggtgttaccggacactgaacctgtttcgctataagagcagatgctacattttcaccatgtggatctttctcctggtccttgagtctatcctgtgggcggcttccgccagcgagacgcctctcacacccgtgtggaatgacaacgcccacggagttggctctgtgcctatgcataccgatctggaactggacttcagccttacatccagctctaagtacacctatcggagaaaactcaccaatcccctggaggaagctcagtccattgatctgcacatcgagattgaggaacagacaatcggggtcgacgtgcatgccctcggccactggtttgatggacgcctgaaccttaagacgagcttccactgttacggcgcttgcaccaaatatgagtacccgtggcatacagccaagtgtcactatgaacgggactaccaatatgagacctcctgggggtgcaatccttctgactgtcccggagtgggcacagggtgcaccgcgtgcggactgtacctcgatagactgaaacccgtcggcagcgcctacaagattatcacgatccgctattcccggagagtttgtgtgcagtttggggaagagaacctgtgcaagattatcgacatgaatgattgtttcgtgtctcgccatgtcaaagtgtgcattatcggcacagttagcaagttttcccagggagacacccttctcttctttggccctctggaagggggaggcctgattttcaaacactggtgtacctctacatgccagtttggggatccgggagacatcatgagcccccgggataagggcttcctctgtcctgagttccccgggtcctttagaaagaagtgcaacttcgctaccacacctatctgtgagtacgacggcaatatggtgagcggatataaaaaggtcatggccacgattgattcttttcaatccttcaacaccagcacaatgcattttaccgacgaacgcatcgagtggaaggatcccgacggcatgctgcgggatcacattaacatccttgtgacaaaagacattgacttcgataatctgggggaaaacccttgcaagatcggactccagacctcttccattgagggcgcttgggggagcggagttggctttacgctgacctgtctggtgtctcttacagagtgccccaccttcctcacatccatcaaagcctgcgacaaggcgatctgttacggggccgaaagcgtcaccctgacaagaggccagaataccgtgaaagtttccggaaagggcgggcacagcggatctacgtttaagtgctgtcatggcgaggattgcagccagattgggctgcacgctgccgctccgcatctcgacaaagtgaacggaatctccgaagtcgaaaattctaaggtgtatgatgacggcgcccctcaatgtggcattaaatgctggttcgtcaagagcggggaatggatctccggaatcttttctggcaactggattgtgctgatcgttctttgtgtgttcctcctgttcagcctggtgctgctttccattctctgccccgtccgcaaacacaagaagtcttga

SEQ ID NO: 13404 - RNA, 3408 nt, synthetic construct
  misc_feature 1..3408: note = derived and/or modified CDS sequence (opt5) from HTNV(Aa14_234)__KX687230.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaccagctttgagaccgtctctacagaagtggacctgaaggggacctgcgttctcaaacacaagatggtggaggagtcctatcgcagcagaaagtctatcacgtgttacgatctgtcctgcaacagcacctattgtaaacctacactgtacatgattgtccccatccatgcttgcaatatgatgaagtcttgtctcatcgccctgggaccttatcgggtccaggtggtgtacgaacgcacctactgcatgacaggcgttcttattgaggggaaatgtttcgtgccggaccagtccgtggtcagcatcattaagcacggaatctttgatattgcctccgtgcatatcgtttgcttctttgtggctgtcaaaggcaacacctataagattttcgaacaggtgaagaaatcttttgagagcacgtgtaatgacacagagaacaaggttcaaggctactatatctgcatcgtcgggggaaattccgcccccatttacgtgcctaccctggatgacttcagaagcatggaggcttttacaggcatcttccggtctccccacggggaggatcacgacctcgccggagaagagaccgcgacctattccattgtgggccctgccaacgctaaagtcccccatagcgcctctagcgatacactgtcccttatcgctttttctgggattccgagctactccagcctgtctatcctcacgtccagcaccgaagccaagcacgtgttctctcctggactgtttcccaaactgaatcatacatcctgcgacaagggcgcgatccctctcatgtggaccggcatgattgacctgcccgggtattacgaggccatccacccctgtacagttttctgcgtgcttagcggacctggcgcttcctgtgaggccttctctgaagggggaatttttaacatcaccagcccgatgtgcctggtctccaaacagaatcgcttcagactcacggagcaacaggtgaactttgtttgtcagcgggtggatgtcgacattgtggtgtactgcaatggccagcgcaaggttatcctgacaaagacccttgtcatcgggcagtgtatttataccatcacatctctgttcagcctcctgcccggagtggctcactccattgccgtggaactgtgcgtccctggctttcatggctgggccaccgctgcgctcctggtgacattctgttttgggtgggttcttatccccgccattacgttcatcattctgaccgtgctcaaatttatcgctaacatcttccacacaagcaaccaagagaatagactgaagtctgtccttcggaaaattaaggaagagtttgagaaaaccaagggatccatggtgtgcgatatctgtaagtacgaatgcgagacatataaagaactgaaggcccatggcgttagctgccctcagtctcagtgtccctactgcttcacccactgtgagccgacggaagccgcttttcaggcccattataaagtgtgccaagtcacccaccgcttcagagacgatctcaagaaaacagtgacccctcagaacttcacacccgggtgttaccggaccctgaatctgtttcgctataagtccagatgctacattttcacgatgtggatctttctcctggttcttgagagcattctgtgggcggcttctgccagcgagacacctctcacccccgtgtggaacgacaatgcccacggagtcggctccgtgcctatgcatacagatctggaactggacttcagccttacctcttccagcaagtacacctatcggagaaaactcacaaaccccctggaggaagctcagtccatcgatctgcacatcgagattgacgagcagacgatcggggtggatgtccatgccctcggccactggtttgacggacgcctgaatcttaagacctctttccactgttacggcgcttgcacaaaatatgaatacccgtggcataccgccaagtgtcactatgagcgggactaccaatatgaaacaagctgggggtgcaacccttccgattgtcccggagttggcaccgggtgcacggcgtgcggactgtacctcgacagactgaaacccgtgggctctgcctacaagattatcacaattcgctatagccggagagtgtgtgtccagtttggggaggaaaatctgtgcaagatcatcgatatgaacgactgtttcgtgtcccgccatgttaaagtgtgcattatcggcaccgtctctaagtttagccagggagatacccttctcttctttggccctctggaagggggaggcctgattttcaaacactggtgtacatccacatgccagtttggggacccgggagatatcatgagcccccgggacaagggcttcctctgtcctgagttccccgggtcttttcgcaaaaagtgcaatttcgctacaacgcctatttgtgaatacgatggcaacatggtgtccggatataaaaaggttatggccaccatcgacagctttcaatctttcaatacatccaccatgcattttacagatgagagaatcgaatggaaggaccccgatggcatgctgcgggaccacattaacatccttgtgaccaaagacattgatttcgacaatctgggggagaacccttgcaagatcggactccagacgagctctattgaaggcgcttgggggtccggagtcggctttaccctgacatgtctggtgagccttaccgagtgccccacattcctcacctccatcaaagcctgcgataaggcgatttgttacggggccgagagcgttacactgaccagaggccagaacacggtgaaagtctctggaaagggcgggcacagcggatccacatttaagtgctgtcatggcgaagactgctctcagatcgggctgcacgctgccgctccgcatctcgataaagtgaatggaatcagcgagatggaaaactccaaggtgtatgacgatggcgcccctcaatgtggcattaaatgctggttcgtcaagtctggggagtggatcagcggaattttctccggcaattggatcgttctgattgtgctttgtgtgttcctgctcttttctctggtcctgcttagcatcctctgccccgtgcgcaaacacaagaagtcctga

SEQ ID NO: 13405 - RNA, 3408 nt, synthetic construct
  misc_feature 1..3408: note = derived and/or modified CDS sequence (opt5) from HTNV(Aa14_239)__KX687231.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacactggatgacttcagaagcatggaggcttttaccggcatcttccggtctccccacggggaggatcacgacctcgccggagaagagacagcgacctattccattgtgggccctgccaatgctaaagtcccccatagcgcctctagcgataccctgtcccttatcgctttttctgggattccgagctactccagcctgtctatcctcacatccagcacggaagccaagcacgtgttctctcctggactgtttcccaaactgaaccataccaattgcgacaagggcgcgatccctctcatgtggacaggcatgattgacctgcccgggtattacgaggccatccacccctgtaccgttttctgcgtgctttccggacctggcgctagctgtgaggccttctccgaagggggaatttttaacatcacatctccgatgtgcctggtcagcaaacagaatcgcttcagactcaccgagcaacaggtgaactttgtttgtcaacgggtggatgtcgacattgtggtgtactgcaacggccagcgcaaggttatcctgacgaagacacttgtcatcgggcagtgtatttataccatcacctccctgttctctctcctgcccggagtggctcacagcattgccgtggaactgtgcgtccctggctttcatggctgggccacagctgcgctcctggtgaccttctgttttgggtgggttcttatccccgccattacattcatcattctgacggtgctcaaatttatcgctaatatcttccacacctccaaccaagagaatagacttaagagcgtcctgcggaaaattaaggaagagtttgagaaaacaaagggatctatggtgtgcgatatctgtaagtacgaatgcgagacctataaagaactgaaggcccatggcgtttcctgccctcagagccagtgtccctactgcttcacacactgtgagccgaccgaagccgcttttcaggcccattataaagtgtgccaagtcacgcaccgcttcagagacgatctcaagaaaaccgtgacacctcagaacttcacccccgggtgttaccggacactgaatctgtttcgctataagtctagatgctacattttcaccatgtggatctttctcctggttcttgagtccattctgtgggcggctagcgcctctgagacgcctctcacacccgtgtggaacgacaatgcccacggagtcggcagcgtgcctatgcataccgatctggaactggacttctcccttacatcctcttccaagtacacctatcggagaaaactcaccaaccccctggaggaagctcagagcatcgatctgcacatcgagattgacgagcagacaatcggggtggatgtccatgccctcggccactggtttgacggacgcctgaatcttaagacgtccttccactgttacggcgcttgcaccaaatatgaatacccgtggcatacagccaagtgtcactatgagcgggactaccaatatgaaacctcttgggggtgcaaccctagcgattgtcccggagttggcacagggtgcaccgcgtgcggactgtacctcgacagactgaaacccgtgggctccgcctacaagattatcacgattcgctattctcggagagtgtgtgtccagtttggggaggaaaatctgtgcaagatcatcgatatgaacgactgtttcgtgagccgccatgttaaagtgtgcattatcggcacagtctccaagttttctcagggagatacccttctcttctttggccctctggaagggggaggcctgattttcaaacactggtgtaccagcacatgccagtttggggacccgggagatatcatgagcccccgggacaagggcttcctctgtcctgagttccccgggagctttagaaagaagtgcaatttcgctaccacacctatttgtgaatacgatggcaacatggtgtctggatataaaaaggttatggccacgatcgactcctttcagagcttcaatacctctacaatgcattttaccgatgagcgcatcgaatggaaggaccccgatggcatgctgcgggaccacattaacatccttgtgacaaaagacattgatttcgacaacctgggggagaatccttgcaagatcggactccagacctccagcattgaaggcgcttgggggtctggagtcggctttacgctgacctgtctggtgtcccttacagagtgccccaccttcctcacaagcatcaaagcctgcgataaggcgatttgttacggggccgagtccgttaccctgacaagaggccagaacaccgtgaaagtcagcggaaagggcgggcactctggaagcacgtttaagtgctgtcatggcgaagactgctcccagatcgggctgcacgctgccgctccgcatctcgataaagtgaatggaatctctgagatggaaaacagcaaggtgtatgacgatggcgcccctcaatgtggcattaaatgctggttcgtcaagtccggggagtggatctctggaatttttagcggcaattggatcgttctgattgtgctttgtgtgttcctcctgttctccctggtcctgctttctatcctctgccccgtgcgcaaacacaaaaagagctga

SEQ ID NO: 13406 - RNA, 3408 nt, synthetic construct
  misc_feature 1..3408: note = derived and/or modified CDS sequence (opt5) from HTNV(Aa14-172)__KU207162.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcacggataccgctcagctggttcccgaaagctcctgttctatggacaaccatcaaagccttaatacaattaccaagtacacacaggtgtcctggcggggcaaagccgatcagtctcagagctcccaaaacagctttgagaccgtctctacagaagtggacctgaaggggacctgcgttctcaaacacaagatgatcgaggagtcctatcgcagcagaaagtctattacgtgttacgatctgtcctgcaataacacctattgtaaacctacactgtacatgatcgtgcccatccatgcgtgcaatatgatgaaaagctgtctcattgctctgggaccttatcgggtccaggtggtgtacgaacgcacctactgcatgacaggcgtccttatcgaggggaaatgtttcgttccggaccagtctgtggtgtccattatcaagcacggaatttttgatatcgccagcgtccatattgtgtgcttctttgttgccgtgaaaggcaacacctataagatcttcgaacaggtcaagaaatcctttgagtctacgtgtaatgacacagagaacaaggtgcaaggctactatatctgcattgttgggggaaatagcgctcccatctacgtgcctaccctggatgacttcagatccatggaagcctttacaggcattttccggagcccccacggggaggatcacgacctcgctggagaagagaccgccacctattctatcgtcggccctgcgaacgccaaagtgccccattccgctagctctgatacactgagccttattgccttttccgggatcccgtcttacagctccctgagcatcctcacgtcttccaccgaagctaagcacgtcttcagccctggactgtttcccaaactgaatcatacaaactgcgacaagggcgccattcctctcatgtggaccggcatgatcgacctgcccgggtattacgaggcgattcacccctgtacagtgttctgcgttctttctggacctggcgcctcctgtgaggctttcagcgaagggggaatctttaatattacctccccgatgtgcctggtgtctaaacagaaccgcttcagactcacggagcagcaggtcaactttgtgtgtcaacgggttgatgtggacatcgtcgtgtactgcaatggccagcgcaaggtgatcctgacaaagacccttgttattgggcagtgtatctataccattacaagcctgttctccctcctgcccggagtcgcccactctatcgctgtggaactgtgcgtgcctggctttcatggctgggccaccgccgctctcctggtcacattctgttttgggtgggtgcttattcccgcgatcacgttcattatcctgaccatcctcaaatttattgccaacatcttccacacaagcaatcaagagaacagactgaagtccgttcttcggaaaattaaggaagagtttgagaaaaccaagggaagcatggtgtgcgatatctgtaagtacgaatgcgagacatataaagaactgaaggctcatggcgtctcttgccctcagtcccagtgtccctactgcttcacccactgtgagccgacggaagccgcctttcaggctcattataaagtgtgccaagttacccaccgcttcagagacgatctcaagaaaacagtgacccctcagaatttcacacccgggtgttaccggaccctgaacctgtttcgctataagagcagatgctacattttcacgatgtggatctttctcctggtccttgagtctatcctgtgggccgcgtccgctagcgagacacctctcacccccgtgtggaatgacaacgcccacggagttggctctgtgcctatgcatacagatctggaactggacttcagccttacctccagctctaagtacacctatcggagaaaactcacaaatcccctggaggaagcccagtccattgatctgcacatcgagattgaggaacagacgatcggggtcgacgtgcatgctctcggccactggtttgatggacgcctgaaccttaagaccagcttccactgttacggcgcctgcacaaaatatgagtacccgtggcataccgctaagtgtcactatgaacgggactaccaatatgagacatcctgggggtgcaatccttctgactgtcccggagtgggcaccgggtgcacggcctgcggactgtacctcgatagactgaaacccgtcggcagcgcgtacaagattatcacaatccgctattcccggagagtttgtgtgcagtttggggaagagaacctgtgcaagattatcgacatgaatgattgtttcgtgtctcgccatgtcaaagtgtgcattatcggcaccgttagcaagttttcccagggagacacccttctcttctttggccctctggaagggggaggcctgattttcaaacactggtgtacatctacctgccagtttggggatccgggagacatcatgagcccccgggataagggcttcctctgtcctgagttccccgggtcctttcgcaaaaagtgcaacttcgccacaacgcctatctgtgagtacgacggcaatatggtgagcggatataaaaaggtcatggctaccattgattcttttcaatccttcaacacaagcaccatgcattttacagacgaaagaatcgagtggaaggatcccgacggcatgctgcgggatcacattaacatccttgtgaccaaagacattgacttcgataatctgggggaaaacccttgcaagatcggactccagacgtcttccattgagggcgcctgggggagcggagttggctttaccctgacatgtctggtgtctcttaccgagtgccccacattcctcacctccatcaaggcttgcgacaaggccatctgttacggggcggaaagcgtcacactgaccagaggccagaatacggtgaaagtttccggaaagggcgggcacagcggatctacatttaagtgctgtcatggcgaggattgcagccagattgggctgcacgccgctgccccgcatctcgacaaagtgaacggaatctccgaagtcgaaaattctaaggtgtatgatgacggcgctcctcaatgtggcattaaatgctggttcgtcaagagcggggagtggatctccggaatcttttctggcaactggattgtgctgatcgttctttgtgtgttcctcctgttcagcctggtgctgctttccattctctgccccgtccgcaaacacaagaagtcttga

SEQ ID NO: 13407 - RNA, 3408 nt, synthetic construct
  misc_feature 1..3408: note = derived and/or modified CDS sequence (opt5) from HTNV(Aa14-175)__KU207163.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacactggatgacttcagaagcatggaggcttttaccggcatcttccggtctccccacggggaggatcacgacctcgccggagaagagacagcgacctattccattgtgggccctgccaatgctaaagtcccccatagcgcctctagcgataccctgtcccttatcgctttttctgggattccgagctactccagcctgtctatcctcacatccagcacggaagccaagcacgtgttctctcctggactgtttcccaaactgaaccataccaattgcgacaagggcgcgatccctctcatgtggacaggcatgattgacctgcccgggtattacgaggccatccacccctgtaccgttttctgcgtgctttccggacctggcgctagctgtgaggccttctccgaagggggaatttttaacatcacatctccgatgtgcctggtcagcaaacagaatcgcttcagactcaccgagcaacaggtgaactttgtttgtcaacgggtggatgtcgacattgtggtgtactgcaacggccagcgcaaggttatcctgacgaagacacttgtcatcgggcagtgtatttataccatcacctccctgttctctctcctgcccggagtggctcacagcattgccgtggaactgtgcgtccctggctttcatggctgggccacagctgcgctcctggtgaccttctgttttgggtgggttcttatccccgccattacattcatcattctgacgatcctcaaatttatcgctaatattttccacacctccaaccaagagaatagacttaagagcgtgctgcggaaaatcaaggaagagtttgagaaaacaaagggatctatggtctgcgatgtgtgtaagtacgaatgcgagacctataaagaactgaaggcccatggcgtttcctgccctcagagccagtgtccctactgcttcacacactgtgagccgaccgaagccgcttttcaggcccattataaagtgtgccaagtcacgcaccgcttcagagacgatctcaagaaaaccgtgacacctcagaacttcacccccgggtgttaccggacactgaatctgtttcgctataagtctagatgctacattttcaccatgtggatctttctcctggttcttgagtccattctgtgggcggctagcgcctctgagacgcctctcacacccgtgtggaacgacaatgcccacggagtcggcagcgtgcctatgcataccgatctggaactggacttctcccttacatcctcttccaagtacacctatcggagaaaactcaccaaccccctggaggaagctcagagcatcgatctgcacatcgagattgaggaacagacaatcggggtggacgtccatgccctcggccactggtttgatggacgcctgaatcttaagacgtccttccactgttacggcgcttgcaccaaatatgagtacccgtggcatacagccaagtgtcactatgaacgggactaccaatatgagacctcttgggggtgcaaccctagcgactgtcccggagttggcacagggtgcaccgcgtgcggactgtacctcgatagactgaaacccgtgggctccgcctacaagattatcacgattcgctattctcggagagtgtgtgtccagtttggggaagagaatctgtgcaagatcatcgacatgaacgattgtttcgtgagccgccatgttaaagtgtgcattatcggcacagtctccaagttttctcagggagacacccttctcttctttggccctctggaagggggaggcctgattttcaaacactggtgtaccagcacatgccagtttggggatccgggagacatcatgagcccccgggataagggcttcctctgtcctgagttccccgggagctttagaaagaagtgcaatttcgctaccacacctatttgtgaatacgacggcaacatggtgtctggatataaaaaggttatggccacgatcgattcctttcagagcttcaatacctctacaatgcattttaccgacgaacgcatcgagtggaaggatcccgacggcatgctgcgggatcacattaacatccttgtgacaaaagacattgacttcgataacctgggggaaaatccttgcaagatcggactccagacctccagcattgagggcgcttgggggtctggagtcggctttacgctgacctgtctggtgtcccttacagagtgccccaccttcctcacaagcatcaaagcctgcgacaaggcgatttgttacggggccgaatccgttaccctgacaagaggccagaacaccgtgaaagtcagcggaaagggcgggcactctggaagcacgtttaagtgctgtcatggcgaggattgctcccagatcgggctgcacgctgccgctccgcatctcgacaaagtgaatggaatctctgaagtggagaacagcaaggtctatgatgacggcgcccctcaatgtggcattaaatgctggttcgttaagtccggggaatggatctctggaatttttagcggcaattggatcgtgctgattgtgctttgtgtcttcctcctgttctccctggtgctgctttctatcctctgccccgttcgcaaacacaaaaagagctga

SEQ ID NO: 13408 - RNA, 3408 nt, synthetic construct
  misc_feature 1..3408: note = derived and/or modified CDS sequence (opt5) from HTNV(Aa14-184)__KU207164.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatgatcgaggagtcctatcgcagcagaaagtctattacctgttacgatctgtcctgcaataacacgtattgtaaacctaccctgtacatgatcgtgcccatccatgcttgcaatatgatgaaaagctgtctcattgccctgggaccttatcgggtccaggtggtgtacgaacgcacatactgcatgaccggcgtccttatcgaggggaaatgtttcgttccggaccagtctgtggtgtccattatcaagcacggaatttttgatatcgccagcgtccatattgtgtgcttctttgttgctgtgaaaggcaacacatataagatcttcgaacaggtcaagaaatcctttgagtctacctgtaatgacacggagaacaaggtgcaaggctactatatctgcattgttgggggaaatagcgcccccatctacgtgcctacactggatgacttcagatccatggaggcttttaccggcattttccggagcccccacggggaggatcacgacctcgccggagaagagacagcgacctattctatcgtcggccctgccaacgctaaagtgccccattccgccagctctgataccctgagccttattgctttttccgggatcccgtcttacagctccctgagcatcctcacatcttccacggaagccaagcacgtcttcagccctggactgtttcccaaactgaatcataccaactgcgacaagggcgcgattcctctcatgtggacaggcatgatcgacctgcccgggtattacgaggccattcacccctgtaccgtgttctgcgttctttctggacctggcgcttcctgtgaggccttcagcgaagggggaatctttaatattacatccccgatgtgcctggtgtctaaacagaaccgcttcagactcaccgagcagcaggtcaactttgtgtgtcaacgggttgatgtggacatcgtcgtgtactgcaatggccagcgcaaggtgatcctgacgaagacacttgttattgggcagtgtatctataccattaccagcctgttctccctcctgcccggagtcgctcactctatcgccgtggaactgtgcgtgcctggctttcatggctgggccacagctgcgctcctggtcaccttctgttttgggtgggtgcttattcccgccatcacattcattatcctgacgatcctcaaatttattgctaacatcttccacaccagcaatcaagagaacagactgaagtccgttcttcggaaaattaaggaagagtttgagaaaacaaagggaagcatggtgtgcgatgtctgtaagtacgaatgcgagacctataaagaactgaaggcccatggcgtgtcttgccctcagtcccagtgtccctactgcttcacacactgtgagccgaccgaagccgcttttcaggcccattataaagtttgccaagtgacgcaccgcttcagagacgatctcaagaaaaccgtcacacctcagaatttcacccccgggtgttaccggacactgaacctgtttcgctataagagcagatgctacatcttcaccatgtggatttttctcctggtgcttgagtctatcctgtgggcggcttccgccagcgagacgcctctcacacccgtttggaatgacaacgcccacggagtgggctctgtccctatgcataccgatctggaactggacttcagccttacatccagctctaagtacacctatcggagaaaactcaccaatcccctggaggaagctcagtccatcgatctgcacattgagatcgaggaacagacaattggggtggacgtgcatgccctcggccactggtttgatggacgcctgaaccttaagacgagcttccactgttacggcgcttgcaccaaatatgagtacccgtggcatacagccaagtgtcactatgaacgggactaccaatatgagacctcctgggggtgcaatccttctgactgtcccggagtcggcacagggtgcaccgcgtgcggactgtacctcgatagactgaaacccgttggcagcgcctacaagatcattacgatccgctattcccggagagtgtgtgtgcagtttggggaagagaacctgtgcaagatcattgacatgaatgattgtttcgtctctcgccatgtgaaagtttgcatcattggcacagtgagcaagttttcccagggagacacccttctcttctttggccctctggaagggggaggcctgatcttcaaacactggtgtacctctacatgccagtttggggatccgggagacattatgagcccccgggataagggcttcctctgtcctgagttccccgggtcctttagaaagaagtgcaacttcgctaccacacctatctgtgagtacgacggcaatatggtcagcggatataaaaaggtgatggccacgatcgattcttttcaatccttcaacaccagcacaatgcattttaccgacgaacgcattgagtggaaggatcccgacggcatgctgcgggatcacatcaacattcttgttacaaaagacatcgacttcgataatctgggggaaaacccttgcaagattggactccagacctcttccatcgagggcgcttgggggagcggagtgggctttacgctgacctgtctggtctctcttacagagtgccccaccttcctcacatccattaaagcctgcgacaaggcgatctgttacggggccgaaagcgtgaccctgacaagaggccagaataccgttaaagtgtccggaaagggcgggcacagcggatctacgtttaagtgctgtcatggcgaggattgcagccagatcgggctgcacgctgccgctccgcatctcgacaaagtcaacggaatttccgaagtggaaaattctaaggtgtatgatgacggcgcccctcaatgtggcatcaaatgctggttcgtcaagagcggggaatggatttccggaatcttttctggcaactggattgttctgatcgtgctttgtgtgttcctcctgttcagcctggtcctgctttccatcctctgccccgtgcgcaaacacaagaagtcttga

SEQ ID NO: 13409 - RNA, 3408 nt, synthetic construct
  misc_feature 1..3408: note = derived and/or modified CDS sequence (opt5) from HTNV(LR1)__AF288293.1__GP
  source 1..3408: mol_type = other RNA
atgggcatctggaagtggctggtgatggccagcctcgtctggcccgttctgacccttagaaacgtgtacgacatgaagattgagtgccctcacacagtgtccttcgggggaaattctgtcatcggctatgtggaactgccgcccgttcctctcgctgatacggcccagatggtgcccgagagctcctgttctatggacaaccatcaaagcctgaataccattacaaagtacacccaggtctcctggcgggggaaagcggatcagtctcagagctcccaaaacagctttgaaacagtgtctaccgaggttgaccttaagggaacatgcgtgctgaaacacaagatggtcgaagagtcctatcgcagcagaaagtctgtgacctgttacgatctctcctgcaatagcacgtattgtaaacctaccctgtacatgatcgtgcccattcatgcttgcaacatgatgaagtcttgtctgatcgccctcggcccttatcgggtccaggttgtgtacgagcgcacatactgcatgaccggggtgctgatcgaaggaaaatgtttcgtcccggaccagtccgtggttagcattatcaagcacggcatttttgatatcgcctccgtgcatattgtctgcttctttgtggctgttaaaggcaatacatataagatcttcgaacaggtgaagaaatcttttgaaagcacctgtaacgacacggagaataaggtccaagggtactatatttgcatcgtgggaggcaactccgcccccatctacgtccctacacttgatgacttcagaagcatggaggcttttaccgggattttccggtctccccacggagaagatcgcgacctggccggcgaggaaatcgcgtcctatagcattgtggggcctgccaatgctaaagttccccactctgccagctccgatacactcagactgatcgcttactctgggattccgagctattccagcctttctatcctgacctccagcaccgaggccaagcatgtgttttctcctggcctcttccccaaactgaaccacacaaattgcgacaagtccgcgatccctctgatttggacgggcatgatcgacctccccgggtactacgaagccgtccatccctgtaccgtgttttgcgttctgagcggacctggcgcttcctgtgaggccttctctgagggaggaattttcaacatcacaagctccatgtgccttgtgtctaaacagaatcggtttcgcctgaccgaacagcaggtcaacttcgtgtgtcaaagagtggatatggacattgttgtctattgcaacggccagcggaaggtgatcctcacaaagaccctggtgatcgggcagtgtatttacacgatcacaagcctttttagcctgctcccgggagtcgctcacagcattgccgtggagctgtgcgttcccggcttccacggctgggccaccgctgcgctgctcgtgacctttcgcttcgggtgggtcctgatccctgccattacatttatcattcttaccgtgctgaaattcatcgctaatatctttcatacatctaaccaagaaaatagactcaagtccgttctgcggaaaattaaggaggagttcgagaaaacgaagggaagcatggtgtgtgatgtctgcaagtatgagtgtgaaacctacaaagagcttaaggcccacggcgtgtcttgcccccagtcccagtgcccttattgttttacacattgcgaacccaccgaggccgctttccaggcccactacaaagtttgtcaagtgacacatcgctttagagacgggctgaagaaaaccgtcacgccgcagaacttcacccctggatgctatcggacactcaatctgttcagatacaagagccgctgttacatctttaccatgtggattttcctgctcgtgctggaatctatcctttgggcggctagcgcctccgagacacccctgacccctgtgtggaacgataatgcccacggcgtcgggagcgttcccatgcacacggacctcgagctggatttttctctgacatccagctccaagtatacctaccggagaaaacttacaaaccctctcgaagaggctcagtctattgacctgcatatcgaaatcgaggagcagaccattggcgtggatgtgcacgccctgggacattggttcgacggccgcctcaatctgaagaccagctttcactgctatggggcttgtacaaaatacgaatatccctggcacacggccaagtgccattacgagcgggattatcaatacgaaacctcctggggatgtaacccgtctgactgccctggcgtcgggacaggatgtaccgcgtgcggcctttacctggaccagctcaaacccgtggggagcgcctataagatcattacaatcagatactcccgccgggtttgcgtgcagttcggcgaggaaaatctgtgtaagattatcgatatgaacgactgctttgtctctagacacgtgaaagtttgtatcattggaaccgtgagcaagttctcccagggcgatacgctgctctttttcgggcccctcgagggaggcgggctgatctttaaacattggtgcacaagcacctgtcaattcggagaccctggcgatattatgtctccgcgcgacaaggggtttctgtgccccgagttccctggctccttccggaaaaagtgtaattttgctaccacacccatctgcgaatatgatggaaacatggtcagcggctacaaaaaggtgatggccaccattgactctttccagtcctttaatacaagcacgatgcacttcaccgatgagagaatcgaatggaaggaccctgatgggatgctccgcgaccatatcaacattctggttacaaaagatatcgactttgacaaccttggagagaatccctgtaagattggcctgcagacctcttccatcgaaggggcttggggaagcggcgtggggttcacacttacctgcctggtctccctgacggagtgtcctacctttcttacaagcattaaagcctgcgataaggcgatctgctatggcgccgagtctggaaccctcacacggggccagaacaccgtgaaagtgagcgggaagggaggccactccgggtctacattcaagtgttgccacggagaagactgtagccaaattggcctgcatgctgccgctccccacctggataaagtcaatggcatctccgagatcgaaaactctaaggtttacgacgatggggccccgcagtgcggaattaaatgttggtttgtgaagtccggcgagtggatctccgggattttctctggaaattggatcgtgctcattgtcctgtgcgtgtttcttctgttcagcctcgttctgctgtccatcccttgtcccgtgagaaaacataaaaagagctga

SEQ ID NO: 13410 - RNA, 3408 nt, synthetic construct
  misc_feature 1..3408: note = derived and/or modified CDS sequence (opt5) from HTNV(SN7)__AF288656.1__GP
  source 1..3408: mol_type = other RNA
atgggcgtgtggaagtggctggtcatggccagcctcgtttggcccgcttgcaccctgagaaacgtgtacgacatgaaaatcgagtgtcctcacacagtgtccttcggggaaaattctgtcattggatatgtggagcttccgcccatgcctctggccgatacgacccagctcgttcccgaaagctcctgctctatggacaaccatcaaagcctgaatacaatcaccaagtacacacaggtgtcctggcggaaaaaggcggatcaggctcagtctagccaaaactcctttgagaccgtcagcgtggaagttgaccttaaaggcacatgtgtgctgaagcacaagatgattgaggagtcttatcgctccagaaaaagcattacctgctacgatctctcttgtaattccacgtattgcaagcctaccctgtacatgatcgtccccatccatgcctgtaacatgatgaaaagctgcctgatcgccctcgggccttatcgggttcaggtggtctacgaacgcacatactgtatgaccggagttctgattgagggcaagtgcttcgtgccggaccagtctgtggtctccatcattaaacacgggatctttgatattgctagcgtgaagatcgtttgtttctttgtggccgtcaagagaaatacatataaacttttcgaacaggtgaagaaatcctttgactctacctgcaacgatacggagaataaggttcaaggatactatatttgcatcgtgggcggcaacagcgctcccatctacgtccctacactggacgatttccggtccatggaggcctttagcgggattttccgctctccccatggagaagaccacgatctcgcgggcgaggaagtggcctcctatagcatcgtcgggcctgctaatgccaaagtgccccactctgctagctccgacaccctgtctcttattgcctacagcggaatcccgtcctatagctctctgtccattctcacaagctctaccgaggcgaagcatgtgttttcccctggcttctttccccagctgaaccacaccaaatgtgacaagacagccatccctctgacgtggaccgggatgatcgatctccccggatactacgaagctattcatccctgcacagtgttctgtgtcctgagcggccctggcgcctcctgcgaggctttctctgaagggggaatctttaatattaccagcccgatgtgtcttgtgtccaagcagaacagattccggctgacagagcagcaagttaattttgtgtgccagcgcgtcgacatggatatcgtggtgtattgtaacggccagagaaaagttattctcaccaagacgatggtcatcgggcaatgcatctacacaattacctctctgttcagccttctgcccggagtggcccactccatcgccgtggagctctgtgtccctggctttcacgggtgggctaccgcggccctgctggtgacattctgctttggatgggttctcattcccgctgtgaccttcatcattctgacagtccttaaatttgtggccaacatcttccatacgagcaatcaggaaaaccggctgaagtctgttctccgcaaaattaaggaggaatttgagaagaccaaaggctccatggtgtgtgacgtctgcaagtatgagtgcgaaacatacaaagagctgaaggcccacggcgtgagctgtcctcagtctcagtgcccctattgtttcacccattgcgaaccgacagaggctgcctttcaagcgcactacagagtttgtcaggtgacccatcggttccgcgatgaccttaaaaagacggtcacccctcagaatttcacacccgggtgctatagaaccctgaacctctttcggtacaagtccagatgttacatcttcacaatgtgggtgtttctgctggtgctcgaaagcatcctgtgggctgcctctgccagcgaggtccctcttaatcccatttggaacgataatgctcacggagttggctccgtgcctatgcacaccgacctggagctcgatttcagcctgacgtcttccagcaaatatacataccgccggaagctgaccaacccccttgaagagacacaggccatcgacctccatattgaaatcgaggagcaaaccattggggtggatgtccacgctctgggacattggtttgacggcagactgaatctcaaaacctccttccactgctatggggcctgtacaaagtacgaatatccgtggcacacggcgaaatgccattacgagcgcgactatcagtacgaaacctcttggggctgtaaccctagcgattgccccggagtgggcacagggtgcaccgcctgtggactgtaccttgaccagctgaagcccgttggctccgcttataagatcatcacaattcggtactctagacgcgtgtgcgtccagtttggggaggaaaatctctgtaaagtgatcgatatgaacgactgcttcgttagccggcacgtgaaggtctgtattatcggaaccgtgtccaaattttctcaaggcgatacgctgctgttctttgggcctcttgagggcggaggcctcattttcaagcattggtgcacaagcacctgtcagtttggggacccgggagatatcatgtcccccagagacaaaggcttcctgtgccctgagttccccgggagctttcgcaagaaatgtaatttcgccaccacacctctgtgcgaatatgatggaaacatgatctctggctacaagaaggttatggctaccattgactcctttcagagcttcaatacatctacgatgcactttaccgatgagcggatcgaatggaaagaccccgatgggatgctcagagaccatattaacatcctggtgacaaaggacattgatttcgacaaccttggcgagaatccttgtaaaatcggactgcagacctccagcatcgaaggcgcctgggggtctggagtcggctttacactgacctgcctcgtgtccctgacggagtgccccaccttccttacaagcattaaggcgtgtgataaagccatctgctatggggctgagtccgtgaccctcacacgcggacaaaacaccgtcaaggttagcggcaaagggggccactctggaagcacatttaagtgttgccacggcgaagactgttcccagaccgggctgcatgccgctgccccgcacctggataaggtgaatggaatttctgagagcgaaaactccaaagtgtacgacgatggcgcccctcagtgcgggatcaagtgttggttcgtcaaatctggagagtggattagcggcatcttttccggcaattggattgtgctcatcgttctgtgcgtgttccttctgttctctctcgtcctgctgagcgtgctttgtcccgttcggaagcataagaaatcctga

SEQ ID NO: 13411 - RNA, 3408 nt, synthetic construct
  misc_feature 1..3408: note = derived and/or modified CDS sequence (opt5) from HTNV(84FLi)__AF366569.1__GP
  source 1..3408: mol_type = other RNA
atgggcgtgtggaagtggctggtcatggccagcctcgtttggcccgcttgcaccctgagaaacgtgtacgacatgaaaatcgagtgtcctcacacagtgtccttcggggaaaattctgtcattggatatgtggagcttccgcccatgcctctggccgatacgacccagctcgttcccgaaagctcctgctctatggacaaccatcaaagcctgaatacaatcaccaagtacacacaggtgtcctggcggaaaaaggcggatcaggctcagtctagccaaaactcctttgagaccgtcagcgtggaagttgaccttaaaggcacatgtgtgctgaagcacaagatgattgaggagtcttatcgctccagaaaaagcattacctgctacgatctctcttgtaattccacgtattgcaagcctaccctgtacatgattgtccccatccatgcctgtaacatgatgaaaagctgcctgatcgccctcgggccttatcgggttcaggtggtctacgaacgcacatactgtatgaccggagttctgattgagggcaagtgcttcgtgccggaccagtctgtggtctccatcattaaacacgggatctttgatattgctagcgtgaagatcgtttgtttctttgtggccgtcaagggaaatacatataaacttttcgaacaggtgaagaaatcctttgactctacctgcaacgatacggagaataaggttcaaggctactatatttgcatcgtgggcgggaacagcgctcccatctacgtccctacactggacgatttcagatccatggaggcctttagcggaattttccggtctccccatggcgaagaccacgatctcgcgggggaggaagtggcctcctatagcatcgtcggacctgctaatgccaaagtgccccacaacgcttctagcgacaccctgtcccttattgcctactctggcatcccgagctattccagcctgtctattctcacatccagcaccgaggcgaagcatgtgttttctcctgggttctttccccagctgaatcacaccaaatgtgacaagacagccatccctctgacgtggaccggaatgatcgatctccccggctactacgaagctattcatccctgcacagtgttctgtgtcctgtccggccctggggccagctgcgaggctttctccgagggaggcatctttaacattacctctccgatgtgtcttgtgagcaagcagaatcgcttcagactgacaaaacagcaagttaactttgtgtgccagcgggtcgacatggatatcgtggtgtattgtaacgggcagcgcaaggttattctcaccaaaacgatggtcatcggacaatgcatctacacaattacctccctgttctctcttctgcccggcgtggcccacagcatcgccgtggaactctgtgtccctgggtttcacggatgggctaccgcggccctgctggtgacattctgctttggctgggttctcattcccgctgtgaccttcatcattctgacagtccttaagtttgtggccaatatcttccatacgtccaaccaggagaatagactgaaaagcgttctccggaagattaaggaagagtttgagaaaaccaagggctctatggtgtgtgacgtctgcaaatatgagtgcgagacatacaaggaactgaaagcccacggggtgtcctgtcctcagagccagtgcccctattgtttcacccattgcgagccgacagaagctgcctttcaagcgcactaccgcgtttgtcaggtgacccatagattccgggatgaccttaagaagacggtcacccctcagaacttcacacccggatgctatcgcaccctgaatctctttagatacaaatctcggtgttacatcttcacaatgtgggtgtttctgctggtgctcgagtccatcctgtgggctgccagcgcctctgaagtccctcttaaccccatttggaatgataacgctcacggcgttgggagcgtgcctatgcacaccgacctggagctcgatttctccctgacgtcttcttccaagtatacatacagacgcaaactgaccaatccccttgaggaaacacaggccatcgacctccatattgagatcgaagaacaaaccattggagtggatgtccacgctctgggccattggtttgacgggcggctgaacctcaagaccagcttccactgctatggcgcctgtacaaaatacgagtatccgtggcacacggcgaagtgccattacgaaagagactatcagtacgagacctcctggggatgtaatccttctgattgccccggcgtggggacaggatgcaccgcctgtggcctgtaccttgaccagctgaagcccgttgggagcgcttataaaatcatcacaattcgctactcccggagagtgtgcgtccagtttggagaagagaacctctgtaaggtgatcgatatgaatgactgcttcgtttctcgccacgtgaaagtctgtattatcggcaccgtgagcaagttttcccaaggggatacgctgctgttctttggccctcttgaaggaggcgggctcattttcaaacattggtgcacatctacctgtcagtttggagacccgggcgatatcatgagcccccgggacaaggggttcctgtgccctgagttccccggatcctttcgcaaaaagtgtaacttcgccaccacacctctgtgcgagtatgatggcaatatgatcagcgggtacaagaaagttatggctaccattgactcttttcagtccttcaacacaagcacgatgcactttaccgatgaaagaatcgagtggaaggaccccgatggcatgctccgggaccatattaacatcctggtgacaaaagacattgatttcgacaatcttggagaaaacccttgtaagatcggcctgcagacctcttccatcgagggggcctggggaagcggcgtcgggtttacactgacctgcctcgtgtctctgacggaatgccccaccttccttacatccattaaagcgtgtgataaggccatctgctatggagctgagagcgtgaccctcacaagaggccaaaataccgtcaaggtttccgggaaaggcggacacagcggctctacatttaagtgttgccacggggaggactgtagccagaccggactgcatgccgctgccccgcacctggataaagtgaacggcatttccgaaatcgagaatagcaaggtgtacgacgatggggcccctcagtgcggaattaaatgttggttcgtcaagagcggcgaatggatctccggcatcttttctgggaactggatcgtgctcatcgttctgtgcgtgttccttctgttcagcctcgtcctgctgtccgtgctttgtcccgttcgcaagcataaaaagtcttga

SEQ ID NO: 13412 - RNA, 3408 nt, synthetic construct
  misc_feature 1..3408: note = derived and/or modified CDS sequence (opt5) from HTNV(Aa08-1111)__KY594715.1__GP
  source 1..3408: mol_type = other RNA
atgggcatctggaagtggctggtgatggccagcctcgtctggcccgttttcaccctgagaaacgtgtacgacatgaaaattgagtgccctcacacagtgtcctttggggaaaattctgtcatcggatatgtggagcttccgcccatgcctctggctgatacggcccagatggttcccgaaagctcctgttctatggacaaccatcaaagcctcaataccattacaaagtacacccaggtgtcctggcggggcaaagcggatcagtctcagagctcccaaaacagcttcgagacagtctctaccgaagtggacctgaaggggacatgcgttcttaaacacaagatggtggaggagtcctatcgcagcagaaagtctatcacctgttacgatctgtcctgcaatagcacgtattgtaaacctaccctctacatgattgtccccatccatgcttgcaacatgatgaagtcttgtctgatcgccctgggaccttatcgggtccaggtggtgtacgaacgcacatactgcatgaccggcgttctcattgaggggaaatgttttgtgccggaccagtccgtggtcagcatcattaagcacggaatcttcgatattgcctccgtgcatatcgtttgctttttcgtggctgtcaaaggcaatacatataagatttttgaacaggtgaagaaatctttcgagagcacctgtaacgacacggagaataaggttcaaggctactatatctgcatcgtcgggggaaactccgcccccatttacgctcctacactggatgactttagaagcatggaagccttcaccggcatctttcggtctccccacggggaggatcacgaccttgcgggagaagagattgcctcctatagcatcgtgggccctgctaatgccaaagtgccccattctgctagctccgatacactgtctctcattgcctacagcgggatcccgtcctatagctctctgtccatcattaccagctctaccgaagcgaagcacgtcttctcccctggactttttcccaaactgaaccatacaaattgcaacaagggcgccatccctctcatttggacgggcatgatcgacctgcccgggtactacgaggctgtgcacccctgtaccgttttctgcgtgctgagcggacctggcgcctcctgtgaggctttctctgaagggggaatttttaatatcacaagcccgatgtgcctcgtctccaaacagaaccgcttcagactgaccgagcaacaggtgaactttgtttgtcagcgggtggacatggatatcgtcgtgtattgcaatggccagcgcaaggtgattcttacaaagaccctggttatcgggcagtgtatttacacgatcacatctctcttcagcctgcttcccggagtcgcccactccattgccgtggaactgtgcgtgcctggctttcatggctgggctaccgcggccctcctggtcaccttctgttttgggtgggtgctgatccccgctattacattcatcatcctcaccgttctgaaatttattgccaacatcttccacacaagcaatcaagagaacagacttaagtctgtgctgcggaaaattaaggaagagtttgagaaaacgaagggatccatggtctgcgacatctgtaagtatgaatgcgagacctacaaagaactcaaggcccatggcgtgagctgccctcagtctcagtgtccctattgcttcacacactgtgagccgaccgaagctgcctttcaggcgcattacaaagtttgccaagtgacacaccgcttcagagatgacctgaagaaaaccgtcacgcctcagaatttcacccccgggtgttatcggacacttaacctgtttcgctacaagtccagatgctacattttcaccatgtggatctttctcctggtgctggagagcatcctctgggctgcctctgccagcgagacacctctgacccccgtttggaatgataacgctcacggagtgggctccgtccctatgcatacggaccttgaactggatttcagcctcacatcttccagcaagtatacctaccggagaaaactgacaaatcccctggaggaagcccagtccattgggcttcacatcgagattgaggaacagaccatcggcgtggacgtgcatgctctcggacactggtttgatggccgcctgaacctgaagacctctttccactgttatggggcctgcacaaaatacgagtatccgtggcatacggcgaagtgtcactacgaacgggactatcaatacgagaccagctggggatgcaatccttccgattgtcccggcgtcgggacaggatgcaccgcctgcggcctctacctggaccagcttaaacccgttgggtctgcttataagattatcacaatcagatacagccgccgggtgtgtgtgcagtttggcgaagaacatctgtgcaagattatcgacatgaacgattgtttcgtctccagacacgtgaaagtttgcattatcggaaccgtgtctaagtttagccagggcgacacgctcctgttctttgggcctctggagggaggcgggcttattttcaaacattggtgtacatccacatgccaatttggagatccgggcgacatcatgagcccccgcgataaggggttcctctgtcctgagttccccggctcttttcggaaaaagtgcaatttcgccaccacccctatctgtgagtatgacggaaacatggtctccggctacaaaaaggtgatggctaccattgatagctttcagtctttcaatacatccacgatgcactttaccgacgaaagaatcgagtggaaggatcccgacgggatgctgcgcgatcacattaacatcctggttacaaaagacattgatttcgacaacctcggagaaaatccttgcaagatcggcctgcagaccagctctattgagggggcctggggatccggcgtggggtttacacttacctgtctggtcagcctcacggagtgccccaccttcctgacatccatcaaagcgtgcgacaaggccatctgttatggcgctgaaagcgtgaccctgacacggggacagaacaccgttaaagtgtctggcaaagggggacatagcggctccacatttaagtgctgtcacggggaggaatgctctcaaattggacttcatgccgctgccccgcacctcgataaggtcaatggcatcagcgagattgaaaactccaaggtgtacgacgatggcgcccctcagtgtgggatcaaatgctggttcgtgaagtctggagagtggattagcggcatcttttccgggaattggatcgtcctgattgttctgtgtgtgttcctcctgttctctcttgtgctgctcagcatcctgtgccccgtcagaaaacataagaagtcctga

SEQ ID NO: 13413 - RNA, 3408 nt, synthetic construct
  misc_feature 1..3408: note = derived and/or modified CDS sequence (opt5) from HTNV(Aa09-189)__KY594716.1__GP
  source 1..3408: mol_type = other RNA
atgggcatctggaagtggctggtgatggccagcctcgtctggcccgttttcaccctgagaaacgtgtacgacatgaaaattgagtgccctcacacagtgtcctttggggaaaattctgtcatcggatatgtggagcttccgcccatgcctctggctgatacggcccagatggttcccgaaagctcctgttctatggacaaccatcaaagcctcaataccattacaaagtacacccaggtgtcctggcggggcaaagcggatcagtctcagagctcccaaaacagcttcgagacagtctctaccgaagtggacctgaaggggacatgcgttcttaaacacaagatggtggaggagtcctatcgcagcagaaagtctatcacctgttacgatctgtcctgcaatagcacgtattgtaaacctaccctctacatgattgtccccatccatgcttgcaacatgatgaagtcttgtctgatcgccctgggaccttatcgggtccaggtggtgtacgaacgcacatactgcatgaccggcgttctcattgaggggaaatgttttgtgccggaccagtccgtggtcagcatcattaagcacggaatcttcgatattgcctccgtgcatatcgtttgctttttcgtggctgtcaaaggcaatacatataagatttttgaacaggtgaagaaatctttcgagagcacctgtaacgacacggagaataaggttcaaggctactatatctgcatcgtcgggggaaactccgcccccatttacgctcctacactggatgactttagaagcatggaagccttcaccggcatctttcggtctccccacggggaggatcacgaccttgcgggagaagagattgcctcctatagcatcgtgggccctgctaatgccaaagtgccccattctgctagctccgatacactgtctctcattgcctacagcgggatcccgtcctatagctctctgtccatcattaccagctctaccgaagcgaagcacgtcttctcccctggactttttcccaaactgaaccatacaaattgcgacaagggcgccatccctctcatttggacgggcatgatcgacctgcccgggtactacgaggctgtgcacccctgtaccgttttctgcgtgctgagcggacctggcgcctcctgtgaggctttctctgaagggggaatttttaacatcacaagcccgatgtgcctcgtctccaaacagaatcgcttcagactgaccgagcaacaggtgaactttgtttgtcagcgggtggatatggacatcgtcgtgtattgcaacggccagcgcaaggtgattcttacaaagaccctggttatcgggcagtgtatttacacgatcacatctctcttcagcctgcttcccggagtcgcccactccattgccgtggaactgtgcgtgcctggctttcatggctgggctaccgcggccctcctggtcaccttctgttttgggtgggtgctgatccccgctattacattcatcatcctcaccgttctgaaatttattgccaatatcttccacacaagcaaccaagagaatagacttaagtctgtgctgcggaaaattaaggaagagtttgagaaaacgaagggatccatggtctgcgatatctgtaagtatgaatgcgagacctacaaagaactcaaggcccatggcgtgagctgccctcagtctcagtgtccctattgcttcacacactgtgagccgaccgaagctgcctttcaggcgcattacaaagtttgccaagtgacacaccgcttcagagacgatctgaagaaaaccgtcacgcctcagaacttcacccccgggtgttatcggacacttaatctgtttcgctacaagtccagatgctacattttcaccatgtggatctttctcctggtgctggagagcatcctctgggctgcctctgccagcgagacacctctgacccccgtttggaacgacaatgctcacggagtgggctccgtccctatgcatacggatcttgaactggacttcagcctcacatcttccagcaagtatacctaccggagaaaactgacaaaccccctggaggaagcccagtccattgggcttcacatcgagattgaggaacagaccatcggcgtggatgtgcatgctctcggacactggtttgacggccgcctgaatctgaagacctctttccactgttatggggcctgcacaaaatacgagtatccgtggcatacggcgaagtgtcactacgaacgggattatcaatacgagaccagctggggatgcaacccttccgactgtcccggcgtcgggacaggatgcaccgcctgcggcctctacctggaccagcttaaacccgttgggtctgcttataagattatcacaatcagatacagccgccgggtgtgtgtgcagtttggcgaagaacatctgtgcaagattatcgatatgaatgactgtttcgtctccagacacgtgaaagtttgcattatcggaaccgtgtctaagtttagccagggcgatacgctcctgttctttgggcctctggagggaggcgggcttattttcaaacattggtgtacatccacatgccaatttggagacccgggcgatatcatgagcccccgcgacaaggggttcctctgtcctgagttccccggctcttttcggaaaaagtgcaacttcgccaccacccctatctgtgagtatgatggaaatatggtctccggctacaaaaaggtgatggctaccattgacagctttcagtctttcaacacatccacgatgcactttaccgatgaaagaatcgagtggaaggaccccgatgggatgctgcgcgaccacattaatatcctggttacaaaagatattgacttcgacaacctcggagaaaacccttgcaagatcggcctgcagaccagctctattgagggggcctggggatccggcgtggggtttacacttacctgtctggtcagcctcacggagtgccccaccttcctgacatccatcaaagcgtgcgataaggccatctgttatggcgctgaaagcgtgaccctgacacggggacagaataccgttaaagtgtctggcaaagggggacatagcggctccacatttaagtgctgtcacggggaggaatgctctcaaattggacttcatgccgctgccccgcacctcgacaaggtcaacggcatcagcgagattgaaaattccaaggtgtacgatgacggcgcccctcagtgtgggatcaaatgctggttcgtgaagtctggagagtggattagcggcatcttttccgggaactggatcgtcctgattgttctgtgtgtgttcctcctgttctctcttgtgctgctcagcatcctgtgccccgtcagaaaacataagaagtcctga

SEQ ID NO: 13414 - RNA, 3408 nt, synthetic construct
  misc_feature 1..3408: note = derived and/or modified CDS sequence (opt5) from HTNV(CJilin93)__AY748307.1__GP
  source 1..3408: mol_type = other RNA
atgggcatgtggaagtggctggtgatcgccagcctcgtctggcccgctctggcccttagaaacgtttacgacatgaaaattgagtgccctcacaccgtgtccttcggggaaaattctgtgatcggatatgtcgagctgccgcccatgcctctcgcggatacagctcagatggtgcccgaaagctcctgttctatggacaaccatcaaagcattaatacgatcaccaagtacacacaggttacctggcggggcaaagccgatcctgggcagtcctctcagaacagctttgagacactgtccgccgaagtggaccttaagggaacctgcgtcctgaaacacaagatggtggaggagagctatcgctctagaaagtccattacatgttacgatctcagctgcaattctacctattgtaaacccacgctgtacatgatcgttcctatccatgcttgcaacatgatgaagtcctgtctgattgccctcggcccgtatcgggtgcaagtcgtgtacgaacgcacctactgcatgacaggggtgctgatcgagggaaaatgtttcgtccccgaccagagcgttgtgtctattatcaagcacggcatttttgatatcgcttccgtgcatattgtctgcttctttgtggccgttaaaggcaatacctataaacttttcgaacaggtgaagaagtcttttgagtccacatgtaacgacaccgagaataaggtccaggggtactatatctgcatcgtgggaggcaactctgcgcctatttacgttcccacgctggatgacttcagaagcatggaagcctttacagggatcttcaaatcccctcacggagaggatcacgacctcgctggcgaagagattgccagctattctatcgtggggcccgctaatgccaaggtcccgcattccgcgagctctgataccctgagccttattgcctactccggaatcccttcttatagctccctgagcatcctcacatcttccaccgacgctaaacacgtgtttagccccggcctgttccctaagctgaaccataccaattgcgacaaatctgccattcccctcacatggacgggcatgatcgatctgcccgggtactacgaagctattcacccttgtaccgtcttttgcgtgctttccggaccgggcgccagctgtgaggccttctccgaagggggaatcttcaacattacatctcccatgtgcctggttagcaagcaaaatcggtttcgcctcaccgagcaacaggtgaacttcgtctgtcagagagtggacatggatatcgttgtgtattgcaacggccaacggaaggtcatcctgacaaaaacccttgtgattgggcagtgtatctacacgattacatccctgttttctctcctgcctggagtggctcacagcatcgcggttgagctgtgcgtccccggcttccatggctgggccaccgctgccctcctggtgacctattgttttgggtgggtgcttattcctgccatcacattcattatcctgaccgtcctcaagtttatcgctaatattttccacacatccaaccaggaaaatcgcctgaaaagcgtgcttagaaagatcaaagaggaatttgagaagacgaagggatctatggtttgcgacgtgtgtaaatacgagtgcgaaacctataaggagctgaaagcccatggcgtctcctgcccccaaagccagtgtccgtactgcttcacacactgtgaacctaccgaggcggcttttcaggcccattataaggtgtgccaggttacacaccggttccgcgatgacctcaaaaagaccgtgacgccccaaaactttacccctgggtgttacagaacactgaatctgttccggtacaagtctcgctgctatattttcaccatgtgggtctttctcctgatccttgaatccgtgctgtgggccgctagcgcctctgagacacccctcacccctgtttggaacgataatgctcacggagtgggcagcgtccccatgcatacggacctggagctggatttctcccttacaagcagctccaaatacacctatagacggaagctcacaaacccgctggaagaggcccagagcattgacctgcacatcgaaatcgaggagcagaccattggggtggatgtgcatgcgctcggccactggtttgacggaagactgaatatcaaaacctccttccactgttacggcgcctgcacaaagtatgaatacccttggcatacggctaaatgtcactatgagcgcgactaccagtacgaaacctcttgggggtgcaaccccagcgattgtcccggagtcggcacagggtgcaccgcctgcggactttatctggaccaactcaagcctgttggctccgcttacaagattatcacaattcggtattctagacgcgtgtgtgtgcagtttggggaggaaaatctgtgcaaaatcatcgatatgaacgactgtttcgtcagccggcatgtgaaggtttgcattatcggcaccgtgtccaaattttctcagggagatacgctgcttttctttggcccgctcgaagggggaggcctgattttcaagcactggtgtacaagcacatgccagtttggggaccccggagatatcatgtcccctagagacaaaggcttcctgtgtcccgagtttcctgggagcttccgcaagaaatgcaatttcgccaccacccccatttgtgagtacgatggcaacatggtctctggatataagaaggtgatggcgaccatcgactcctttcagagcttcaatacatctacgatgcattttaccgatgagcggatcgaatggaaagaccctgatggcatgctcagagaccacattaacatcctggttacaaaggacattgatttcgacaaccttggggagaatccctgcaaaatcggactgcagacctccagcattgaaggcgcctgggggtctggagtgggctttacactcacctgtctggtctccctgacggagtgcccgaccttccttacaagcatcaaggcttgcgataaagccatttgttacggggctgagtccgtgaccctcacacgcggccagaacaccgttaaggtgagcggaaagggcgggcactctggaagcacatttaaatgctgtcatggcgaagactgctccaagatcgggctgcacgccgccgctcctcatctggataaagtcaatggaatctctgagattgaaaacagcaaggtgtatgacgatggcgcgccccagtgtggcatcaaatgctggttcgtgaagtccggggagtggatttctggaatctttagcggcaattggattgtcctcatcgttctgtgtgtgttccttctgttttccctcgtgctgctgtctatcctttgccctgtccggaagcacaaaaagagctga

SEQ ID NO: 13415 - RNA, 3408 nt, synthetic construct
  misc_feature 1..3408: note = derived and/or modified CDS sequence (opt5) from HTNV(KHF,clone:4)__LC209208.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgccgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacactggatgacttcagaagcatggaggcttttaccggcatcttccggtctccccacggggaggatcacgacctcgccggagaagagacagcgacctattccattgtgggccctgccaatgctaaagtcccccatagcgcctctagcgataccctgtcccttatcgctttttctgggattccgagctactccagcctgtctatcctcacatccagcacggaagccaagcacgtgttctctcctggactgtttcccaaactgaaccataccaattgcgacaagggcgcgatccctctcatgtggacaggcatgattgacctgcccgggtattacgaggccatccacccctgtaccgttttctgcgtgctttccggacctggcgctagctgtgaggccttctccgaagggggaatttttaacatcacatctccgatgtgcctggtcagcaaacagaatcgcttcagactcaccaagcaacaggtgaactttgtttgtcaacgggtggatgtcgacattgtggtgtactgcaacggccagcgcaaggttatcctgacgaaaacacttgtcatcgggcagtgtatttataccatcacctccctgttctctctcctgcccggagtggctcacagcattgccgtggagctgtgcgtccctggctttcatggctgggccacagctgcgctcctggtgaccttctgttttgggtgggttcttatccccgccgtgacattcattatcctggctattctcaagtttatcgccaatatcttccacacgtccaaccaagaaaatagactgaaaagcgtccttcggaagattaaagaggaatttgagaagaccaagggatctatggtgtgcgatgtttgtaaatacgagtgcgaaacatataaggagctgaaagcccatggcgtgtcctgccctcagagccagtgtccctactgcttcacccactgtgaaccgacagaggctgcctttcaggcgcattataaggtctgccaagtgacccaccgcttcagagacgatctcaaaaagacggttacccctcagaacttcacacccgggtgttaccggaccctgaatctgtttcgctataagtctagatgctacatcttcacaatgtggatttttctcctggtgcttgaatccatcctgtgggctgccagcgcctctgagacccctctcacgcccgtctggaacgacaatgctcacggagtgggcagcattcctatgcatacagatctggagctggacttctcccttacctcctcttccaaatacacatatcggagaaagctcaccaaccccctggaagaggcccagagcatcgatctgcacatcgaaattgaggagcagaccatcggggtggacgtccatgctctcggccactggtttgatggacgcctgaatcttaaaacatccttccactgttacggcgcctgcacgaagtatgaatacccgtggcataccgcgaaatgtcactatgagcgggactaccaatatgaaacatcttgggggtgcaaccctagcgactgtcccggagttggcaccgggtgcacagcctgcggactgtacctcgatagactgaagcccgtgggctccgcttacaagattatcaccattcgctattctcggagagtgtgtgtccagtttggggaggaaaatctgtgcaaaatcatcgacatgaacgattgtttcgtgagccgccatgttaaggtgtgcattatcggcacggtctccaaattttctcagggagacacacttctcttctttggccctctggaagggggaggcctgattttcaagcactggtgtacctctacctgccagtttggggatccgggagacatcatgagcccccgggataaaggcttcctctgtcctgagttccccgggagctttagaaagaaatgcaatttcgccacaacccctatttgtgaatacgacggcaacatggtgagcggatataagaaggttatggctacaatcgattcctttcagagcttcaatacgtctaccatgcattttacagacgagcgcatcgaatggaaagatcccgacggcatgctgcgggatcacattaacatccttgtgaccaaggacattgacttcgataacctgggggagaatccttgcaaaatcggactccagacatccagcattgaaggcgcctgggggtctggagtcggctttaccctgacgtgtctggtgtcccttaccgagtgccccacattcctcaccagcatcaaggcgtgcgacaaagccatttgttacggggctgagtccgttacactgaccagaggccagaacacagtgaaggtcagcggaaagggcgggcactctggaagcacctttaaatgctgtcatggcgaagattgctccccgaatgggctgcacgccgctgcccctcatctcgacaaggtgaacggaatctctgagatcgaaaatagcaaagtgtatgatgacggcgctccccagtgtggcattaagtgctggttcgtcaaatccggggagtggatctctggaatttttagcggcaactggatcgttctgattgtgctttgtgtgttcctcctgttctccctggtcctgctttctatcctctgccctgtgcgcaagcacaagaaaagctga

SEQ ID NO: 13416 - RNA, 3408 nt, synthetic construct
  misc_feature 1..3408: note = derived and/or modified CDS sequence (opt5) from HTNV(KHF,clone:5)__LC209209.1__GP
  source 1..3408: mol_type = other RNA
atgggcatctggaagtggctggtgatggccagcctcgtctggcccgttctgacccttagaaacgtgtacgacatgaaaattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacactggatgacttcagaagcatggaagcctttaccggcatcttccggtctccccacggggaggatcacgacctcgccggagaagagacagcgacctattccattgtgggccctgccaatgctaaagtcccccatagcgcctctagcgataccctgtcccttatcgctttttctgggattccgagctactccagcctgtctatcctcacatccagcacggaagccaagcacgtgttctctcctggactgtttcccaaactgaaccataccaattgcgacaagggcgcgatccctctcatgtggacaggcatgattgacctgcccgggtattacgaggccatccacccctgtaccgttttctgcgtgctttccggacctggcgctagctgtgaggccttctccgaagggggaatttttaacatcacatctccgatgtgcctggtcagcaaacagaatcgcttcagactcaccgagcaacaggtgaactttgtttgtcaacgggtggatgtcgacattgtggtgtactgcaacggccagcgcaaggttatcctgacgaagacacttgtcatcgggcagtgtatttataccatcacctccctgttctctctcctgcccggagtggctcacagcattgccgtggaactgtgcgtccctggctttcatggctgggccacagctgcgctcctggtgaccttctgttttgggtgggttcttatccccgccgtgacattcattatcctggctattctcaaatttatcgccaatatcttccacacgtccaaccaagagaatagacttaagagcgtcctgcggaaaattaaggaagagtttgagaaaaccaagggatctatggtgtgcgatgtttgtaagtacgaatgcgagacatataaagaactgaaggcccatggcgtgtcctgccctcagagccagtgtccctactgcttcacccactgtgagccgacagaagctgcctttcaggcgcattataaagtctgccaagtgacccaccgcttcagagacgatctcaagaaaacggttacccctcagaacttcacacccgggtgttaccggaccctgaatctgtttcgctataagtctagatgctacatcttcacaatgtggatttttctcctggtgcttgagtccatcctgtgggctgccagcgcctctgagacccctctcacgcccgtctggaacgacaatgctcacggagtgggcagcattcctatgcatacagatctggaactggacttctcccttacctcctcttccaagtacacatatcggagaaaactcaccaaccccctggaggaagcccagagcatcgatctgcacatcgagattgaggaacagaccatcggggtggacgtccatgctctcggccactggtttgatggacgcctgaatcttaagacatccttccactgttacggcgcctgcacgaaatatgagtacccgtggcataccgcgaagtgtcactatgaacgggactaccaatatgagacatcttgggggtgcaaccctagcgactgtcccggagttggcaccgggtgcacagcctgcggactgtacctcgatagactgaaacccgtgggctccgcttacaagattatcaccattcgctattctcggagagtgtgtgtccagtttggggaagagaatctgtgcaagatcatcgacatgaacgattgtttcgtgagccgccatgttaaagtgtgcattatcggcacggtctccaagttttctcagggagacacacttctcttctttggccctctggaagggggaggcctgattttcaaacactggtgtacctctacctgccagtttggggatccgggagacatcatgagcccccgggataagggcttcctctgtcctgagttccccgggagctttagaaagaagtgcaatttcgccacaacccctatttgtgagtacgacggcaacatggtgagcggatataaaaaggttatggctacaatcgattcctttcagagcttcaatacgtctaccatgcattttacagacgaacgcatcgagtggaaggatcccgacggcatgctgcgggatcacattaacatccttgtgaccaaagacattgacttcgataacctgggggaaaatccttgcaagatcggactccagacatccagcattgagggcgcctgggggtctggagtcggctttaccctgacgtgtctggtgtcccttaccgagtgccccacattcctcaccagcatcaaagcgtgcgacaaggccatttgttacggggctgaatccgttacactgaccagaggccagaacacagtgaaagtcagcggaaagggcgggcactctggaagcacctttaagtgctgtcatggcgaggattgctccccgaatgggctgcacgccgctgcccctcatctcgacaaagtgaacggaatctctgaaatcgagaatagcaaggtgtatgatgacggcgctccccagtgtggcattaaatgctggttcgtcaagtccggggaatggatctctggaatttttagcggcaactggatcgttctgattgtgctttgtgtgttcctcctgttctccctggtcctgctttctatcctctgccctgtgcgcaaacacaaaaagagctga

SEQ ID NO: 13417 - RNA, 3405 nt, synthetic construct
  misc_feature 1..3405: note = derived and/or modified CDS sequence (opt5) from HTNV__D00376.1__GP
  source 1..3405: mol_type = other RNA
atgggcatctggaagtggctggtgatggccagcctcgtctggcccgttctgacccttagaaacgtgtacgacatgaagattgagtgccctcacacagtgtccttcggggaaaattctgtcatcggatatgtggagctgccgcccatgcctctcgctgatacggcccagctggttcccgaaagctcctgttctatggacaaccatcaaagccttaataccattacaaagtacacccaggtgtcctggcggggcaaagcggatcagtctcagagctcccaaaacagctttgagacagtctctaccgaagtggacctgaaggggacatgcgttctcaaacacaagatggtggaggagtcctatcgcagcagaaagtctatcacctgttacgatctgtcctgcaatagcacgtattgtaaacctaccctgtacatgattgtccccatccatgcttgcaacatgatgaagtcttgtctcatcgccctgggaccttatcgggtccaggtggtgtacgaacgcacatactgcatgaccggcgttcttattgaggggaaatgtttcgtgccggaccagtccgtggtcagcatcattaagcacggaatctttgatattgcctccgtgcatatcgtttgcttctttgtggctgtcaaaggcaatacatataagattttcgaacaggtgaagaaatcttttgagagcacctgtaacgacacggagaataaggttcaaggctactatatctgcatcgtcgggggaaactccgcccccatttacgtgcctacactggatgacttcagaagcatggaagcctttaccggcatcttccggtctccccacggggaggatcacgacctcgccggagaagagacagcgacctattccattgtgggccctgccaatgctaaagtcccccatagcgcctctagcgataccctgtcccttatcgctttttctgggattccgagctactccagcctgtctatcctcacatccagcacggaagccaagcacgtgttctctcctggactgtttcccaaactgaaccataccaattgcgacaagggcgcgatccctctcatgtggacaggcatgattgacgttccccgctattacgatgggatccaccccttcaccgtgttctgtgtcctgtccggacctggcgccagctgcgaggctttttccgaagggggaattttcaacatcacatctccgatgtgtcttgtgagcaaacagaatagatttcggctgaccgaacagcaggttaacttcgtgtgccaacgcgtcgacgtggatattgtggtttactgtaacggccagagaaaggtcatcctcacgaagacactggtgatcgggcagtgcatttataccatcacctccctttttagcctgctccccggagtggcccacagcattgctgtcgagctgtgtgtgcctggcttccatggctgggccacagccgctctgctcgttaccttttgcttcgggtgggtgctgatccccgcggtcacatttattatccttgccattctgaaattcatcgctaatatctttcacacgtccaaccaagaaaatcggctcaagagcgtgctgcgcaaaattaaggaggagttcgagaaaaccaagggatctatggtttgtgacgtgtgcaagtacgagtgtgaaacatataaagagcttaaggcccatggcgtctcctgccctcagagccagtgcccctactgttttacccactgcgaaccgacagaggccgctttccaggcccattataaagtgtgtcaagttacccacagattccgggatgacctgaagaaaacggtgacccctcagaactttacacccgggtgctaccgcaccctcaatctgttcagatataagtctcggtgttacatctttacaatgtggattttcctgctcgtcctggaatccatcctttgggcggctagcgcctctgagacccctctgacgcccgtgtggaacgataatgcccacggagtgggcagcattcctatgcatacagacctcgagctggatttttccctgacctcttcttccaagtacacatatagacgcaaacttaccaaccccctcgaagctcagagcatcgacctgcacatcgagattgaggaacagaccatcggggtcgatgttcatgccctgggccactggttcgacggacggctcaatctgaagacatcctttcactgctacggcgcttgtacgaaatatgagtacccgtggcataccgccaagtgccactatgaaagagactaccaatatgagacatcttgggggtgtaaccctagcgattgccccggatgtggcaccgggtgcacagcgtgcggactttacctggaccgcctcaaacccgtgggctccgcctacaagattatcaccattcggtattctagacgcgtgtgtgtccagttcggggaagagaatctgtgcaagatcatcgatatgaacgactgttttgtgagccggcatgttaaagtgtgcattatcggcacggtctccaagttctctcagggagatacactgctctttttcggccctcttgaagggggaggcctgatttttaaacactggagaaccagcacctgtcagttcggggacccgggagatatcatgagcccccgcgacaagggcttcctgtgccctgagtttcccgggagcttccggaaaaagtgtaattttgctacaacccctatttgcgagtacgatggcaacatggtgtctggatataaaaaggttatggccacaatcgactccttccaatcctttaatacgtctaccatgcatttcacagatgaaagaatcgagtggaaggaccccgatggcatgctccgcgaccacattaacatcctggtgaccaaagacattgattttgacaaccttggggaaaatccttgtaagatcggactgcagacatccagcattgagggcgcttgggggtctggagtcggcttcaccctcacgtgcctggtgtccctgaccgaatgtcccacatttcttaccagcatcaaagcctgcgataaggcgatttgctacggggccgagtccgttacactcacccggggccagaacacagtgaaagtcagcggaaagggcgggcactctggaagcaccttcaagtgttgccatggcgaggactgttccccgaatgggctgcacgctgccgctcctcatctggataaagtgaacggaatctctgaaatcgagaatagcaaggaatatgacgatggcgctccccagtgcggcattaaatgttggtttgtgaagtccggggagtggatctctggaattttcagcggcaactggatcgtcctcattgttctgtgcgtgttccttctgttttccctcgtgctgctgtctatcctttgtcctgtcagaaaacacaaaaagagctga

SEQ ID NO: 13418 - RNA, 3417 nt, synthetic construct
  misc_feature 1..3417: note = derived and/or modified CDS sequence (opt5) from LANV(510B)__AF005728.1__GP
  source 1..3417: mol_type = other RNA
atggagggctggctgttcaccatcctcggggtgtgctacattatgacaacggtcctgcccaagaccatctatgaacttaaaatggagtgtcctcacacagttggactgggccaggggtacattatcggaagcgccgaactcggcctgattgacatcgctaccgtgccggagatcaaacttgaatcctcttgcaactttgatctgcatacaaccagctccacacaaaagtctttcacccagctcgagtggagaaagaaagccgagacgaccgacacaacccaggcggctagcacaacctttgaagcccagacgaagacagtgaatattcgggggacctgtatcctggcctccgatctgtatgacacactcaagcgcgtcaaaaagaccgtgctgtgctacgatcttacctgtaaccaaacacagtgccagcccacggtttatctgattacccctgtgggaacatgtatgtctatcagaagctgcatggctaatctcctgtccaaccggattcagatcaccttcgagaaaacacactgtgtcaccggccaacttgtggaaggccagtgctttaatcccagccattctctgacgctctcccagcctccccacacatacgacgttgtgaccctgcctaccacatgtttctttaccgccaagaaagctgatcagtataagattgtcaagacattcgaggggatcatcagcaaaacgggatgcaccgagaactctattcaaggctactacgtgtgctttatcgggtcccatagcgaaccgctgattatccccacactcgaggacattcgctctgccgaactggcgtccagaatgcttctgcaccctcggggagaggatcacgaccccctccagaatgcccaggctgtgctgcgcatcgtcggccctatcaccgccaaggttcccagctcctctagcacagaaacccttcaagggattgctttcgccggagtgccgatgtattccagcttttctacgctggtgagaaacgcggatcctgagtacgtcttctcccccggcatcattcctgagagcaatcagtctgtgtgtgacaaaaagaccctccccctgacatggaccggctatctgcccatcagcggggaaatggagaaagttacaggatgcaccgtgttttgtacgctcgccggccctggggctaactgcgaagcctactccgagtctggaattttcaatatcagctccccgacatgtctggtcaacaaggtgcagcggttccgcggcagcgaacagaaaatcaattttatgtgccaaagaattgataacaatgttgtggtctattgtaacgggcagaagaaggtgatccttaccaaaacactggtcattggacagtgcatctacaccttcacctctctcttttccctgatgcccgacgtggctcatagccttgccgttgagctgtgtgtgcctggcctccacggctgggccacaattgctctgctgtctacgttctgctttgggtggctcctgatccccggaattacccttatcgtcctgaagatcctcaaaattctgacatattcctgtagccattactcctctgagagcaagttcaaaatgatcctggaaaaggtgaaggttgagtaccagaaaaccatgggctccatggtgtgcgacatttgccaccacgaatgtgagacagtcaaggaacttgagtctcataaacaaagctgcgtggaggggcagtgtccttattgcatgaccgtgacggaagcgacacagtccgccctccaggctcactttagcatctgtaagctgaccggacggttccatgaggccctgaaaaagtctctcaagaaacccgaagttcaccgcggctgctacagaaccctgggggtctttcggtatcgctccagatgttacgtgggccttgtgtggggatgcctgctcacaattgagctggtcctgtgggccgctagcgccgagaccccgcttctcgaacctggctggtctgatacagcgcatggggtgggagagctgcccctgaagacggacctcgaactggatttctcccttcctagctctagctcctatagctaccggagacgcctgaccaaccccgctaataaagaggaatctctcccttttcacttccaaatggagaagcaggttatccacgccgagatccagtccctgggccattggatggacgccacatttaacattaaaaccgctttccactgttatggggcctgcaagcagtacagctacccctggcaaacagctaagtgtttctttgaaaaagattatcagtacgagaccggatggggctgcaatccgggggactgccctggcgtgggaacgggctgtaccgcctgcgggatctatctggataaacttaagtccgtcggaaaggcgtacaaagtgatttctctcaagtatacacggaaagtttgtatccagctgggcaccgaacaagtgtgcaagcatattgacgccaacgattgtctggtcacacccagcgtgaaggtttgcatcatcgggaccgtgtccaaaattcagccctctgacacactcctgttccttggacctctggagcagggcggggtcatcctcaagcagtggtgtaccacgagctgcacatttggcgatccgggagacattatgtccaccacctctggcatgagatgtcccgaacacacagggagcttccgcaaaatctgcggatttgctaccacgcctgtgtgtgagtaccaaggcaatacaatttccgggtatcagcggctgatggccaccaaggacagcttccagtcttttaacctgacagatccccacatcacctccagcaaacttgagtggatcgaccctgatggaaatacaagagaccatgtgaacctcattctgaatcgcgatgtctctttccaggacctgtccgataacccctgcaaggttgacctccacacccaaagcatcgatggcgcttgggggtctggcgtgggatttacgctgacctgcgtggtcggccttacagaatgtccttccttcattaccagcatcaaggcctgcgacctggcgatgtgttacgggtccacagtggccaccctcgctcggggaagcaatacggttaaagtggtcggcaaagggggacattctggcagctcctttaagtgctgtcacgattctgactgcagctccgagggcctgatggcctctgctccccatctggaaagagtgacagggttcaaccagattgatagcgacaaggtttacgacgatggagccccgccttgttcctttaaatgctggttcaccaagtctggcgagtggcttctggggatcctcaatggaaactggattgtgatcgccgtcctggtgatcattctcatcattagcatcattctgttctcctttctttgtccccgccggagccacaagaaaaatgtttga

SEQ ID NO: 13419 - RNA, 3402 nt, synthetic construct
  misc_feature 1..3402: note = derived and/or modified CDS sequence (opt5) from LQUV(Longquan-Rs-32)__JX465402.1__GP
  source 1..3402: mol_type = other RNA
atgaaaagcatcctgctcattctgcttctggaacaggtgagatccaaggccaccaacgaaatcaagctcgagtgcccccacgaccaacgggtcgaaacaggcttctctcatgggtttacggatctgagccctattctttacaccaaaggactgttcacaaagcacctcgagaataactgtccgtttgacatctccattatcaatcgcctggttagagatgtgcggatctctacctggcaggctaaaagcacaaacaccgacgccacagtggcgtccgctacctctttcgaaacgaaggataccgacgataagctggccggcgtctgcgggtttttcgacgatattacaaaacccaagcagggacagcgcaaagccatcatttgttatgacctcagctgcaatcaaacccattgtctgcctacacttcacctgatctttccccagcagttctgccagtccctcaagcaatgtagcattaacgcttacgatcataaaatcctgattaccatctctctttccttttgccctgagggcctgatcattgggggaaattgtatcgtgcccgttctcgcccagagccagctgctgcacaaccacatgacgtataatattaaggtgacatgcttctttgagtactctatggctagagaatccctcgacaacaagttcctggaggaaatgaatcggcttgtcctgggccgcaactgtgagaaaaccgagtatctcggcgggtacgtgtgctttctggccggatatggcacagcgatccatgttccttacgataatacctaccttagcggggccgtggtcaactctatgaaggctaatctgcacggagaagaccatgacagactcaaactgggcgatacctccgccgtgattgctgggaacctgaagttcgtgatcgacagcacagccccggagaaatcctatcagggagaatgcttcacgggccacatgggctacacctctctctatttttaccccgtccggagcaaggggaaatatgttacaatcctgaccaagggagtgattcctgtgatcaacaagacaacctgtatgcccaaaattgtccctcttgtgtggacgggcatggttgagatgcgcgggatcgaagagaagctggaggcgtgcacaatgcactgtattatggtgggaaatggcgctacctgcgaagccttctccgccaccgggatctttgatatcaaaagcacaacctgtcaaattggaaagacacataaatacagacggacggaggaccagatcaccttcacatgccaggatctcaacaaggacatttctgtcatctgtaatggcgaaaacattaccgtgcccgttaagtccctgatcgtgggccaatgcatttatacaatcaccagcatcttttctattttcccggctacggcccacagcatcgccaccgagatgtgtgtccaggggattcatggatggcttacaatcattatctttttcaccttttgcttcggctggctgctcatccctattctgacatgtctgatcattaataccatcgcttactccctcattacgctggcgtactttaaaaacggggcccgccttggaaatctgatcaagagaatgaaatctgagttccagcggacaatcggcaacaccacatgcaatatttgcctccgcgagtgtgagagcgaatccgagtataagagccacgaggaactgtgcaaaaacgggtcttgtccctactgcatgaaggatatcggcgtgtcccaggtcctgcttaatgaacattataacgcttgtatgctcattgacagatacgagaagcggctgacccacaccctgaatcaaacacctctctatagcagaaaagtgcgcaagatccagtcttttcggtacagaaaccgctgcttcattctgacggtttggatcatccttctgaccgtggagtccctcatttgggccagctccgccgaagatatcaaacccgctcccaagtggcagaatacagcccacggaattggcaccatcaaactgaactctgactatgagctggatttcagcgtcgtggcggggtccgaatttacacataagcggatgcttcagtctcctgagagcggaaagaaaaacattccgttcaccgtttacctctccgagcaactgatcacgagcacagtgcagattctgggcaattggatggacgctgaaatcaacgtcaagtctgtgtttcactgttacgggacctgcaaaaagtattcctacccctggcagagctctccttgtcataaagaggtggacttcgaatttcagtccagctggggatgcaatcccatctcttgtcctggcattaacagcgggtgcaccgcctgcggcacatatgttgataagctcaaaaccatcgccaaggcttacagaattatcacagtcaagtattcccgcaaagtgtgttaccaaattggaacgaagaaagcctgcaagaccctggagagcaatgactgtcttgtgtctaacggcgtcaaaatctgcgctatcgggacaatttccaccctgcagacaggaatgaccctcgtgttctttggccccctgaatgggggagccctgcttatcaaggattggtgtattagctcctgcaagttcggcgacccgggggatatcatgcagatttctaacaatatcacgtgtcctagctttgacggcaccatgcagcgggtttgcagattcggactcgaacccatgtgttcctattctggcaacaaaatcagcggggtgaagcgcgtcctggagacaaaagattcctacctgtctgtgaatctcaccaagcctaaactggttggaagcacacttctgtggaactccctcgacagctctattaaggatcacatcaatattgtggtctccaacgacatcgattttgaggacctggcggaaaccccctgcaaggtgacaattaaaaatctgaagatcgagggcgcctgggggagcggaattggcatcaaacttcactgtgaagtttctctctccgagtgcagcgaatacctgaccacgatcaaggtgtgcgataacgctatttgttatgggggcaacgtcgcccatctgtctcggggactcaatacagtgatcattaaaggcgctgggggacactccggcagctccttcaagtgctgtcatgagaccagctgctctgacatcgggtttaaggccgaggcgcctcacctggccagaattgtggacgatggaatcaccacaagcatgtcctactctgacggcgctcccgaagccggcatcgtcagctggatttataaagttgctgagtggatcaaggggatgttcaacggaaattggttcgtgcttattatcatgattctgtttctcatcatctccattgtgctgctgatcttcctttgtccggtcaaaaagtacaaatga

SEQ ID NO: 13420 - RNA, 3402 nt, synthetic construct
  misc_feature 1..3402: note = derived and/or modified CDS sequence (opt5) from LQUV(Longquan-Ra-25)__JX465397.1__GP
  source 1..3402: mol_type = other RNA
atgaaaagcatcctgctcattctgcttctgggccaggtgagatccaaagccaccaacgagatcaagctcgaatgcccccacgaccaacgggtcgagacagggttctctcatggatttacggatctgagccctattctttacaccaaaggcctgttcacaaagcacctcgaaaataactgtccgtttgacatctccattatcaatcgcctggttagagatgtgcggatctctacctggcaggctaaaagcacaaacaccgacgccacagtggcgtccgctacctctttcgagacgaaggataccgacgataagctggccggggtctgcggatttttcgacgatattacaaaacccaagcagggccagcgcaaagccatcatttgttatgacctcagctgcaatcaaacccattgtctgcctacacttcacctgatctttccccagcagttctgccagtccctcaagcaatgtagcattaacgcttacgatcataaaatcctgattaccatctctctttccttttgccctgaagggctgatcattggaggcaattgtatcgtgcccgttctcgcccagagccagctgctgcacaaccacatgacgtataatattaaggtgacatgcttctttgagtactctatggctagagagtccctcgacaacaagttcctggaagagatgaatcggcttgtcctgggccgcaactgtgaaaagaccgagtatctcgggggatacgtgtgctttctggccggctatgggacagcgatccatgttccttacgataatacctaccttagcggagccgtggtcaactctatgaaggctaatctgcacggcgaggaccatgacagactcaaactgggggatacctccgccgtgattgctggaaacctgaagttcgtgatcgacagcacagccccggaaaaatcctatcagggcgagtgcttcacgggccacatggggtacacctctctctatttttaccccgtccggagcaagggaaaatatgttacaatcctgaccaagggcgtgattcctgtgatcaacaagacaacctgtatgcccaaaattgtccctcttgtgtggacggggatggttgaaatgcgcggaatcgaggaaaagctggaggcgtgcacaatgcactgtattatggtgggcaatggggctacctgcgaggccttctccgccaccggaatctttgatatcaaaagcacaacctgtcaaattggcaagacacataaatacagacggacggaagaccagatcaccttcacatgccaggatctcaacaaggacatttctgtcatctgtaatggcgagaacattaccgtgcccgttaagtccctgatcgtggggcaatgcatttatacaatcaccagcatcttttctattttcccggctacggcccacagcatcgccaccgaaatgtgtgtccagggcattcatggatggcttacaatcattatctttttcaccttttgcttcgggtggctgctcatccctattctgacatgtctgatcattaataccatcgcttactccctcattacgctggcgtactttaaaaacggagcccgccttggcaatctgatcaagagaatgaaatctgagttccagcggacaatcgggaacaccacatgcaatatttgcctccgcgaatgtgagagcgagtccgaatataagagccacgaggaactgtgcaaaaacggctcttgtccctactgcatgaaggatatcggagtgtcccaggtcctgcttaatgagcattataacgcttgtatgctcattgacagatacgaaaagcggctgacccacaccctgaatcaaacacctctctatagcagaaaagtgcgcaagatccagtcttttcggtacagaaaccgctgcttcattctgacggtttggatcatccttctgaccgtggagtccctcatttgggccagctccgccgaggatatcaaacccgctcccaagtggcagaatacagcccacggcattgggaccatcaaactgaactctgactatgaactggatttcagcgtcgtggcgggatccgagtttacacataagcggatgcttcagtctcctgaaagcggcaagaaaaacattccgttcaccgtttacctctccgagcaactgatcacgagcacagtgcagattctggggaattggatggacgctgagatcaacgtcaagtctgtgtttcactgttacggaacctgcaaaaagtattcctacccctggcagagctctccttgtcataaagaagtggacttcgagtttcagtccagctggggctgcaatcccatctcttgtcctgggattaacagcggctgcaccgcctgcggaacatatgttgataagctcaaaaccatcgccaaggcttacagaattatcacagtcaagtattcccgcaaagtgtgttaccaaattggcacgaagaaagcctgcaagaccctggaaagcaatgactgtcttgtgtctaacggggtcaaaatctgcgctatcggaacaatttccaccctgcagacaggcatgaccctcgtgttctttgggcccctgaatggaggcgccctgcttatcaaggattggtgtattagctcctgcaagttcggggacccgggcgatatcatgcagatttctaacaatatcacgtgtcctagctttgacggaaccatgcagcgggtttgcagattcggcctcgagcccatgtgttcctattctgggaacaaaatcagcggagtgaagcgcgtcctggaaacaaaagattcctacctgtctgtgaatctcaccaagcctaaactggttggcagcacacttctgtggaactccctcgacagctctattaaggatcacatcaatattgtggtctccaacgacatcgattttgaggacctggcggagaccccctgcaaggtgacaattaaaaatctgaagatcgaaggggcctggggaagcggcattgggatcaaacttcactgtgaggtttctctctccgaatgcagcgagtacctgaccacgatcaaggtgtgcgataacgctatttgttatggcggaaacgtcgcccatctgtctcggggcctcaatacagtgatcattaaaggggctggaggccactccgggagctccttcaagtgctgtcatgaaaccagctgctctgacatcggatttaaggccgaggcgcctcacctggccagaattgtggacgatggcatcaccacaagcatgtcctactctgacggcgctcccgaggccgggatcattagctggatctataaagtcgctgaatggattaagggaatgttcaacggcaattggttcgttcttatcattatgatcctgtttctcatcatttccatcgtgctgctgattttcctttgtccggtgaaaaagtacaaatga

SEQ ID NO: 13421 - RNA, 3402 nt, synthetic construct
  misc_feature 1..3402: note = derived and/or modified CDS sequence (opt5) from LQUV(Longquan-Ra-5)__JX465398.1__GP
  source 1..3402: mol_type = other RNA
atgaaaagcatcctgctcattctgcttctgggccaggtgagatccaaagccaccaacgagatcaagctcgaatgcccccacgaccaacgggtcgagacagggttctctcatggatttacggatctgagccctattctttacaccaaaggcctgttcacaaagcacctcgaaaataactgtccgtttgacatctccattatcaatcgcctggttagagatgtgcggatctctacctggcaggctaaaagcacaaacaccgacgccacagtggcgtccgctacctctttcgagacgaaggataccgacgataagctggccggggtctgcggatttttcgacgatattacaaaacccaagcagggccagcgcaaagccatcatttgttatgacctcagctgcaatcaaacccattgtctgcctacacttcacctgatctttccccagcagttctgccagtccctcaagcaatgtagcattaacgcttacgatcataaaatcctgattaccatctctctttccttttgccctgaagggctgatcattggaggcaattgtatcgtgcccgttctcgcccagagccagctgctgcacaaccacatgacgtataatattaaggtgacatgcttctttgagtactctatggctagagagtccctcgacaacaagttcctggaagagatgaatcggcttgtcctgggccgcaactgtgaaaagaccgagtatctcgggggatacgtgtgctttctggccggctatgggacagcgatccatgttccttacgataatacctaccttagcggagccgtggtcaactctatgaaggctaatctgcacggcgaggaccatgacagactcaaactgggggatacctccgccgtgattgctggaaacctgaagttcgtgatcgacagcacagccccggaaaaatcctatcagggcgagtgcttcacgggccacatggggtacacctctctctatttttaccccgtccggagcaagggaaaatatgttacaatcctgaccaagggcgtgattcctgtgatcaacaagacaacctgtatgcccaaaattgtccctcttgtgtggacggggatggttgaaatgcgcggaatcgaggaaaagctggaggcgtgcacaatgcactgtattatggtgggcaatggggctacctgcgaggccttctccgccaccggaatctttgatatcaaaagcacaacctgtcaaattggcaagacacataaatacagacggacggaagaccagatcaccttcacatgccaggatctcaacaaggacattggcgtcatctgtaatggggagaacattaccgtgcccgttaagtctctgatcgtgggacaatgcatttatacaatcacctccatctttagcattttcccggctacggcccactctatcgccaccgaaatgtgtgtccagggcattcatgggtggcttacaatcattatctttttcaccttttgcttcggatggctgctcatccctattctgacatgtctgatcattaataccatcgcttacagcctcattacgctggcgtactttaaaaacggcgcccgccttgggaatctgatcaagagaatgaaatccgagttccagcggacaatcggcaacaccacatgcaatatttgcctccgcgaatgtgagtctgagagcgaatataagtcccacgaggaactgtgcaaaaacggaagctgtccctactgcatgaaggatatcggcgtgtctcaggtcctgcttaatgagcattataacgcttgtatgctcattgacagatacgaaaagcggctgacccacaccctgaatcaaacacctctctattccagaaaagtgcgcaagatccagagctttcggtacagaaaccgctgcttcattctgacggtttggatcacccttctgacagtggagtctctcatctgggcctccagcgccgaggatattaaacccgctcccaagtggcagaataccgcccacgggatcggaacaattaaactgaactccgactatgaactggatttctctgtcgtggcgggcagcgagtttacccataagcggatgcttcagtcccctgaatctgggaagaaaaacatcccgttcacggtttacctcagcgagcaactgattacatccaccgtgcagatcctgggaaattggatggacgctgagattaacgtcaagagcgtgtttcactgttacgggacctgcaaaaagtattcttacccctggcagtccagcccttgtcataaagaagtggacttcgagtttcagtcttcctggggctgcaatcccatcagctgtcctggcatcaactctggatgcacagcctgcggcacctatgttgataagctcaaaacaattgccaaggcttacagaatcattacggtcaagtatagccgcaaagtgtgttaccaaatcgggaccaagaaagcctgcaagacactggaatccaatgactgtcttgtgagcaacggagtcaaaatttgcgctatcggcaccatctctacactgcagaccgggatgacgctcgtgttctttggacccctgaatggcggggccctgcttattaaggattggtgtatctccagctgcaagttcggcgacccgggagatattatgcagatctccaacaatattacctgtccttcttttgacggcacaatgcagcgggtttgcagattcgggctcgagcccatgtgtagctattccggaaacaaaatctctggcgtgaagcgcgtcctggaaaccaaagatagctacctgtccgtgaatctcacaaagcctaaactggttgggtctacccttctgtggaacagcctcgactccagcatcaaggatcacattaatatcgtggtctctaacgacattgattttgaggacctggcggagacaccctgcaaggtgaccatcaaaaatctgaagattgaaggagcctggggctccgggatcggcattaaacttcactgtgaggttagcctctctgaatgctccgagtacctgacgacaatcaaggtgtgcgataacgctatctgttatggaggcaacgtcgcccatctgagccgggggctcaataccgtgattatcaaaggagctggcgggcactctggatccagcttcaagtgctgtcatgaaacctcctgcagcgacattggctttaaggccgaggcgcctcacctggccagaatcgtggacgatggcattacaacctctatgagctactccgacggggctcccgaggccggaatcgtctcttggatctataaagttgctgaatggattaagggcatgttcaacgggaattggttcgtgcttatcattatgatcctgtttctcattatcagcatcgtgctgctgattttcctttgtccggtcaaaaagtacaaatga

SEQ ID NO: 13422 - RNA, 3402 nt, synthetic construct
  misc_feature 1..3402: note = derived and/or modified CDS sequence (opt5) from LQUV(Longquan-Ra-56)__JX465399.1__GP
  source 1..3402: mol_type = other RNA
atgaaaagcatcctgctcattctgcttctgggccaggtgagatccaaagccaccaacgagatcaagctcgaatgcccccacgaccaacgggtcgagacagggttctctcatggatttacggatctgagccctattctttacaccaaaggcctgttcacaaagcacctcgaaaataactgtccgtttgacatctccattatcaatcgcctggttagagatgtgcggatctctacctggcaggctaaaagcacaaacaccgacgccacagtggcgtccgctacctctttcgagacgaaggataccgacgataagctggccggggtctgcggatttttcgacgatattacaaaacccaagcagggccagcgcaaagccatcatttgttatgacctcagctgcaatcaaacccattgtctgcctacacttcacctgatctttccccagcagttctgccagtccctcaagcaatgtagcattaacgcttacgatcataaaatcctgattaccatctctctttccttttgccctgaagggctgatcattggaggcaattgtatcgtgcccgttctcgcccagagccagctgctgcacaaccacatgacgtataatattaaggtgacatgcttctttgagtactctatggctagagagtccctcgacaacaagttcctggaagagatgaatcggcttgtcctgggccgcaactgtgaaaagaccgagtatctcgggggatacgtgtgctttctggccggctatgggacagcgatccatgttccttacgataatacctaccttagcggagccgtggtcaactctatgaaggctaatctgcacggcgaggaccatgacagactcaaactgggggatacctccgccgtgattgctggaaacctgaagttcgtgatcgacagcacagccccggaaaaatcctatcagggcgagtgcttcacgggccacatggggtacacctctctctatttttaccccgtccggagcaagggaaaatatgttacaatcctgaccaagggcgtgattcctgtgatcaacaagacaacctgtatgcccaaaattgtccctcttgtgtggacggggatggttgaaatgcgcggaatcgaggaaaagctggaggcgtgcacaatgcactgtattatggtgggcaatggggctacctgcgaggccttctccgccaccggaatctttgatatcaaaagcacaacctgtcaaattggcaagacacataaatacagacggacggaagaccagatcaccttcacatgccaggatctcaacaaggacatttctgtcatctgtaatggcgagaacattaccgtgcccgttaagtccctgatcgtggggcaatgcatttatacaatcagctctatctttagcattttcccggctaccgcccactccatcgccacggaaatgtgtgtccagtctattcatggatggcttaccatcattatctttttcacattttgcttcggctggctgctcatccctattctgacctgtctgatcattaatacaatcgcttacagcctcattaccctggcgtactttaaaaacggggcccgccttggaaatctgatcaagagaatgaaatccgagttccagcggacgatcggcaacacaacctgcaatatttgcctccgcgaatgtgagagcgagtctgaatataagtcccacgaggaactgtgcaaaaacgggagctgtccctactgcatgaaggatatcggcgtgtctcaggtcctgcttaatgagcattataacgcttgtatgctcattgacagatacgaaaagcggctgacacacaccctgaatcaaacccctctctattccagaaaagtgcgcaagatccagagctttcggtacagaaaccgctgcttcattctgacagtttggatcatccttctgacggtggagtccctcatttgggcctctagcgccgaggatatcaaacccgctcccaagtggcagaataccgcccacggaattggcacaatcaaactgaactccgactatgaactggatttctctgtcgtggcggggagcgagtttacccataagcggatgcttcagtcccctgaaagcggaaagaaaaacattccgttcacagtttacctctctgagcaactgatcacctccacggtgcagattctgggcaattggatggacgctgagatcaacgtcaagagcgtgtttcactgttacgggacatgcaaaaagtattcttacccctggcagtccagcccttgtcataaagaagtggacttcgagtttcagtctagctggggatgcaatcccatctcctgtcctggcattaacagcgggtgcaccgcctgcggcacctatgttgataagctcaaaacaatcgccaaggcttacagaattatcaccgtcaagtattctcgcaaagtgtgttaccaaattggaacaaagaaagcctgcaagacgctggaatccaatgactgtcttgtgagcaacggcgtcaaaatctgcgctatcgggaccatttccacactgcagaccggaatgacactcgtgttctttggccccctgaatgggggagccctgcttatcaaggattggtgtatttctagctgcaagttcggcgacccgggggatatcatgcagatttccaacaatatcacctgtccttcttttgacggcacgatgcagcgggtttgcagattcggactcgagcccatgtgtagctattccggcaacaaaatctctggggtgaagcgcgtcctggaaaccaaagatagctacctgtccgtgaatctcacaaagcctaaactggttggaagcacccttctgtggaactctctcgactccagcattaaggatcacatcaatattgtggtctctaacgacatcgattttgaggacctggcggagacaccctgcaaggtgaccattaaaaatctgaagatcgaaggcgcctgggggtccggaattggcatcaaacttcactgtgaggttagcctctctgaatgctccaagtacctgacaaccatcaaagtgtgcgataacgctatttgttatgggggcaacgtcgcccatctgagccggggactcaatacggtgatcattaagggcgctgggggacactccggcagctctttcaagtgctgtcatgagacaagctgctccgacatcgggtttaaagccgaagcgcctcacctggccagaattgtggacgatggaatcaccacctctatgagctactccgacggcgctcccgaggccggcatcgtctcttggatttataaggttgctgagtggatcaaagggatgttcaacggaaattggttcgtgcttattatcatgattctgtttctcatcatcagcattgtgctgctgatcttcctttgtccggtcaagaaatacaagtga

SEQ ID NO: 13423 - RNA, 3402 nt, synthetic construct
  misc_feature 1..3402: note = derived and/or modified CDS sequence (opt5) from LQUV(Longquan-Ra-90)__JX465400.1__GP
  source 1..3402: mol_type = other RNA
atgaaaagcatcctgctcattctgcttctgggccaggtgagatccaaagccaccaacgagatcaagctcgaatgcccccacgaccaacgggtcgagacagggttctctcatggatttacggatctgagccctattctttacaccaaaggcctgttcacaaagcacctcgaaaataactgtccgtttgacatctccattatcaatcgcctggttagagatgtgcggatctctacctggcaggctaaaagcacaaacaccgacgccacagtggcgtccgctacctctttcgagacgaaggataccgacgataagctggccggggtctgcggatttttcgacgatattacaaaacccaagcagggccagcgcaaagccatcatttgttatgacctcagctgcaatcaaacccattgtctgcctacacttcacctgatctttccccagcagttctgccagtccctcaagcaatgtagcattaacgcttacgatcataaaatcctgattaccatctctctttccttttgccctgaagggctgatcattggaggcaattgtatcgtgcccgttctcgcccagagccagctgctgcacaaccacatgacgtataatattaaggtgacatgcttctttgagtactctatggctagagagtccctcgacaacaagttcctggaagagatgaatcggcttgtcctgggccgcaactgtgaaaagaccgagtatctcgggggatacgtgtgctttctggccggctatgggacagcgatccatgttccttacgataatacctaccttagcggagccgtggtcaactctatgaaggctaatctgcacggcgaggaccatgacagactcaaactgggggatacctccgccgtgattgctggaaacctgaagttcgtgatcgacagcacagccccggaaaaatcctatcagggcgagtgcttcacgggccacatggggtacacctctctctatttttaccccgtccggagcaagggaaaatatgttacaatcctgaccaagggcgtgattcctgtgatcaacaagacaacctgtatgcccaaaattgtccctcttgtgtggacggggatggttgaaatgcgcggaatcgaggaaaagctggaggcgtgcacaatgcactgtattatggtgggcaatggggctacctgcgaggccttctccgccaccggaatctttgatatcaaaagcacaacctgtcaaattggcaagacacataaatacagacggacggaagaccagatcaccttcacatgccaggatctcaacaaggacatttctgtcatctgtaatggcgagaacattaccgtgcccgttaagtccctgatcgtggggcaatgcatttatacaatcaccagcatcttttctattttcccggctacggcccacagcatcgccaccgaaatgtgtgtccagggcattcatggatggcttacaatcattatctttttcaccttttgcttcgggtggctgctcatccctattctgacatgtctgatcattaataccatcgcttactccctcattacgctggcgtactttaaaaacggagcccgccttggcaatctgatcaagagaatgaaatctgagttccagcggacaatcgggaacaccacatgcaatatttgcctccgcgaatgtgagagcgagtccgaatataagagccacgaggaactgtgcaaaaacggctcttgtccctactgcatgaaggatatcggagtgtcccaggtcctgcttaatgagcattataacgcttgtatgctcattgacagatacgaaaagcggctgacccacaccctgaatcaaacacctctctatagcagaaaagtgcgcaagatccagtcttttcggtacagaaaccgctgcttcattctgacggtttggatcatccttctgaccgtggagtccctcatttgggccagctccgccgaggatatcaaacccgctcccaagtggcagaatacagcccacggcattgggaccatcaaactgaactctgactatgaactggatttcagcgtcgtggcgggatccgagtttacacataagcggatgcttcagtctcctgaaagcggcaagaaaaacattccgttcaccgtttacctctccgagcaactgatcacgagcacagtgcagattctggggaattggatggacgctgagatcaacgtcaagtctgtgtttcactgttacggaacctgcaaaaagtattcctacccctggcagagctctccttgtcataaagaagtggacttcgagtttcagtccagctggggctgcaatcccatctcttgtcctgggattaacagcggctgcaccgcctgcggaacatatgttgataagctcaaaaccatcgccaaggcttacagaattatcacagtcaagtattcccgcaaagtgtgttaccaaattggcacgaagaaagcctgcaagaccctggaaagcaatgactgtcttgtgtctaacggggtcaaaatctgcgctatcggaacaatttccaccctgcagacaggcatgaccctcgtgttctttgggcccctgaatggaggcgccctgcttatcaaggattggtgtattagctcctgcaagttcggggacccgggcgatatcatgcagatttctaacaatatcacgtgtcctagctttgacggaaccatgcagcgggtttgcagattcggcctcgagcccatgtgttcctattctgggaacaaaatcagcggagtgaagcgcgtcctggaaacaaaagattcctacctgtctgtgaatctcaccaagcctaaactggttggcagcacacttctgtggaactccctcgacagctctattaaggatcacatcaatattgtggtctccaacgacatcgattttgaggacctggcggagaccccctgcaaggtgacaattaaaaatctgaagatcgaaggggcctggggaagcggcattgggatcaaacttcactgtgaggtttctctctccgaatgcagcgagtacctgaccacgatcaaggtgtgcgataacgctatttgttatggcggaaacgtcgcccatctgtctcggggcctcaatacagtgatcattaaaggggctggaggccactccgggagctccttcaagtgctgtcatgaaaccagctgctctgacatcggatttaaggccgaggcgcctcacctggccagaattgtggacgatggcatcaccacaagcatgtcctactctgacggcgctcccgaggccgggatcgtcagctggatttataaagttgctgaatggatcaagggaatgttcaacggcaattggttcgtgcttattatcatgattctgtttctcatcatctccattgtgctgctgatcttcctttgtccggtcaaaaagtacaaatga

SEQ ID NO: 13424 - RNA, 3423 nt, synthetic construct
  misc_feature 1..3423: note = derived and/or modified CDS sequence (opt5) from NYV(Rhode Island-1 (RI-1))__U36801.1__GP
  source 1..3423: mol_type = other RNA
atggtgggctgggtctgcatcttcctggttgtgctcgccaccacaacggctgggctgaccagaaacctttacgagctgaagattgaatgtccccacacagtgggactcggccaggggtatgtcaccggaagcgtggagacaacccctatcctgcttacacaagttaccgacctgaaaattgaatcctcttgcaattttgatctccatgtgccgagcacgtccatccagaagtacaaccaggtcgagtgggccaaaaagtctagcaccacagaatccacctctgcgggcgctacaaccttcgaggccaaaacgaaggaggtgagcctgaaggggacatgtaatattcccgttaccacatttgaagccgcttataaatccagaaagaccgtgatctgctacgacctggcctgtaaccagacctattgcctccctacagtccacctgatcgctcccgtgcaaacgtgtatgagcgtgcgctcttgcatgattggacttctgtccagcagaatccaggtcatttacgagaaaacctattgtgttacaggccagctcgtggaaggcctgtgcttcatccctacccatacaattgcccttacccagcccgggcacacgtacgatacaatgaccctgcctatcacctgttttctcgtggcgaagaaactgggaacacaactgaagattgccgtcgagctcgagaagctgatcaccgcttctggctgcacagaaaattccttccaggggtactatatctgctttcttggaaaacatagcgagccgctgtctgtgcccatgatggacgattaccggtccgccgaactcttcacgcgcatggttctgaaccctagaggcgaggaccacgatcccgaccagaatgggcagggacttatgcggattgctggccctatcaccgccaaggtgcccagcacagaaaccacagagaccatgcaaggcattgcgtttgccggggctccgacgtattcctctttcagcaccctggtccgcaaagccgatcctgactacgtgttttcccccggaatcattgctgagagcaaccactctgtttgtgataagaaagccatccctctcacatggaccggcttcctggccgtgtccggggaaatcgagaagattacaggatgcaccgtcttttgtacgctggtgggccccggggctagctgcaaagcgtattctgaaacaggaatcttcaatattagctcccccacctgtctcgtcaacaaggtgcagaagttcagaggctctgagcagcggatcaattttatgtgccaacgcgttgaccaggatgtgattgtctactgtaacggccagaaaaaggtgatcctgacaaaaacccttatcattgggcagtgcatctataccttcacaagcctgttttccctcattcctggagttgcccatagcctggctgtggaactttgtgtcccgggcctgcacgggtgggccacggccgctctcctgatcaccttctgctttggatggctgctcattcccacaatcaccatgattatcctgaagatccttagactgctcacattctcttgttcccattacagcaccgagtctaaatttaaggccattctggagcgggtgaaggtggaataccagaaaacgatgggctccatggtttgcgacgcgtgccaccacgagtgtgaaacagctaaggagctggaaacccataaaaagagctgccctgaggggcaatgtccctattgcatgaccatgacagagtccaccgaatctgcccttctcgcccacttcagcatctgtaaactgacaaatcgctttcaggagaacctgaagaagtccctcaaaagacctgaagtcaagcagggccggtaccgcacgctgggagtgttcagatataaatctcggtgctacgtgggccttgtctggggagtgctgctcaccacagagctgattgtttgggctgccagcgctgacacacccctgatggagtccggatggagcgataccgcccatggcgtggggatcgtcccgatgaagaccgaccttgaactcgattttgcgctggcctcttccagctcttattcctacagacgcaaactggtgaatcctgctaacaaggaggaaacgctccccttccactttcaactggacaagcaggttgtgcatgccgagattcagaaccttggacactggatggatggcaccttcaatatcaaaacagctttccactgttatggggaatgcaagaaatacgcctacccttggcagaccgcgaagtgctttttcgagaaagactatcaatacgagacaagctggggctgtaatccccctgattgtcccggagtcggcaccgggtgcacagcctgcggagtgtatctggacaagctccggtctggcgggaaggcttacaaaatcgttagcctgaagtttaccagaaaagtgtgtattcagctgggaacggaacagacatgcaagcatatcgatgtcaacgactgtcttgtgaccccgtccgtgaaagtctgcctcattggcaccatcagcaagctgcagcctggggatacactcctgttcctgggcccccttgagcaaggaggcattatcctgaaacagtggtgtaccacgtcttgcgtttttggggaccccggagacatcatgtccacaaccacaggcatgaagtgtcctgaacacaccgggagcttccgcaagatttgcggatttgccacaaccccgacgtgtgagtatcagggcaacaccatctccgggttccaacggatgatggctacaagagattcttttcagagcttcaatgtgaccgaaccccatattacatccaaccgcctcgagtggatcgaccctgattctagcattaaagaccacatcaatatggtgctgaaccgggatgtctcctttcaggacctgtctgataatccctgcaaggtggaccttcacacccagagcatcgatggcgcctggggatccggcgttgggttcacgctcgtgtgtacagtcggactgaccgagtgcgccaactttattacaagcatcaaggcttgcgactctgcgatgtgttacggcgccaccgtgaccaatctgctcagagggtccaacacagttaaagtggtcggaaaaggcggccattctagctccctgttcaagtgctgtcacgatacggactgcaccgaagaggggcttgctgccagccctccccatctggatcgcgtgacaggatataatcaaattgactctgacaaggtttacgatgacggcgcccctccctgtaccatcaaatgctggttcacaaagtccggggaatggctcctggggattctgaacggcaattgggtggtcgtggctgtgcttatcgtcattctgatcctcagcatcctgctcttttccttcttttgtccgattcgggggcggaaaaacaagagcaactga

SEQ ID NO: 13425 - RNA, 3423 nt, synthetic construct
  misc_feature 1..3423: note = derived and/or modified CDS sequence (opt5) from NYV(New York-1 (NY-1))__U36802.1__GP
  source 1..3423: mol_type = other RNA
atggtgggctgggtctgcatcagcctggttgtgctcgccaccacaacggctgggctgaccagaaacctttacgagctgaagattgaatgtccccacacagtgggactcggccaggggtatgtcaccggatccgtggagacaacccctatcctgcttacacaagttaccgacctgaaaattgaatctagctgcaatttcgatctccatgtgccgtccacgtctatccagaagtacaaccaggtcgagtgggccaaaaagagctccaccacagaatctaccagcgcgggcgctacaacctttgaggccaaaacgaaggaggtgtccctgaaggggacatgtaatattcccgttaccacattcgaagccgcttataaaagccggaagaccgtgatctgctacgacctggcctgtaaccagacccactgcctccctacagtccatctgatcgctcccgtgcaaacgtgtatgtctgtgcgctcctgcatgattggacttctgagctctagaatccaggtcatttatgagaaaacctactgtgttacaggccagctcgtggaaggcctgtgctttatccctacccacacaattgcccttacccagcccgggcatacgtatgatacaatgaccctgcctatcacctgtttcctcgtggcgaagaaactgggaacacaactgaagattgccgtcgagctcgagaagctgatcaccgcttccggctgcacagaaaatagctttcaggggtactacatctgcttccttggaaaacactctgagccgctgtttgtgcccatgatggacgattatcggtccgccgaactcttcacgcgcatggttctgaaccctagaggcgaggaccacgatcccgaccagaatgggcagggacttatgcggattgctggccctatcaccgccaaggtgcccagcacagaaaccacagagaccatgcaaggcattgcgtttgccggggctccgatgtactcctctttcagcacgctggtccgcaaagccgatcctgactatgtgttttcccccggaatcattgctgagagcaaccattctgtttgtgataagaaaaccatccctctcacatggaccggcttcctggccgtgtccggggaaatcgagaagattacaggatgcaccgtcttttgtacgctggtgggccccggggccagctgcgaggcttactctgaaacaggaatcttcaatattagctcccccacctgtctcgtcaacaaagtgcagaagttcagaggctctgaacagcggatcaattttatgtgccaacgcgttgaccaggatgtgattgtctattgtaacggccagaagaaagtgatcctgacaaagacccttgttatcgggcagtgcatttacaccttcacaagcctgttttccctcatccctggagtggcgcacagcctggccgtcgagctttgtgtgccgggcctgcatgggtgggctacgaccgccctcctgattacattctgctttggatggctgctcatccccaccattacaatgatcattctgaaaatccttagactgctcaccttctcttgttcccactatagcacggagtctaagtttaaagccatcctggaacgggtgaaggttgagtaccaaaagacaatgggctccatggtctgcgacgtgtgccaccatgaatgtgagaccgctaaagaactggagacccacaagaaaagctgccctgaggggcagtgtccctactgcatgacaatgaccgaatccacagagtctgcccttcaggcgcatttcagcatttgtaagctcacgaatcgctttcaggaaaacctgaaaaagtccctgaagagacctgaggtgaaacaaggctgctatcggaccctcggagtcttccgctacaagtctagatgttatgtgggcctggtttggggagtgcttctgacaaccgagctcatcgtctgggctgccagcgccgacacacccctgatggaatccgggtggagcgataccgctcacggcgtggggattgttccgatgaaaacggacctggagcttgattttgccctcgcttcttccagctcttactcctatcggagaaagctggtgaatcctgccaacaaagaagagaccctgcccttccattttcagctcgacaagcaggtcgtgcacgcggaaatccagaacctgggacactggatggatggcacattcaatattaagaccgccttccattgctacggggagtgtaaaaagtatgcttacccttggcaaacagccaaatgctttttcgagaaggactaccagtatgaaaccagctggggctgtaatccccctgattgccccggagttggcacagggtgcaccgcttgtggagtgtaccttgacaaactgcgctctgtcggcaaggcctataaaatcgtgagcctcaagtttacgcggaaggtgtgcatccagctggggacagagcagacctgtaaacacattgatgtcaacgactgcctggttaccccgtccgtgaaggtgtgtcttatcggaacaattagcaaactccaacctggcgataccctgctgttcctcgggcccctggaacagggcggaatcattcttaagcagtggtgcacgacatcttgtgtctttggcgaccccggggacatcatgtccaccacaaccggaatgaaatgccctgagcatacaggcagcttcagaaagatctgtgggtttgcgaccacgccgacctgcgaataccaaggaaacacaatttccggcttccagcgcatgatggccacccgggattcttttcagagcttcaatgtgacagagccccacatcacctccaacagactggagtggattgaccctgattctagcatcaaggaccacattaatatggttctcaaccgcgatgtgtcctttcaggacctgtctgataatccctgtaaagtcgacctgcatacgcaaagcatcgatggggcttggggctccggagtgggcttcacacttgtttgcaccgtggggctcacagaatgcgccaactttatcaccagcattaaggcttgtgactctgccatgtgctatggagccaccgtcacaaatctgctgcggggctccaacacggtgaaagttgtggggaagggaggccacagcggctctctcttcaaatgttgccatgataccgactgtacagaggaagggctggctgcgtcccctccccaccttgatagagtcaccggatacaatcagatcgacagcgacaaggtgtatgatgacggcgcccctccctgcacaattaagtgttggttcaccaaatctggggagtggctgctcggaatcctgaacggcaattgggtggtcgttgctgtgctgattgtgatccttattctgtccatcctcctgtttagcttcttttgcccgatccgcgggcggaagaacaaatccaactga

SEQ ID NO: 13426 - RNA, 3423 nt, synthetic construct
  misc_feature 1..3423: note = derived and/or modified CDS sequence (opt5) from NYV(New York-2 (NY-2))__U36803.1__GP
  source 1..3423: mol_type = other RNA
atggtgggcttcgtctgcatctttctggttgtgctcgccaccacaacggctgggctgaccagaaacctttacgagctgaagattgaatgtccccacacagtgggactcggccaggggtatgtcaccggaagcgtgggcacaacccctatcctgcttacacaagttaccgacctgaaaattgagtcctcttgcaatttcgatctccatgtgccgagcacgtccatccagaagtacaaccaggtcgaatgggccaaaaagtctagcaccacagagtccacctctgcgggggctacaacctttgaagccaaaacgaaggaggtgagcctgaagggaacatgtaatattcccgttaccacattcgaggccgcttataaatcccggaagaccgtgatctgctacgacctggcctgtaaccagacccactgcctccctacagtccatctgatcgctcccgtgcaaacgtgtatgagcgtgcgctcttgcatgattggccttctgtccagcagaatccaggtcatttatgagaaaacctactgtgttacaggccagctcgtggaggggctgtgctttatccctacccacacaattgcccttacccagcccggacatacgtatgatacaatgaccctgcctatcacctgtttcctcgtggcgaagaaactgggcacacaactgaagattgccgtcgaactcgagaagctgatcaccgctgggggatgcacagagaatagctttcagggctactacatctgcttccttgggaaacactccgaaccgctgtttgtgcccatgatggacgattatcggagcgccgaactcttcacgcgcatggttctgaaccctagaggagaagaccacgatcccgaccagaatggccagggccttatgcggattgctgggcctatcaccgccaaggtgccctctacagagaccacagaagcgatgcaaggaattgcctttgctggcgccccgatgtactccagcttctccaccctggtccgcaaagctgatcctgactatgtgttttctcccgggatcattgccgagagcaaccattccgtttgtgataagaaaacgatccctctcacctggacaggattcctggccgtgagcggcgagatcgaaaagattaccgggtgcacagtcttctgtaccctggtgggacccggcgcttcttgcgaggcgtactccgaaacgggcatctttaatattagctctcccacatgtctcgtcaacaaagtgcagaagttcagagggagcgagcagcggatcaattttatgtgccaacgcgttgaccaggatgtgattgtctattgtaacggacagaagaaagtgatcctgaccaagacacttgttatcggccagtgcatttacaccttcacctccctgttttctctcatccctggggtggcccacagcctggctgtcgaactttgtgtgccgggactgcatggctgggccacaacggccctcctgattaccttctgctttgggtggctgctcatccccacaattaccatgatcattctgaaaatccttagactgctcacattctcctgtagccactattctaccgagtccaagtttaaagctatcctggagcgggtgaaggttgaataccaaaagacgatgggcagcatggtctgcgacgtgtgccaccatgagtgtgaaacagccaaagagctggaaacccacaagaaatcttgccctgagggacagtgtccctactgcatgaccatgacagagtccaccgaaagcgcgcttcaggctcatttctccatttgtaagctcacaaatcgctttcaggagaacctgaaaaagtctctgaagagacctgaagtgaaacaaggctgctatcggacgctcggggtcttccgctacaagagcagatgttatgtgggactggtttggggcgtgcttctgaccacagagctcatcgtctgggccgcctccgctgacacacccctgatggagtctgggtggagcgataccgcccacggagtgggcattgttccgatgaaaaccgacctggaacttgattttgctctcgcctcctcttcttcctacagctatcggagaaagctggtggaccctgcgaataaagaggaaacgctgcccttccatttccagctcgataagcaggtcgtgcacgccgagatccagaacctggggcactggatggacggcacctttaacattaagacagctttccattgctacggagaatgtaaaaagtatgcctacccttggcaaaccgctaaatgctttttcgagaaggattaccagtatgagacatcttggggctgtaatccccctgactgccccggggttggaaccggctgcacagcctgtggggtgtaccttgataaactgcgctccgtcggaaaggcgtataaaatcgtgagcctcaagtttacccggaaggtgtgcatccagctgggcacggaacagacatgtaaacacattgacgtcaacgattgcctggttaccccgtctgtgaaggtgtgtcttatcgggaccattagcaaactccaacctggcgacacactgctgttcctcggacccctggagcagggcgggatcattcttaagcagtggtgcaccacgtcctgtgtctttggagaccccggcgatatcatgagcacaaccacagggatgaaatgccctgaacataccggatctttcagaaagatctgtggctttgccacaaccccgacgtgcgagtaccaagggaataccatttccggcttccagcgcatgatggctacacgggacagctttcagtccttcaacgtgaccgaaccccacatcacatctaatagactggagtggattgatcctgacagctccatcaaggatcacattaacatggttctcaatcgcgacgtgtcttttcaggatctgagcgacaacccctgtaaagtcgatctgcatacccaatccatcgacggagcctggggctctggggtgggattcacgcttgtttgcacagtgggcctcaccgagtgcgctaatttcatcacaagcattaaggcctgtgattccgccatgtgctatggggctaccgtcaccaacctgctgcggggaagcaatacagtgaaagttgtgggcaagggcgggcactctggatccctctttaaatgttgccatgacacggattgtaccgaagagggcctggcggccagccctccccaccttgacagagtcacagggtacaaccagatcgactctgataaggtgtatgacgatggagctcctccctgcaccattaagtgttggttcacaaaatccggcgaatggctgctcgggatcctgaatggaaactgggtggtcgttgccgtgctgattgtgatccttattctgagcatcctcctgttttctttcttttgcccgatccgcggccggaagaataaatccaactga

SEQ ID NO: 13427 - RNA, 3447 nt, synthetic construct
  misc_feature 1..3447: note = derived and/or modified CDS sequence (opt5) from PUUV(K27)__L08754.1__GP
  source 1..3447: mol_type = other RNA
atgggcgagctgagccccgtgtgcctctacctgcttctgcaggggctcctgctttgtaacaccggagccgctagaaatctgaacgaactcaagatggagtgccctcacacaatccggctgggccaagggctggtcgttggatccgtggaactcccgtctctgcccattcaacaggtggagacgcttaaactggaaagctcctgtaatttcgacctccatacctctacagccggccagcagagctttaccaagtggacatgggagatcaaaggggatctggcggagaacacccaggcttcctctaccagcttccagacaaagtccagcgaagtcaatcttcgcggactgtgcctcattcctacgctggtggttgagaccgccgccagaatgcggaaaacaatcgcttgttatgacctgtcttgcaaccagaccgtgtgtcaacccacagtctacctcatgggccctattcagacctgcatcacgacaaagtcctgtctgcttagcctgggcgatcagcgcatccaggtgaattatgaaaagacctactgcgtttctgggcaactcgtggagggaatttgttttaaccccatccacacaatggccctgtcccagcctagccatacctatgacattatgaccatgatggtcagatgcttccttgtgatcaaaaaggtgacatctggcgattccatgaaaattgagaagaattttgaaacgctggtccagaaaaacgggtgcaccgctaataacttccaaggatactatatctgtctcattggcagctcctctgagccgctgtacgttcccgccctggacgattaccggagcgcggaagtgctctcccgcatggcctttgctcctcacggggaggaccatgatatcgaaaagaatgccgtgagcgctatgagaatcgccggaaaggtcacaggcaaagcgccctctaccgagtccagcgacacagtgcagggcattgccttctctgggagccctctgtatacctccacgggagttcttacatctaaggatgaccccgtgtacatctgggctccgggcattatcatggaggggaaccacagcatttgcgagaaaaagaccctgcctctcacctggacaggatttatctccctgcccggcgaaatcgagaaaaccacacagtgtacggtcttctgcacccttgccgggcctggagctgattgtgaagcctatagcgaaacaggcatttttaatatctcttcccctacctgcagcattaaccgggtgcagcgcttcagaggctctgagcaacagatcaagtttgtttgtcagcgggtggacatggacattacagtctactgcaacgggatgaaaaaggtgatcctgaccaagacgctcgtcatcggacagtgtatttataccttcacatccatcttcagcctgattcccggcgtggcccactccctggctgttgagctctgcgtgcccgggctgcatggatgggcgaccatgcttctgctcctgacactgtgttttggctgggtccttatcccgaccattacgatgatcctcctgaaaattctgatcgccttcgcttacctctgctctaagtataatacagatagcaaatttcgcatcctgattgaaaaggtgaaaagagagtaccaaaagaccatggggtccatggtttgcgaagtgtgtcagtacgagtgcgaaacagccaaggagcttgagtctcaccggaaaagctgttccatcggcagctgcccctattgtctgaacccttctgaagccaccacctccgctctccaggcccatttcaaggtctgcaaactgacaagccgctttcaggagaatctgagaaagtctcttacggtgtacgaacccatgcaaggatgttatcggaccctctccctgttcagataccgcagccggtttttcgtgggcctggtttggtgcgtcctcctggtgcttgagctgattgtgtgggcggcttctgccgagacacagaacctcaatgccgggtggaccgacacagctcacggaagcggcatcattcctatgaaaaccgatctggaactggacttttcccttcccagctctgcctcctatacgtacagacgccagctccagaacccggctaatgagcaagaaaagatccctttccatctgcagctgagcaagcaggtcatccacgccgagattcaacacctcgggcattggatggatgcgacatttaacctgaaaaccgccttccactgttatggatcctgcgaaaagtacgcttacccctggcagaccgccggctgttttatcgagaaagactatgagtacgaaacagggtggggctgcaatcctcccgattgccctggagtgggcaccgggtgtacagcttgcggagtttatcttgacaagctgaaatctgtgggcaaggtcttcaagattgtgagcctccggtacacgagaaaagtttgtatccagctggggaccgagcagacatgcaagaccgtggattccaacgactgtctgattacaacctctgtcaaagtgtgccttatcggaacgatcagcaagttccaaccctccgataccctcctgtttctgggcccgctccagcagggaggcctgattttcaaacagtggtgtacaaccacatgccaatttggagaccctggcgacatcatgtctacccccacagggatgaagtgtcccgaacttaatgggagcttccgcaaaaagtgcgcctttgcgaccacgcctgtttgtcagttcgatggcaacacaatttccgggtataagcggatgatcgccaccaaagacagctttcagtctttcaatgtgaccgagccgcatatttccacaagcgctctggaatggatcgatcccgactcttccctcagagatcacatcaacgtcattgtgagccgcgacctgtcttttcaggatctgtccgagaccccttgccaaatcgaccttgccacggctagcattgatggagcctggggctccggggtgggcttcaatctggtctgcacagttagcctcaccgagtgttctgcctttctgacaagcatcaaggcttgcgacgcggccatgtgttacggatccaccacagctaacctcgtgcggggccagaacaccattcacatcgtggggaaaggaggccattctgggagcaagttcatgtgctgtcacgatacgaaatgctcctctaccggactggtcgccgccgctccccatcttgacagagtgacaggctataatcaggccgatagcgacaagatttttgacgatggcgcgcctgaatgtgggatgtcctgctggttcaagaaatctggagagtggatcctgggcgttctcaacgggaattggatggtggtcgctgtgctggttgtgctgcttatcctgagcattctcctgttcaccctctgttgcccccgccggccttcctacagaaaggaacacaaaccctga

SEQ ID NO: 13428 - RNA, 3447 nt, synthetic construct
  misc_feature 1..3447: note = derived and/or modified CDS sequence (opt5) from PUUV(13891)__U22418.1__GP
  source 1..3447: mol_type = other RNA
atgggcaagatcattcccgtgtgcctgtacctcctgttcctttgtctgctcctgtggaacagaggggacgcccggaatcttaacgagctgaaaatggaatgccctcacaccatcggactcggccaggggctggtcattggaagcgttgagctgccgcccgtgcctctcacacaagtggaatccctgaaacttgagtctagctgtaattttgatctgcatacgtccacctctagccagcagtccttcacaaaatggacctgggaaatcaagaacgacctcgctgagaatacacaggcctctagcacctcctttcaaacaaaaagctctgagattaacctgcgcggcctttgcctgattccccctctcgtcatcgaaaccgcggctagaacgcggaagaccattgcctgtttcgatctgtcctgcaatcagacagcctgtcagcccaccgtgtttctgatcgggcctattcagacatgcatcaccacaaagagctgtctcctgggacttggcgaccaacgcattcaggttaactatgagaaaacgtactgcgtgtctggccagctggtcgaaggggtgtgtttcaatccggttcacaccatggctctctcccagcccagccatacatatgatatcgtgaccgtcatggtgagatgctttctgattgtgaagaaagtctctaccggagactccatgaaacttgagaagtccttcgagacactggttcaaaagacgggctgcaccgggaacggatttcagggctactatgtgtgtctcgtggggagctctagcgaacctctgtacatccccacactggatgactatcggtccgccgagatcctcagccgcatggctttcgcccctcacggagaagatcatgacgtcgagaagaatgcgatttctgccatgagaatcgtgggcaaagttaccggcaaggctccctccacagaaagctctgataccattcaggggatcgcctttagcggaaacccgctgtacacgtccacaggcgtgcttaccgctaaagacgatcctgtctacatttgggcccccgggatcatcatggagggaaatcactctgtgtgcgacaagaaaaccctgcctctcacatggaccggcttcattcccctgcccggggagatcgaaaagacaacgcaatgtaccgtgttttgcacacttgcgggacctggcgccgactgtgaggcttatagcgaaaccggcattttcaacatctccagcccgacatgcctgattaatcgggttcagcgcttcagaggggccgagcagcagatcaaatttatctgtcaacgggtcgatatggacattaccgtgtactgcaacggactcaagaaggtcatcctgacgaaaaccctggtgattggccagtgtatctatacattcacctctatcttttccctcatccccggggttgctcacagcctggccgtggaactttgcgtccctggactgcatggctgggccacaatgctcctgctgcttaccttctgttttgggtggattctcatccccttcttttctatgatcctgctgaagattctcatcgctttcgcgtacctgtgctccaaatataacacggatagcaagtttaaaattcttatcgagaaggtgaagcgcgagtaccagaaaacaatgggctccatggtttgcgaagtgtgtcagtatgagtgcgaaaccgccaaggagctggaatctcacagaaaaagctgtcctattggatcctgcccctactgtctcaatccggctgaggccacaacctctgccctgcaagctcatttcaaggtctgcaaactgaccagccggtttcaggacaaccttcgcaagtccctcggcgcctacgagcctaagcaggggtgttatagaacactgagcctgttccggtacagatctcgctttttcgtgggattcaattggtgcctcctgcttgtgctggaactcatcgtttgggcggcttccgccgagacgcagagcctgaactctggctggaccgatacagcccacgggtccggaatcattcccatgcggaccgacctggaacttgattttagcctcccttctagcgcttcctatacatacagacgccaactgcagaatcccgccaacgagcaggagaaaatccctttccatctgcagattagcaagcaagtcatccacgctgaaattcagcacctcggccattggatggacgggacctttaatctgaaaacggccttccactgttatggctcttgcgagaagtacgcgtatccctggcagacagccggatgttttatcgaaaaagattacgagtacgaatccggctgggggtgcaacccgcctgactgccccggagtgggcaccgggtgtaccgcttgcggagtgtatcttgataagctcaagagcgtcggcaaagccttcaagatcgtgtccctgcggtacacaagaaaggcttgtattcaactggggaccgagcagacatgcaagtctgttgacagcaatgactgtctggtgacgacctccgtcaaagtgtgccttatcggcacagtttctaagtttcagcccagcgataccctcctgttcctgggacctctcgagcagggcgggctgatttttaaacaatggtgtacaaccacgtgccagttcggagacccgggcgatatcatgtccacccccgtggggatgaagtgtcctgaactttctggcagctttcgcaagaaatgcgccttcgcgacaacccccgtctgtcagtttgacggaaacacactgtccgggtataagcggatgattgccaccaaagatagcttccagtctttcaatgtgacagagcctcatatctccgctagctctctcgaatggatcgaccccgattccagcctgagagaccacattaacgttatcgtgggccgcgatctgtcttttcaagacctttccgagaccccttgccaggtcgatctggccacgacaagcattgacggagcttggggctccggggtgggattcaatctcgtgtgcagcgtctctctgaccgaatgtagcacctttctcacatccatcaaggcctgcgattctgccatgtgttacggcagcaccacggctaacctgcttcgggggcagaatacagttcacattgtgggaaaaggcggccattccgggtctaagttcatgtgctgtcacgacaccaagtgcagctccacaggactggtggcggccgctccccatctcgacagagtcaccggctataaccaggccgattctgacaaaatctttgatgacggggccccggagtgtggaattagctgctggttcacaaagtccggcgagtggatcctgggggtgctgaacggaaattggatggttgtggctgtccttatcgccctgtttattttcagcatctttctcttcaccctgtgttgccctcgccggccctcttacgcgaaagaacacaagccttga
